United States Patent 8,781,750 (CELL-TYPE-SPECIFIC PATTERNS OF GENE EXPRESSION) - sequence listing, part 53

SEQ ID NO: 38369 - DNA, 208261 bp, Homo sapiens
gacggcggcagtgcgagaaagccgaagatggcggtccccgcggcgctgatcctacgggagagccccaggtagctgatccgttaagctcttgcggtagccgcgcccaggaaggcccagatcgggctcgcacaaggctgtccttgctgcctgccgcctgggcgccgcggcgggcccggttgagtggggtggggtggggtgggctgccgaggttgcgacgctgcgtctgcggagtgcgtggggccgtgtagcgcctctacagtcacggtggtccacctgtggggctcacagtgcgcctggcagctgaggtctgtacggaagcgtgtggtctgcaagcgtggggtctgcgtcactgttcgcggagtttggtatcagaagttcccgggtgctgccttcagtgctgccgaatcacgtggaacggtattccgtttccgatttcagttccggttcagacactctggtgggaaaggctcacgctgctgctggagggtctttaatagccaacatgtgttaataccccttttaaatcagtatcgaataggggaccgaatttttggttggtagaagaatctagcctggctttggtagcatttgcttttatttgcattttaaacagatttttagttaatttctacttatggtagataaagttggttgtccatggtagtgatataaagctcccctttaacattatttaagtaaaaaaagactcaatttgtgaaaaaataagcaatagtgcaggtagcgtgtggatacagaaaaagtactgaagtatataggcaaaatagtgttcggaagtaatttctttgtgcttggattgggtagaaatctttcagaagaaaagagttattttaaagtttttccttctttctggattccttttgttaccagtggagggtgtccaggttcttggcgtcttgaacaaagaactggagaagacgcacaaagaaagcgaggaaagaatgaagaagacatttattgaaaatgaaactaccctccacagtgtgggagctgcttgagcataggggctgaagggcccctacagaatttttgggaatttaaataccctctagaggattccattggttacttggtgtactccctatgtaaatgaagaggatgaagtaaagttacaaagtcattttctccgcctatgccatatggagaggacatttcttgtcatagctgaagtgggaatcagctttatgttcccagcctcctgaccctattttcctgcctcactttggttctgatcgccagtttctttcctcataccagtgtcttggggaacaccgctacatcagtaaactgtatccaatatggtgcagtatagaattgttctcatcacatcatttaaagttgattattacaggaaaggtgctgtggctcatgcctgtaattccagcactttgggaggctgaggcgggctaatctctctctcttttttttccctgagagggcgtttccctcttgttgcgcaggctggagtgcaatggcgccatctcggctcactgcagcctccgcctcctgtgttcaagcgattctcctccctgagcctcctgagtagctgggattacaggcacccgccaccacgcccagctaattttttgtatttttagtaaagatggggtttcaccatgttggctaggctggtctggaactcctggcttcgggtgatctgtcctccctggccttgcaaagtgctgggattataggggtgagccactgcaggactgattgagctcaggagttcaagaccagcctgggcaacagggcaaaactctgtctctacaaaaaatacaaaaattagccagcgctgtggcccgcgcatgtagttctagctacttgggaggctgaggcacaaggattcttagaacccaggaggcagaggctgtagtgagctgagatcgtgccactgcactccagcctgggtgacagagtaagaccctatctcaaaattgattactgttgtaataataaatttgattttacagttgaaacagggttttaaaataactgtgtgcttagtgaccccagatgattttgtacatagtatttgaaaagttatttgccttgcagtattcttttatgtttttggtgtaattgccataattgctattcctctcctcccacccctttcagagttccatttttgggttaagtgtttatataaacgctctactaaattaaggctcttccctgcgcagtacaaggtttccctagtagtttggtttgcccaaaagaaagagaaaatttgccaaatggaccttttcagcagaagtaattttgggggcatctttttggaaatgtacccgttgccctgccttttttgctggctgtcatctgtttttatttcactcagatttaccatatagcattcagagttgttggaatgaaaacttatagacaactatagaaagtgcagttcaacttggaaaactcatttcaaaactctgttttataattttgtttagcatgaagaaagcagtgtcactgataaatgcaatagatacaggaagatttccacggttgctcactcggattcttcaaaaacttcacctgaaggtttgtatttgtgtgtttccatgccttgtaatcttccttctgatttaattgaaagtctgattatttggagaactttttgcaaagcatagtgttctccaatatgttcttagagacactggttctgtggaagatttggtaatgtttcatggtcagaagtttgagaaactctgtcttcaataaagttaaatgttttaaattatggaacttttcagagtattttatatgctagtgtttgtggtatgtattcgagggtgattatggcaggtaacattttccaaatgtgtttgaccttggatctgttttattatggtatatattttgggactaaagttctaaaaatatactttagggaaaaattctgatgtcttggttttatttttccgcttaaaaataattctgtggtattttctatcaactggtatttaatctttcacttaattttgtttctctttcacttttattttaaggatatggttgttttggacatgtggatgctttgtaattctctacctggcccaatccaagttaatttagttaatttctttatcaggttataaaaatttgattccatctcatatttatggagcacccactaactgctctgtgcagtgccatgtatcaccatccattgagaaccaagactcttactctgtcatcttgtttttcttggccaagagccagcctcaaaactgtgcctttcccctttgaagtgtctttcaaatccaagttctcacaattctaggtcaaatctttagtacctcttttttagatgacaatagttaccttcaagctggtttccctgcctatagtcttcttgctttctactgcttcataatactatgtaaattactttctaaattttttttcctgaaacaaagatgtattatattttttacagtgttcaaagccatcagtgactgtccattgccctatggagaaaagttagaaatccttaacattgcgtacaagtcccattgtagtatggctgcagtctacattctcctcattttgtaagtgctgcagttacactggatggtacccatttactacaacttgccatgaactttttcagcaatgtgtctatgcatatactctttcccttgcctataaatgtccttcttcccctttactgagtaacttgttcatccttcaaggatttcacaatctcagtctcagcagtttgttctttcttctgtgctcctagttcattctcacctgattttagtactgcatcataagtatttgtttcatgattagcaggcaaccaaatccccaaacctattaatgtgtcttcctctggttttaaatatcttgaggattatgtcttactcatctttatgtttcccattcctaatacattgctactagtatagttggcactcagtaaatgttcttgaagttaattattttccttgctgtggaaaacacaaaacaaacctaagtcttctataatatattcctttttctaaggaatttgtgaggtggatggagagaaaggagaaactgcaatgatagcggcaacattctgtggtatttgctgttcataaagttacattggcttgtttttgactgttgtggtgctaatggctttgtgttactaactcatctaatccgtatggcaacttgaaaacataggtactgtggtcatctctggtcatcttcattttatctatgaggtaaccaagatagagatagagatcagttaagtaactttcccaaggtaacacagctagctagttgggcaacttggctccgtaactctctcccttattacacgaaacctcaggaaagagtatggaacatttcataaattggcccaaaagtgaatgatgtgggtaatacagatattctgctttatttcttcagctggtgggtgcttgcttatgtataaaaatatgggacaagaaactcttatacatgtcttttgttcttcacactgagggagtggagaacttgcacagaaaattgtgatgtttagtttgtctttgacactctcagtcatgtatggagttgagaatagttagtatctatcttagagttaactgagtggctaaagcattccatggaggagcttgaatgctttgccatcagaggtaggggagtggagaggagaagaggtgcttgttgaaaagtgaagttacccgtcctgctggcatttaatgtccagggacttttaaataaagaaacatatgtatgtgaatacttgcctgctaagaagacgtcaggaaaggtctaattgtttttttcctgtacagtttcaggggatcttcttttagaggggctcctattttgataagggcttttcagtcaagtttgcagtgcatttcaggatctgcctactttcatttatgtatcccgactccatcgagttggcctttaccttgagacagaattcttagaatagtgaaactgaggcaggcagattggtgaagaggtttagggattttgttgcccctctactggtacttttattttattaagtttgacctgtttatgggcagaagagatgtatttgtccagactggttccttggaatcccaagggggaatcaatatgagggactaagacaacttaggtatagaatgtgggcatgccagattatggatctgggagtcctctttggccatcttcttggctcatcctggcatatacaaatacatggagattttgtttctttgtttgttacaatgtgtggagggtgcttctggtatttaacgtccagggactttaaaaatattttacagtgtttagggcagtcctgcacaaagacttgtctcatccagcgtgccagcggtttgcattgggaaatgctgatggaagtcaggtgaacttgcatagctgggaacttagaaataaacatttgtggcctttgcacttcaaaaataactgtcacaactcatgcaataaaaaaactcatgtacttggctccataggagagattttgaggccctcacacaaagcctgttgagataacagtgctgtatatctagttttgagaggtcagctctctgggttcctgaccatggcagactaaaaatagcaaactgggggttgaaggtactgtcatggggcatgtaggcagcttcaagaaatgactgctgatcatgaaatgaaatgggagaattatgaaaatcacacccaagaaacataaaaggacagaagtctgagatttctgtttgctctggttaaaaattatccatgtatctcagcagttctttaggatagatgagccccttagcacagggctctgatgcttgtaattatgacctgcgtcaccacaagatatttgtttaatctaatttattttgtttacaaaggtctagaaatgagcatcatatgttttataaatttacatgcacatcagtttcttttcaccatgtatttttctttaaagttctcatctcatatacgaataaatgaatcttctgtcaagtatgaattttgaatgcctgaatatgtgctaatataatagattgctatttgtattataggctgagagcagtttcagtgaagaagaggaagaaaaacttcaagcggcattttctctagagaaacaagatcttcacctagttcttgaaacaatatcatttattttagaacaggtatttttattgcatcaaattttctagccatgatttgtttactacatatttgtattgttatgatatctatgacattctgttttttttaattaaaaagtatgcaagatggaagctgtgaatgtattttagttaagaatttcagtgtaaaaatatttgaatattgtaaagtatttaaatatgaattgagacttcattgatttgagacagttatacaagattttaattcattggtacttggtataatggaaaaatggacatattttacttaagatattaaatgatttgggggatatattgactaggatggtaagtaagacatttagaaaagaagtattgtcatattatgtgccactaagctgccttctgcatccctttttctcatctaaattcacttcctgatttaagctcctattcaaggctcatctcctttacttgagctgtgaccccttatacttcctttatttggatttttaaaaatccttggctcatcacagtagagcacattgttagtctttcagcagttcatatgcgttagttatacctccttcaccagattctaatttgtggggagcaggatcatattttttgtgtatcttatataagcctaccacattggtgtgcttaaaatagatcctcataaattcctgttgattaaaaataatacttgtgaaataaaagtttaaatagttttgtaacttcatgagcattttaatgaacatattaggaggacaagctaccagttatctactacagccttacatacattatagatcacaaagataaatgtggttctaatttttggtgggtgttcagtagaagaaaaggatcattgagtaggacagcatagcatggtgttccagaataatgtaagaaacagaacaggtatcagtgttaaaattttttacaacttttaatcatatattatgtaggaaattggtagataaggtaattttgagaaagtgcttctgggaaaaaatttgttagttgggaaacaaaactattgtatacttatttgaaattattaagtgaaataaatgaaattttaattagggtaccatttacatagccaaagcaaagaagaagttttttggtttttaagtggatttaggattacttaaagcataggtaagagtgagaaaaaaattcatcttgaataatttaggccatttaatcctgaatcttccagcccttggtcgtgtattttattatgtgtaaaataaccaaaaatgttggtaataggactatgaagttttcttttgacttaagtcatttaaaaatagttttgtatttagtatagtttaaagtttcagtatgaagatgagggacatatgtaattttttgtttctttttaataggcagtgtatcacaatgtgaagccagcagctttgcagcagcaattagagaacattcatcttagacaagacaaagctgaagcatttgtcaatacgtggtcttctatgggtcaagaaacagttgaaaagttccggcagagaattctggctccctgtaaggtatagaacatactgtcttaaatatgtttttcaataacatatggcataaattattatacctgaagagtttttaaagtgataatattttgttgagaggtagagtcaggcaaaagaaacacagatgctcctcaacttacaatggccttacatcctgatagacctgtcacaaattgaaaatatcgttaagtcaaaaacagagtacactctagagaatcagttgtttacccttgtgatcacatggctgactggaaactatcgctcgctgccattgcccagcatcatgagagaatatcatacatattgctagcccaggaaaatacagaattcaaaatatgaagtatagtttttgctgaatacatattggtttcatgccattataaagtaaaaaaattgtctggtatgggccctgacttaagtttagattttacagtagtgcaaaactatcgcaatttcgatatacttttacttttgatctcttcttcggctagtggtgtggtacataagatattcctgtttttggaggcttttcaagatggctgactagaggcacaggacacttctccacaaagaagaaccaaaatagtgagtaggtaatcacactgtaaataaaacatctaaaagagaatgctagagttcagtagagaagtgaccggaaacacctgaggagagggaggagaggtggacagccttgctgggatcaaccagaagcctggagaggctcctcagtgtggagttggggtaagtgagagatccctagctgtccacattcttgctgcagactcctgtaatcctaactgtgggagagttcttgaaccccatgggccccgagactggcatagggagctccctgaagttcatgcaatggtattgctctagaaagggtgctcttgctgggttccatgctccccctgagtcttaggtagctggagcacggctccattttaagagtctaatccctgttagaaacagaataatcttaaaatttgtatgaaaccaaaagagaacccaaatagccaaagcaatcctaagcaaaaagaacaaagctggaggcatcatattccctgatttcaacttgtattacaaggctatagtaaccaaaacagcatggtgttggtagaaaagcagacatatataccaatggaacagcataaaatacccagaagtaaacccatgtatttatagccaactgatttattacaaagttgccaagagcatacaactggggaaagggcaccctctttaataaatggtgctaggaaaactggataactatgcagaagaatgtaatggcccttctctctcaccatgtaaaaaatcaactcaaaattgattaaagacttaaacataagacccacaactgttaaaatactagaagaaaacaggagaaatactccaggacatttgtctaggcaaaaattttatggctgaccttcctaaaacatggacaaaaaaccccaaaatagacaaatggaactatattaaactaaaaatcttctgtacattagaggaaacaatcaacaaaatgaagacacaacctgacaaatgggataaaatatttacaaactattgacttagcaaatgattaatatccagaatatacaaggaactcaaacatctcaactgcaaagtaactaatcccatttaatgtggacaaaggatctaaacaaatgcttcttgaaagacgatatataaatggctaacaggtatatgaaaaaatgcttaaaatcactaattatcagagaaatgcaagtcaaaaccaaacatgccatatcatcttaccccagttagaatggctattattaaaaagagaaaaaaataatggatgcaggtgaggatgtggagaaaagggaactctcatatgcttttggtggcaatgtatattagtacagccattagggaaaagcagtgtggagatttctcaaaaaactaaaattagaactaccacacagtccagtaattccactacttggtatatattcaaaggaaaggaaatcggtatattaaagaaatatttgtacccctgtgtttgttgcaacactgttcacaatagcaaagataagaaatcaacctaagtgtccattagtggatggatgaataaagggaatttggtataattacacactggaataatattcaaccataaaagagagtgaaatgttgtttgcagcaacatggatagaactagaggtctttatgttacgtgaaataagctagacacagacaaatataacaggcactcactcctatgtgggagctaaacaagttgatgtcatggaggtagagagtagaatggtagtcaccagaggctgagaagaatgcatgggatgtggggtcggagggtggatgagtagaagttggttaatgggtacaaacatataatcagaagtaataagtttaatgtttgatagtttagtatggtgcttatagttgacatcaatatattggtcatttcaaaatagctagaattaaggaagtgaactgttctgaacacacacaaatgataaatgctcagggtggtgaatatcttaaataccctgacatgatcattacacagtctatgcatataagaaaatataacacatatctcataaatatgcaaaaatattatgtattgattaacaaataggctttgtgttagatgattttgctcaaccacaggctaatgtaagtatactgaacatgtctaaggttagctaagctaagctgtgatgtttggtagattaagtgtattaaatacatttgtgaattattgtattttaacttaacgatagattaattgaggcataagcccattgtaagtcaaggagcatctgtatattctctagaagtcctctgtgagatatatgatttgcacgtattttctcctaatctgtagctttccttttcattctcttaacagtatctttcccagaacagaaccattaactttgatgaaatctgttgtattttttttttctcttttcatgaacctacttctggttttctaggaatttgcagcctaatcatgacataaatatttactgttttcttctaaatgttttacatatttatattttatgtttagatctaaaatccatttactgttaattttgtatgatacataaagtgcaggtcaaagttcattttttctatgtatggatgttcatttgctccaatgtgatttgttgttaaaattatcattttgtcattgaattaccatgtgtttgtctaaaatcatttgatatttttgtgagtctttttctggaatctctctttgatttcattgacttatttgtctatgccaatatcacactgccttaattattatagcttaatagtaagtgttaaaatcaggtattgtgaacccactgacttttttcttcttttttataattgttttggcaatcctagtttctttgccttttcatatgtttgaaaatcagcttttgtatttctgtaaaaaatcctgcttggggtattgattggggttgtgtttaatttgtaaataactttattgagaaatgactccttaataagtattgagtatatctatttatttaggtcttctttgatttcttttatcagtgtcttttgttttcagcttatcaatcctgcccttattttgttaggtttgtaccttaagtactttttctttctttttttttttgttgttgaactattggtagtatttttcaaattttgttttccaatggcttattgatagtatatggaaatacagtagacttttctatactgatctctatcctgtaacttggtaaattcactaattagttttagcagctttcttataggttttttgtgatttcctttgaaggcagtcacgttgtctgtgaataaagacagttttatttcttccttttcaatctgtagagcttttatttttcttgctttattttactgacaaggacttccaacgtgatgctgaataggagtggtaagtctgaatatccttgccttgttcccaattttagggtgaaagcattcaggctcttatcattaagtaggatgttagaaaatgcccctttattgttttcacttctctacttccctttttaaaaattctgtattcttactactctcaagtgtcttctatgtcattgcttcattttttatcattttaaagtctactttttcctatatcctctatagattttaagctttccatttgtttccctgcaattctttttttaagccattttcatttttaaaaaaaattcttggctttttaatagtagcctgttttctgtttatatttttcctatattttatacagtccgtttttttccttgcactttagtagtcataacaattaaaaatatttttgttttctgcttctaatagtaaattactttttagtgtcttcatgatgaaagtttgtttttttaaaggtaatatttttcccatagttggattacagaagcttctctttaagaaattaattaatcatttgtcatataaaatatgcaaataaagaagttggaatgatctgattaattgtacattgtcccattgagaatgctggaaattatcttttggtaattctgggtatatcataggattgctaatatactattttaaagtctgaaatgcttaaataatataatgataacaagcatttattgtgcttattgtgggtcagatgttataatgagttctttgtatgttacaaaacccattaatagttctagtttatacatgtacttataaaattgaggcttagagaggtttaaaaagttgcccatgattgtacagctaagtaagtggctgagttgggatttgacaagaatagtcacattcctaagctattatgctatcctaacacatagatgttagctgcggaatttttctgcgtcaggcattatgcagggtgatttatatagttgtttgtatgtacttcatattagtccattctcacattgctataaataacctgaaatagggtaattatataaagaaaagaggtgtaatttgcccacggttctgcaggctgtacgggaagcatgatgtgctggcatctgcttggcttctggggaggcctcaggaaacttacagtcatggtggaaggtgaatggggagcaggtgtctttcatggcaggagcaggaacaagagagagagggaggagggaggggctacatacttttgaacaagcaggtcttgcgagaactcaactatcacaagaatagcactgaagggatggtgctaaagcattcatgagaagcctgcccccatgatccagtcacctcccaccgggcccacctccaacactggagattacaattgcacatgagatttgttgtggtcacagatccaaaccatgtcacataccttttaaaagtgaggaaataaaactttagaaaatattagtcactttatcatattatcccaagtggtccatgatgaaactgaaatgaggattggatctgtctgtctctaagtcttattccttttatatcatgctacctctggcagctgtaatgctatctttctttttcattctgagaactgtttaggatactgtggccaaaatagccagatgtgaaaacagatcatgccatttaaattgtaacaaaaatatattacactgacttatatgatgaaaaaaggtgtacatgcaatgactttaactgttttatggtaacttagggtcctacccacataaactgtggggtgcttgcagcagaacacatgttggtagtacagtcagccctctgtatccctggatttcgtattcatggattaaactcgcagcagatcaagaatatttgggaaacaaaaaattccaaaaagtgaaacttgaatttgccatgtgctgagtactatgttaaatccacagaaatgatgtgttgtcattgtattagttattataaataatctagagatgatttaaagtataaaggaggatatgtgtagattatatttaaatactgtgtcattttatatgagggacttgagtatctgcagttttgggtgtctgtagggggtcctggaaccagccctcgctagatactgaggaaagactgtgattctgaattcaaagagggtaagatcaatgaaataatgttaaaaaatcaaaaggtgtttatttttattccattttaaaaacttcttttttaagctttatcgaggtataattgataaacaaaaattatgcgtattcagggtgtgcaatgtgatgatttgatagctgtatacattgtgtaatgattaccataatcaaattaatcaacatatctgtcaccacacagttaccaccttttatgtgtgggtgagtgtgtgcgtgaggacatttaagatctactgtctttgaaaacttaaagtaaacaacgtggtattattaactatagtcaccatgccatacattagattcccagaacttaatttgttttatagctaaaagttgtaccctctgaccagcatctcctcatttccctcataccccatccccaggcaactaccattctactctctgcttcagtgagttaaacttttagagtatgcgtataaattagctcatacagtgttttgtctttctgtgcctggcttatttcacttagcataacaccctccaggttcatccattttgtcacaaatggcagtgttttctttttaaaggttgaataatattccattcattatctgttcatttgttgacagacacttaggttgtttccttatcttggccattgtgaataatactgcagtgaacatgagggtgcagatatctcttcaactgatttcatttcctttgcgtataaaccaggagtgggattgttggattgtatgatagttttatttttaatgttttaaggaacctccatactgtttttcataaaggctgtaccaatttacattcccaccaacactgtacaatggtttctttttctctgctgtcttcctaacacttgctgtctcttgtctttttgataataggtattttaacgatgtaacgtcatgttgtattatgcttttgatttgcatttctttgatgattaatgatattgaccactcttttatatacctgttgatcatttttatgcctttttttggtggggagaatgtctgttcagttcctttgtccagtttttaaatgggttattagttttcctgctattgagtttgtgagttccttatgtattttgtatgttaacctcttatacatggtttacaaatacaggttgggtatcacgtatctgaaatgcttgggaccagaagtgttttggattttggattttttgaattttggaatatttgcatatacataatgagatgtcttggggatggtaagcaagtctaaacactgaattcatttatgtttcaaatacaccttatatacatagcctgaaggtaatcttacacaatattttaaataattttgtgtatgaaacaaagttttgactgtgacctgtcatatgagatcaggtgggaaattttctgtttatggtatcatgttggagttcaaagagtttcagattttggagtattttagattttggatttttggattagggatgccgaacctctgttttctcacattctataggttgccttttcattttgttaagtttcctttgttgtgtagaagctttttagtttgatataatcacacttgtttgtttttgcttttgttatgtatttcatatccaaaaagtgatacgcttttggtgtcctatccaaaaaatcattgcaaaggccagtgctaaggagctatttttcctgtatttttttctagaaattttatagtctcagatctttcatttaagtctttaattcatttttagttaatttttgtgcatggtataagataaaggtccagttccttttttttttttttgcatgtagattttcagttttctcagtaccattagttgaaaaggctttttcccatggtgtatccttggtgcccttgtcaaagactggttgaaagacacttctttttatctcttattgtttagatttaataaatgagagggccaattgaaaaaaaaacttgacattaatagctttttgcagaatatgattgaagggattttaaaatttcatctcatctcactttaatacgtctgttttttgccatttatttatttttctttgtataaattcatggtgtacaactgaaattttgttacatgcatagatttcataatggtgaattcaggacttttaggtaatttctcattatccaccctcgcagcacctcctctcccttctgagtctccattgtctgtcattccactttttacatccatgtgtacacattatttagctcccacttatgagtaagaatatgcagtatttgtctttctgtgtctgacttgtttcacttaagataatggcctccagtttcatccaagttgctgcaaaagatatgattctgttcttttttatggctcaatagtgttccattgtctatatatacacaccatattttctttatccagtcatccaatgatggacacttaggttgatcccatattgttgttattatgaatactgtgataaacaggagtgcaagtacctttttagtacactgatttcttttcctctgggtagatgccccattgagggattgctagattgaatgttagttctagttttagttatttgagcaatctctatactgttttccatagagttcccttttctatactattttccataagagttctcttttctccacatccttgttaacatctattattttttaacttttttattttttatttatttatttatttattattttgagacggagtcttgctctgtcacccaggctggattgcaatggtgtgacctcggctcactgcaacctccgcctcccaggttcaagagtttctcccacctcagcctcctgagtagctgggattacaggcgcacaccaccacgcccggctaatttttgtatttttagtagagatggggtttcaccatgttggtcaggctggtctcgaactcctgaccttgtgatccgcttgcctcagcctcccaaagtgtgggcttacaggcgtgagccactgcgcccggactttcttcactttttaatagccattctgactagggtaagatgatagctcattgtggctttgatttgcatttctctgatcagtgatgttgagcatttttaaatgtatctgttggccatttttatgtcttcttttgaaaaatgtctattcatgtcctttgccctgtgcccactttttaatgggattatttttgttgttgttgttcagttgtttgggttttttgtacattctggatattggtcctctgtcaggtgcatagtttgcaaatattttctcccattttgcaggttttctatgtactatgttgattatttcttttcctgggcaaatcttcttagtttaactaagttccatttgtctatttttatttttgttttctgtccttttaagatcttagtcatgaattctttgcttagaacaaggtccaaaagagttttcgctaggtttcttctagtattttaaatttcaagtattccattgaagtctcttaattcatcttgagattttttttatatgatcagagacaggggtctagtctcattcttctgcttttggcaatgcagttttctcagcaccatttattgaaaacgttgtcttttcctcaatttatgttcttgttgactttgtcaaagaacacttaaatgtaaatatgtagctttatttctgggttttctagtctgttctcttgatctatgtgtctatctttatactagtaccatgctgttttggttattatagccttgcagtttaatttgaagtcagagagtgtaaggcctccaggtttgttctttttgcttaggactgctttggccattcaggttcttcattgcttccatatgaattttaggattgtttttcctaatttagtgaaaaatgacaatggtattttgataaggattgcattgaatctgtagattgctttgggcagtatagtcattttaataataattctttttattattatgttttaagttctggggtacatgtgcagaatgtgcaggtttgttacataggtatacacgtgccatagtggtttgctgcacccatcaacccgtcatctacattaggtatttctcctaatgctatccctccaccagccccccacaccctgacaggccccagtgtgtgattcccccaccccttatgtccatgtgttctcattgttcagcacccccttatgagtgagaacatgcggtgtttggttttctgttcttgtgttagtttgctgagaatgatggtttccggcttcatccatgtccctgcaaaggacatgaactcatccttttttatgcctgcatagtattccatggtgtatatgtgccacatttttttttaatccagtctttcattgatgggcatttgggttggttccaagtctttgctgttgtgaacagtgctgcaataaacatacatgtgcatgtgtctttatagtagaatgatttataatcctttgggtatatacccagtaatgggatggctgggtcaaatggtatttatagttctagatccttgaggaattgccacactgtcttccacaatggttgaactaatttacactcccaccaacagtataaaagcattcctatttctccacatcctcttcagcatctgttgtttcctgactttttaatgatcacattctaactggcatgagatggtatctcattgtggttttgatttgcatttctctaatgaccagtggtgatgagctttttttcatgtgtttttggctgcataaatgtcttcttttgagaagtgtctgttcatatcctttgcccactttttgatgggtttttttcttgtaaatttgtttaagttccttgtagattctggatattagccctttgtcagatggatagattgcaaaaattttctcccattctgtaggttgcctattcactctgatggtagtttcttttgctgggcagaagcccttcagtttaattagatcccatttgtccattttggcttttgttaccattgcttttggtgttttagtcatgaagtctttgcccatgcctatgacctgaatggtattgcataggttttcttttagggtttttatgatttttaagtctttaatctatcttgacttaatttttgtataaggtgtaaggaaggggtccattttcacttttccacacagggctagctagttttcccagcaccatttattacatagggaatcccttccccatttcttgtttttgtcaggtttgtcaaaggtcagatggttgtagatgtgtggtgttatttctgaggcctctgttatgttccattggtctatatgtctgtatggtaccagtactacactgttttggttactgtagcctcgtagtgtagtttgaagtcaggtagcatgatgcctccagctttgttcttttgcttaggattgtcttggctatgtgggctccttttggttccatgtgaaatttaaagtagtttttttccaatgctgtgaggaaagtcaatggtagcttgatggggatagcattgaatctataaattactttggacagtatagccattttcacgatattgattcttcctatccatgagcatggaatgttttttcatttgtttgtgtcctctcttattttcttgagcagtgatttgtagttctccttgaagaggaccttcaaatcccttgtaagttggattcctaggtattgtatcctttttgtagcaattgtgaatgggagttcactcatgatttgtctttctgtgtctgttattggtgtatagggatgcttgtgatttttgcacattgattttgtatcctgagactttgctgaagttgctcatcatcttaaggagatttttggttgagatgatggggttttctaaatatacaatcatgtcatctgtaaacacagacaatttgacttcctcttttcttttttttctttttttttttgagacggagtctcactctgtcacccaggctggagtgcagtggcacgatgtcggctcactgtaagctcctcctcccgagttcatgccattctcctgcctcagcctccctagtagctgggactacaggtgcttgccaccaagcccagctaattttttgtatttttagtagagacggggtttcactgtcttagccaggatggtctagatcccctgacctcgtgatccgtccgccttggcctcccaaagtgctgggattacaggcgtgagccaccgcacccagcctcctcttttcctaattgaatatcctttctttctttctcttgcctgattgccgtggctagaacttccaatactgtgttgaataggagtggtgagagagggcatccttgtcttgtgctggttttcaaagggaattcttccagtttttgcccatacagtatgatattggttgtgggttgtcatgaatagctcttattattttgagatatgttccatcaatgcctagtttattgagagttttttttagcacaaagggctgttgaattttatcaaaggtcttttctgcatctgttgagataatcttgttgttttttcattggttctgtttatgtgatggattacttttattgacttgcatatcttgaaccagccttgcatcccagggatgaagccgacttgatcatggtggataagctatttgatgtgctgctggatttggtttgctggtattttattgaggatttttgcattgatgttcatcagggatactggcttgaaattttctttttttgttgtgtctctgccaggttttggtattaggatgatgttggcctcgtaaaatgaattaggaaggattccctctttttctgttgtttggaatagttttagaaggaatggtaccagcttctctttgtacctctggtagaatttggctgtcattctgtctagtctgggactttttttggttggtaggctattaactactgcctcagtttcagaacttcttattgctgtattcagggattcaaattcttcctggtttagtgttgggcaggtgtatgtgtccaggagtttatccatttcttctagattttctagtttatttgcgtagatgtgtttctagtattctctgatggtagtttgtatttctgtgggatcagtggtgaagtcccctttatcattttctattgtgtgtatttgattcttctctcttttcttctttattagtctggctaagggtctgtgtattttgttgagcttttcaaaaaaccagctcctggattcattgatttttttgaaggacttttcatgtctctatctccttcagttctgctctgatcttagttatttcttgtcttctggtagcttttgaatttgtttgctcttgcttctctagttcttttaattgtgatgttagggtgtcgattttagatctttcctgtttttgttgagttttgttttatttttttttttgtgtgggcatttagtgctataaatttccctctgcacactgctttaaatgtgtcccacagattctggtaccttgtgtctttgttctcattggtttctaagaacaactttatttttgcttttatttcgttttctacccagtagtcattcagcggcaggttgttcagtttccatgtgttgtgaggttttgagtgagtttcttaatcttgagtctaatttgattgcagtgtggtccgacagagtgtttattaatgatttctgttcttttgcatttgctgaggagtgttttacttccaattatgtggtcaattttagaataagtgcgttatggtgctgagaataatgtatattctgttgatttggtgtggagagttctgtagatgtctattaagtccacttggtccagagctgagttcaagtcctggatatccttgttgattttctgtctttttgatctgtctaatattgatagtggggtgttaaagtctctcactattattgtgtggtagtctaagtctctttgtaggtctctaagaacttgctttatgaattggggtgctcctgtattgggtgcatatatacttagaatagatagctcttgttgcattgatccccttgccattatgtaatgcccttgtctcttttgatctttgttggtttaaagtctgttttatcagagactaggattgcaacccctccttttttttgctttccatttgctttgtagatcttcctccatccctttattttgagcctatgtgtgtctttgcatgtgagatgggtctcctgaatacagcacaccaatgagtcttgactctttatccaatttgccagtctgtgtcttttaattggggcatttagctcagtcacattaaagattaatattgtcatgtgtgagtttgatcctgtcattatgatggtagctggttattttgcccattagggtttctgctgagagatctgctgtgggtaacctgacctttccctctggctgcccttaacattttttcctttatttccaccttggtgaatctgacgattatgtgtctcggggttgctcttctcgaggagtatctttgcggtgttccctctatttcctgaatttgaatgttggcctgccttgctaggttggggaagttctcctggataataccctgaagagtgttttccaacttggttccattctccccatcactttgaggtacaccaatcaaacatagatttggtcttttcacatagtcccatatttcttggaggctttgttcatttcttttcactgtttcttctctgatcttgtcttctcactttatttcattgagttgatcttcaatatctgatatcctttcttttgctttatcgattcggctattgatacttgtgtatgcttcatgaagttctcgtgctgtgtttttcagctccaagaggtcatttatgttcttctctaatctggttattctagttagcagtttgttttacctttttttcaaggttcttagctttcttgcattgggttagaacatgcgcctttagcttggaggagtttgttattacccagcttctgaagcctacttctgtcagttcgtcaaactcgttctccgtccagttttgttcccttgctggcgaggagttgtgatcctttggaggagaagagctgttctggtttttggaattttcagcctttttgtgctggtttctccctatctttgtggatttatctacctttgttctttgatgttggtgacctttggaagaggtctctgagtggccgtactttttgttgatgttgatactattcctttctgtttattagttttccttctaactgtcaggcccttctgctggagtttgctggatgtccactccagaccctgtttgcctgggtatcaccagtgcaggctgcagaacagcaaagattgctgcctcttgcttcttcctgaagcttctttccagaggggcacccacaagatgccagccccagctctcctgtatgaggtgtctttcggctcccactgtggggtttctcccagtcaggatacacaggggtcagggacccacttgaggaggcagtctgtcactggatcagagcttgaatgctatgctgggagatccactgctctctccagagctgccaggcaggggcgtttaagtctgctgaagctgcacccacagccacccctttccccaggtgctctgtcccagggagatgggggttttatctataagtccctgactgaggctactgcctttttttcagagatgccctgcccagagaggaggaatctagactggcagtctggctgcagtggctttttgagctgcagtggctttttgagctgcagtgggctctgcccagttcgaactctctggtggctttgttacactgtgagggtaaaaccgcctactcaagcctcagcaatggcggacgcctgtccctccaccaagctcgagcttctaggtcaactcagactgctgtgctagcagcgagaatttcacgtcggtggatcttagcttgctgtactctggggttgggacctgctgagccagaccactttgctccctggcttcagccccctttccaggagagtgaacggtgattcactggcattccaggtgccattggggtatgaaaaaaacaaacaaacaaactcctgcagctagcctggtgtctgcccaaacggccacccagttttatgcttgaaacccagggcctaggtggcataggcacccgagggaatctcctggtctgcaggttgtgaagaccgtgggaaaagcacagtttctgggccggagtgcaccgttcctctcggtacagtctcttacggcttcccttggctggggaagggggatctcctgacccgttgtgcttcccgggtgaggcaatgccccaccctgcttctgctcaccatccgtgggctgcatccactgtcctatcagtcccagtgagatgaactgggtacctcagttggaagtgcagaaatcacctgccttctgcatcgattttgctgggagctacagaccggagctgtttctttttggccgtcttgccagcatatcatcataatagttcttttgacccatgagcatgggatgtttttccatttgtttgtgtcgtgttcagttttctttcgtcagtattttgtagttctccttgtgaagattgtgcatcttggttaaaaaaatattcctatgtatttggctgagcactatgggctcatgcctgtcatttcagcactttgagaggctgaggtgggtggatcaccactcctgggtgatccccaagagtttgagaccagcctggccaatatggtgaaacaccatctctactaaaaatacaaaaattagccaggcgtgctggtgcgtgcctgtaatcccagctacttgggaggctgaggcctgagaattgcttgaacctgggagggacaggttgcagtgagccgagatagtgccactgcactccagcctgggcgacagagtgagactctgtctcaaaaacaaacaaacaaaaaattcctatgtattgtatttttcttgtagccattgtaaatgggattgttttcttgattttgttctcaactagattgttactggtgtaagaaatgctactgatttttcatgttgattttgtgttgtgcagctttactacattcatttattaaatctaagaatttttcatgaatctttaggttttcctagatataagttatatcttcagcaaacagtaataattttactttctcttttcccatttagaagccttttatctcttgcctgatggctgtggctaggacttccagtactatgttaaataggagtagtgaaaatgggcatccttgtcttgtccaacgtttttgaggaaatgtttttaacttttccctgttcagtgtgatgttgtctgtgggcttgtcatatatggcatttaatattatgatgcatatttcttctatgcccagtttgttgagagtttgtatcatgaaggggtactgcattttatcaaatgctatttctcagtctattggtttgatcataaagtttttctccttcattctttttatgtgatgaatcacatttattgacttgtgtattttgaaccactcttagatcccttgactaaaacccacttgattgtggtgtattatctttttaatatgctgttggattctgtttcctagtattttgtttaggactgttgtgtctatgttcatcagggtattggtctttagttttctttattcgttgtgtccttgtctggttttggtattgggatgatactggagaatgagttagggagaattcctttcccctgttccaactttttggaacagttttacaagaattggtattagttctttgtatgtttggcagaattcagctgtgaatccgtctggtcctgcgtttttggggggaagattttattactgatttaatctcactacccattattggtctattcaggctttctgtttcttctttgttcaatcttgggaggttgtgtattagtctgttcttacattgctacacagaaatacctgtgactgggtaacttataaagaaaagaggtttaattggcttatggttctgcaggctgtactggaagcatgatgctagcacctggggaggccttgagaaacaaaacaatcatagcaaaaggtgaagggggagcaaacccatcacatggtcagagcaggaacaagagaggaaggggggaggtgctacacacttttaaaccaccagatctcaagagaattcactattgtgaggacaataccaagaggggtggtgctaaatcattcctgagaaacctgcctccatcatccaatcacctcccatcaggccccacctccaacattgggtattacatttcaatatgagatttggatgggaacatacatccaaactatatcaggttatatgtttccagaaatttacctattttctgcaagttttctagtttatgaacatgtagttgttcataatagtctctgatgatcttttgaatttttctcatatcatttgtaacgtctccattttgatttcttattatatttggatcttctttcctctggttagtcttgctagcacttgatcaattttgcttatctttttaaagaacgagctttttgtttcattaattttttaatttttttttggtctctgttttatttagttttgctctgatccatgttacttctttacttctgctaattttgtgtttggttcgttcttgcttttctagttcctttagatgtattgttaggttgttaatttgcaatctttctacttttttgatgcaggtatttattgctgcaaaattccttcttagcactggttttgctgtgtcctacaggtttttgtatgttgtatttccagtttcatttgtttcataaaattttttaattctccttaattttttcattgatccaaaggtcattcaggggcatattgtttaatttttctgtatttgtatagtttccagagtttttcttgatattgatttcttggtattggttttattctactgtggtctgagaagttacttggtatgatttgatttttaaaaatttgttgaggcttgttttgtggcataacatatggtctatattggagaatatcccatgtgttgatgagaagagtatttattctgcagttgttggatagaatgttctataaatgtgtgttaggtacattttgtctgaagtccaatttaagtctgatgtttgttgattttatgtctcagtgagctgtctaatgctgtgagtgagatggtgacgtcccctattattgtttttctgtctaactctctttaggtctagtaatatttgttttatgaatttgggtgctcaaatgttgggtgcatgtatgtttagaattgttatgtcctcttgtagaactgacacctttaatatcaggttttatacttttgtgttttcttgatggggttgccctgtctctttcaagtttaggactcctttgaacatttcttgtagagctggtctacttttgacaaattctcttagtattctgttaataatctgtctgggaaagaagattatttctacttcatttatggagcttgatatttctcgatgtagaactcttgactgataatgacttcattattttttactatttttattttaaagtatgctttatctgataaaaatatagctacctctgcttgctttagattttcgttggcccataatatcaatcaatatctttttccacccctttacttttagtctatgtgtcttcacagataaggtgggtttcttgtaaatagcatatagttgattttttttctttttttttgagatggagtcgcgtgctgtcgccaagctggagtgcagtggcgggatctcagctcactgcaacctccgtctcccaggttcaagcaattctcctgcctcagcctcctgagtagctgtgactgtatataggtgcgcgccaccatgcacagctaatttttgtactttaagtagagactgtcaccatgttgacagaatgttctctatctcttcacctcattatccgcctgtgttggcctcccaaagtgctgggattacaggcatgagccaccgctatatggcctatagttgattttttttattcatttagccaacgtgtattttttagtaggacatttaatccatttatgtttgaggtggtatatgagattttgttcctgtcatattgtttttttcatcattttgtaaacttttgggttttttgtctgtctaaatttatggtttgttggaattctgtaatggtttcatttgattcttcttctttgtatgatatctttactagtgtattttatatttttgtgtgttttcacaatgataaatattgtcctgtctcttccaagtttaggacttctttgagcatttcctgtaggactggtctagttttcatgaattccctcagtatttgattgtctgggaaagactatttctcctttatttatgaagcttaatactacctggatatacaattcttggctgacagttgttttctttcacactttgattatgtcgtcacattttttcctgccttgtaaggtttctgctgggtagtctgctgttagtttgatggactttcctttatagatgacacttttctcttgattgtagaatttgttctttcactttgacattagacactcattataatatgttgtattgaagtcccttttatgttgtatttgcctgcagatcatggagcctcctgtatctattatgtctgtatctcttgctagccttgggagtttttcaatctattattttgttaaagatttttgatgtttctgtccctttgggaataccagtaattcataagttcaatgctgtatgcagtcctaaacacttggaaagctttgttcatttttttcttatttttaaaatttttatcagactgcactgtttgaaaagacctgtcttcatgttctgaaatcttttcttctgcttggcctagtctattattggagtttccatgtattttatatctccttcagtgaattttttagttccaggatttttttaaagacgtctatctccttggtaaatttctcattcatatcctgaattgattttctgattactttgtattagttttcagatttctcttgtatctcattgaacttaattgaaatcaaaatattgaattctttggggttgtaaggttttctttttggttctgctctattgttggagaattattgtgttcctttgatggtgtcatattgccatgcgttttcatgtttcttgtgtttttatgttcattctagcacatctggaacaattgctttttttttcaatttaacttttgtttggagtagactttgctcctttatatgtgacttcgatgttggttgagtagggccacttgtttttatttctgggtgtgcgcattggtgaatactttatgatattcttggctataaatattgttattggtatctgtggattcctttgtgtgttagggtgtgggttttgatggaggatgtggtgaaattatgctagggactggaatgcttgataggtccttcttcaggtttcagtggtagcagtggttgtctaagcaggtctatatctagggcagtgtgtgctggcacatgagttggcagttccatgcaggctgattattgggggctctgggtggctcttttggataccagttgtggtagcagtgtactgggcaagtgagtgggctcatgagctcttgggtagctgggtggcctcagtaatggtggcagcagtagtggtaagatgctctccccagtgcccttgtgttgggagtgattgcaattggctgtgtgggctgacctccaggctgggtggcacttgcagatagaaaccaaccgagagagtaatggcagggtttttatgcccaaactctgtcccctgggagaagtgcttgggtgtctcaggcagtgggctggactgtgggacctccagaagtccagatcctgcattgtgtctcagagagtagggcaaagctgggtaaatctggattgggaaagcctgggcttgtcctatgaaatgcttgcatgaggggtgacaacacctttgctgaagtactgccatgatgggagagtggggctactggtcccagtggtttcagcattggctggcaagtggggaatctgtgtccctctcatgtctcagtcctggtggggcttcctcccttatcccgactcttgcagctgatcctgtagtttagtcggactgggtagttgtcacctatctcataactcagccctgcccaggtcaggaccagactgctttggcggctcttattctgctcacatcttgggggttgcctagctcccaagctgggggctggagtttatgtcacgcttgcttttcagtcctggttgcagaatcccatttcctacacaggccccagttcagcaaaccacagattgagttactctgatacttaggactggtgctataggttcccaggtcacacaatttgttaaaccctaggattgagaatggcatcttactgtagctgcttaggtctcagggaaggtgtggaacccagggtgtgttatttccctatagcagttcctttatacagtctcctggttgcttcccaagtcaaattcaaggtttgggagggtcaagatacactcccatggcctggattatacaattgattctccagtaggaaagtgaaccacagaaagacactcagttaccttctcccacgttgcagactcccttttggttgccagcctgccctgtccacattagctgtttgttgtcctctctttttggagtttctgtttgcttttctgttaaatgcctgtgttctgtcttggaacacttacattataagtgtgactttaacactttatcttaacctctttggagacttgagactgaaatgtcactaccacttattagaatttgtattcttccctcttgaatctgtgttgactgttagcagtgttcttctaacagggttttctgtttgattttgttgttgtaatacctatgtgttcataacatttattaaatcatgaattcttttcagacagaaattgaatgctatgtttaattttattcctgaaattctatttggagctcttttacgtgtattcctgccatactaaatgtaaaaactgacatgtcaaatgtttttgacatcaatgtatcttttctgggagatacctaaaggaaacgacttgagttcttttatatatattttctaaaatatttttacaaataagattatgagacttgtaaataatattttaagcacttctgagtatcttgctctttaaagcatgcatttattgactccttaaaatgcacttatggttttgtcagggagttttaaaatataaattcaacagttctgtctagtttgaatgtttagaatgtgtttaatgtgattttctcctgctaagaatgttctttatttcgccaagtacatggcagattttccataatataaactattatatagtgaaactttgtattttcttacaggttcttgagaaatctacatgaaaaaatggatagacaatagtcctaagataataatgttcctataacattaaaaaaatcccctttaagccattgtaagatttactttattgttaacaactagttgtttcattaattattgaatacctatcttttatatggagtataagaaattataaattgttactttaaaaacttatgttctcttgttttattattttctttaatttgatttcatttcttttggcattctatggatggtcgaatggctttgtcctaaagaggacagaaaaagcatactttatgcagctaaagcttgaaacacaatatgtaactgtgaatacatatctgagagcttcttcaagatttaaatgcttctgaacattattgtctttgtttatagcaagggtattttgttgtaattatattcacatgcaattcaaatttctgccttttttgttactttagtttcggtatgttatgtaaaaggcataggttttctgtatgcttaaattcactgactatacgtggttgtgagctttaaatgctgctatgtattctctacctttactgaaatgtttatctgcagtaaaatgcagagattttttttttttttttttttttttttgagacggagtctcgctctgtcgcccaggccggactgtggactgcagtggcgcaatctcggctcactgcaagctccgcttcccgggttcacgccattctcctgcctcagcctcccaaaatgcagagattttaatttaattgttcagtctgatgggttttagaagttatatacacacatttaattatgatacctaacaaagtatagaaaattttcatcagcaggaaattactttcaacctcatcctcacttttttatttctgtcaccacagattagttttgtctgctcttggatttaacgtaatggactcatataatatgtatttgactgtcactcaaaataatttttttgattcattcatattattacatttattagtaattcttttattgctaagtgtcattccattatatgaaaatatcacaatttgtttatctgtatttctgttcatgtatgtttgggttttttacagtttctggctaatatgagtaagattgctatgaacatttgtgttcaagtcattttatggatattatatttttttcccttgcgtaaatatctagtaatggggattgctgatcccccaagccaaaaagtctgagacttcctatttaagttttagtctctccatgctacatggattgggaaaagtcatatatgtgtgaatctcaccttgagtggtttcctttaagagtcaaatttcctttaacttttgcctgattttagtcattcttttttgtttgtttgtttttgaggtagggtctcgctctgtggcccaggctggagtgtgcagtggcacgatatcggctcactgcaacctctgcctcctgggttcaagagattcttgtgtctcagcctcccgagtagttgggattacaggcacgcaccaccactcctggctaatttttttgtatttttagtagaggtggggtttcaccatgttggccaggctggtcttgaacccctgaacttaagtgatctgcccgccttggcctcccaaaatactaggattacaggtgtgagccaccacacctggcctgattttagtcattcttaatgcattcaaattgttgttttaaaaaaacgttttgtatagagattatatatttttatattcaaggaggttggtgtgatataggctatttcccaaccattactagactaagaactccaaaagtgattttttaaaaatgtgtcttattttatccaccccactccatttccattttagggtttccatgttactcattgtagaagttggagttcttacaattgtctttaaggaactacatgccctgttgtctcctcagcccacaacctacattgttgaccatctccttttaacatcctctatctggcttattgaatacctctaatctctttacttcaaaagttctgctggatgttcatagggctggcttggttcctttttccagctgattgtttaaatgtcacatttgtcagtgaatctttccctgatagtgccacctcctctgtggcattttattatcttatttttctccataatatttattttttttgtggcccactatatattttacttatttacttttttgtctgtctctaccaccagaatataagctcctcaatggcaataatttttgtctgtttgtttactgctgttattttcactacttttggtctttgggagatagtagagtgtcagtaaatatttgttgaatgaatgcatgtgcaatattccatccttacaaactgtgctatttttaagttcactttattcggtttccttatgaagagggatattttttttattgacagagaaaggacaataaaaggaggaggctatgaactgcattttgtatttcctaatattcttttgtgttttcatttttggttgtacttcaagcctttttgtggttcatttattttatggctcttgaattttgctagagtactagattctagtcatttaaaaaattttctctttaaaagtgaaaatatagaaagaattgctttaggttgaaacagatggaaattctccaggaaaaaaaaaaagtgatggacttagctgttgatgcagaaatcaatttaaaaatctttagatctaagagacccttaatcagtcttatttgaaacagaatgtatttctccactgcataagtaattggctgaaaccagaaccattaacaaattgaatgaagatttcgttaatgccagggaactgtgctgttagcaaaatcactcttattatgtcacagtattcaaagatgtgcatttgttaaatagagttgatgtactttttcagagtgttgccaattgtgagaacatttgttgaatgacatttcagtgtcctcaaacttgtgctattatcttcatatattcttggtatgcagaggtgacaaacaatttgaaaaaaaaatacattgatgatttccctcacttccctccaacttgaatatgaaggccagtcttatgatttggtactttggtcaagtctgtgggtcaagggatataattaagttccttgtcaccctaacagtgagactaggccgacttttgtggtgtctaaacttgagggtattggttagggaatatccctgaattgtgtttgtaataaggcatttgcacttcttattgtgatttgatgtagcagccaaattaaaagtacagagtgccaaaatgaatgtgttggcttagtcacttttggagttttgcagagggcaacagactcctgaggtcttctggaggctgcctaatgggtaaccctgttggagatttgtgcagtatgtcttatgaaagtaggcagtcacttggatatggtaatatattcacttctgtgttttataggttatatattgtataccagtcatctctgataccctggccctggcatcttattattttttttccagagacagggttttgctcagtcactcaggctgaagtgtgcagtggcttgtggtgtgatcatagctcactgcagccttaaactcctaggctcaagggatcctcctgcctcagcttcccaagtaactaggactacaggtgtatgctgtcatgcctagatactttttaaagaacattttcatagagacagtgtcttgccattttgcccaggctggtcttgaactcttggcctcaagcaattggtccccctgcctcagcctcccaaagtgctaggattacgggtgtgagtcactgtgcctgccttgtatctttaaaaaataatgttttataattataatttgtatagtatatactgtattcttttgaattgtatggttccatgaattttgatagctgtatttccatgagatcaccatggtaatcaagatacagagcattatgtttatagcggcacaatttgcaattgcaacaatatggaaccaacctaagtgcccatcaaccaacaaatgaataaagaaaatatggtatatatacactatggagtactactcagccataaaaaggaatgaagtagcgttttttgcagcaacttgggtgacactggaggccagttttctaaatgaagtaattcaggaatggaaaaccaaatatcttacgttctcccttattgggagctaagctatgaggttgtggtggcatgagaatgatataatggactttggggatttgtggggcaaggttgggaggaagatgagggataaaagactacacattgggtacagtgtacactgcttcggtgacggttgcactaaaatctcagaaatcactgctacagaacttacccatgtaagcaaataccacctgtaccccaaaaactattgaaataaaattaaaaaaaattttttttaaagatagagtattttcattaccctcaaaagtttcattttcctttgcagtcccttactgccctaacctagccccaagcaacccctgctctacattctgtcactatagatggcattctctagtattttatataaatggacttacagatatactttttgtatgtgtctggcttcatacactgattataatgattttgagactgatcattttgttacttgtattagtactttttttttttttattacagagtagtattctaccatttggatatacctcagtttgcttatctgttcacctgtttgtggatatctgggctatttctaggttttggctattatgaataaacctaattaatgtttatctgtgattaacatttatgtatatgttttgtatgtttttgtatatgtttatgtatatgttttgtatgtgtatatgtatatgtttttgtataggcctatattttcttttttttaattatactttaagttctaggatacatatgcacaacgtgcaggtttgttacatagatatacatgtgccatgttgttatgccgcacccattaactcatcatttacattagatatttctcctaatgctctccttccccctgccccccaccacatgacaggccccgtgtgtgatgttccccttcctctgtccaagtgttctcattgttcagttcccacctatgagtgagaacatgcggtgtttggttttctgtccttgtgatagtttgctgagaatgatggtttctggcttcattcatgttcctgcaaaggacatgaactaatccttttttatggctgcatagtattccgtggtgtatatgtgccacattttcaaaatccagtctatcattgctggacattcgggttggttccaagtatttgcttttgagaatagtgccgcagtaaacatacatgtgcatgtgtctttatagtagcatgatttataatcctttgggtatatacccagtaatgggatggctgggtcacatggtatttctagttctagatccttgaggaatcgccacactgtcttccacgatggttgaactagtttacactcccaccaacagtgtaaaagcattcctatttctccacatcctcttcagcatctgttgtttcctgactttttaatgatcgccattctaactggcatgagatggtatctcattgtggttttgatttgcattctctgatggccagtgatgatgagcattttttcatgtgtctgttggctgtgtagatgtcttcttttgagaagtgtctgttcatatcctttgcccactttttgaatggggttatttgtttttttcttgtaaatttgttggagttctttgtagattctggatgctagcccgttttcagatgggtagattgcacaaattttctcccattctgtaggttgcctgttcactctgatggtagtttcttttgtcatgcagaagctctttagtttaattagattccatttgactattttggcttttgttgccattgcttttggtgttttagacatgaagtccttgcccatgcctatgtcctgaatggtattgcctaggttttcttctagggtttttatgttttaggtctaacatgtaagtctgtaagccatcttgaattaatttttgtataaggtgtaaggaagggatccagttttagttttctacatatggctagcctgttttcccagcaccatttattaaatagggaatcctttccccatttcttgtttttgtcaggtttgtcaaagatcagatggttgtagatgtgtggtgttatttctgaggcctctgttctgttccattggtctgtatctctgttttggtaccagtaccatgctgttttggttactgtagccttgtagtatagtttgaagtccggtaacgtgatgcctccagctttgttctttttgctcaggattgacttggcaatgagggctcttttttggttccatatgaactttaaagtagtttttccaattctgtgaagaaagtcattggtagtttgatggggatggcattgaatctataaattaccttgggcagtatggccattttcatgatattgatttttcctatccatgagcatggaatgctcttccatttgtttgtgtcctcttttatttcattgagcagtggtttgtagttctccttgaagaggtccttcacatcccttgtaagctggattcctaggtattttattctctttgaagcaattgtgaatgggagttcactcatgatttggctctctgtctgttattggcatatagaaatgcttgtggtttttgcatattgattttgtatcctgagactttgctgaaattgcttatcagcttaaggagattttgggctgagacgatggggttttctaaatatacagtcatgtcatctgcaaacggggacagtttgacttcctcttttcctaactgaataccctttatttctttctcttgcctgcttgccctggccagaacttccaacactatgttgaataggagtggtgagaaagggcatccctgtcttgtgctagttttcaaagggaatgcttctagtttttgcccatttgatatgatattggctgtgggtttgtcataaatagctcttattattttgagataatcaatacttagtttattggaataccatcaatacctagtttattccaacaaaagccaatggaaactaatacaaatggaatctaatacctctaataccatcgatacctaatttattgagtgattttagcatgaagggctgttgaattttgtcgaaggcctttcctgcatctactgagataatcatgtggtttttgttgttgtttctatttatgtgatggattacgtttattgattggcgtatgttgaaccagccttgtatcccagggatgaagccgacttgattgtggtggataaactttttgacgtgctgctggattcggtttgccagtattttattgaggatttttgcatcaatgttcatcagggatattggtctaaagttctctttttttgtcgtgtctctgtcaggctttggtatcaagatgatgctggcctcataaaatgagttagggaggattccctctttttctgttgtttggaatagtttcagaaggaatggtaccagctcctccttgtacctctggtagatttcagctatgaatctgtctggtccttggctttttttggttggcaggctattaattatttccttaatttcagagcctgttattggtctattcagagattcaacttctttctggtgtagtcttgggagggtgtatgtgtccaggaatttatccatttcttctagattttctagtttatttgcatagaggtgtttatagtattctctgatggtagtttgcatttctgtgggattggtggtgatatcccctttatcatttttttttatctatttgattcttctcgcttttcttctttattaatcttgccagcagtctatcaattttgttgatcttttcaaaaaactggtttctggattcattgatgttttgaagggtttttttctgtctctgtctccttcagttttgctctgatcttagttatttcttgccttctgctagcttttgaatttgtttgcttttgcttctctagttcctttaaatgtgatgttagggtgtcagttttagatctgtccatctttctcttgtgggcatttagtgctataaatttccttctacatactgctataattgtgtcccagagattctggtacattgtgtctttgttcttattggattcaaagaacatctttatttctgccttcatttcgttacttacccagtagtcattcaggagcagattgttcagtttccatgtacttatgcagttttaagtgagtttcttaatcctgagttctagtttgattgcactgtggtctgagagacagtttgttgtgatttctgttcttttacattggctgaggagtgctttacttccaactatgtggtcaattctggaataattgcgatgcggtgctgagaagaatgtatattctgttgatttggggtggagagttctgtagatgtctattaggtctgcttgatgcagagctgagttgaagtcctggatatgcttgttaaccttctgtctcattgatctgtctaattttaacagtggggtgttaaagtctcccattgttattgtatgggagtctaagtctctttgtaggtctataaggacttgctttatgaatctgggtgctcctgtattgggtacatatatatttaggatagttagctcttcttgttgaattgatccctttaccattatgcaatggccttctttgtctcttttgatctttgtttaaagtctgttttatcagagactaggattgcaacccctcctttatttttgctttccatttgcttggtagatcttcctctatccctttattttgaacctatgtgtgtctctgcacgtgaagtggttctcctgaatacagcacactgttgagtgtcttgtgtcagtctgtgtctcttaattggaacatttagcccatttacatttaacgttaatattgttatgtgtgaatttgatcctgtcgttatgatgttacctggttattttcctcgttagttgatgcagtttcttcctagcattgatggtctttacaatctggcatgtttttgcagtggctggtaccagttgttcctttccatgtttagtgcttccttcaggagctcttgtaaggcaggcctggtagtgacaaagtctgtcagcatttgtctgtaaatgattttatttctccttcacatatgaagtttattttggctggatatgaaattctgggttgaaaattcttttctttaagaatgttgaacattggcccccactctcttctggcttgtagagtttctactgagagatgcgctgttagtctggtgggtttccctttgtgggtaacccgacctttgtctctggctgcccttaacattttttcctttgtttcaactctggtgaatctgacaattatgtgacttggagttgctcttctccaggagtatctttgtggcgttctctgtattacctgaatttgaatgttggtctgccttgctagcttggggaagttctcctggataatatcctgcagagtgttttccaacttggttccattctccctgtcactttcaggtgcaccaatcagatatagatttggtcttttcacatagtcccatattttttgaaggctttgttcgtttctttttattcttttttctctaaacttctcgcttcatttcattcatttgatcgtcagtcactgataccctttcatactgaatgggcaaaaactggaagcattctctttgaaaactggcacaagacagggatgccctctctcaccactcctgttcagcatagtgttggaagttctggccaggccaagcaggaaagagaaagaaataaagggtattcagttaggaaaagaagaagtcaaattttccctgtttgcagatgagatgattgtatatttagaaaaccccattgtctcagcccaaaatctccttaagctgataagcaacttcagcaaagtcttaggatacaaaatcagtgtgcaaaaatcacaggcattcctatacgccaataacaaacagagatccaaatgacgagtgaactcccattcacaattgcttcaaagagaataaaatacctaggaatccagcttacaagggatgtgaaggacctcttcaaggagaactacaaaccactgctcaacgaaatgaaagaggacacaaacaaatggaagaacattccatgctcatgaataggaagaatcgatatcatgaaaatggccatactgcccaaggtaatttatagattcaatgccatccccatcaaactaccaatgactttcttcacagaattggaaaaaactactttaaagttcatatggaaccaaaaaagagccctcattgccaagtcaatcctaagcaaaaagaacaaagctggaagcatcacattaccggacttcaaactatactacaaggctacagtaaccaaaacagcatggtactggtaccaaaacagagatatagaccaatggaacagagtacagcccttggaaataataccacacatctacaaccatctgatctttgacaaacctgacaaaaacaagaaatggggaaaggattccctatttaataaatgttgctgggaaaacaggctagccatatgtagaaagctgaaactggatcccttccttacaccttatacaaaaattaattcaagatagtttaaagacttaaaaattagacctaaaaccataaaaaccctaggaggaaacctaggcaataccattcaggccataggcatgggcaaggacttcatgtctaaaacaccaaaagcaatggcaacaaaagccaaaattgactgatgggatctaattaaactaaagagcttctgcacagcaaaagaaactaccatcagagtgaacaggcaacctacagaataggagaaaatttttacaatctacccaactgacaaagggctaatatccagaatctacaaagaacttgaacaaatttacaagagaaaatcaaacaaccccatcaaaaagtgggcaaaggatatgaacagacacttctcaaaagaagacatttatgcagccaacagacacatgaaaaaatgttcatcatcactggccatcagagaaatgcaaatcaaaaccacaatgagataccacctcacaccagttagaatggcgatcattaaaaagtcaggaaacaacaggtgctgaagaggatgtggagaaatagcaatgcttttacacctttggtgggagtgtaaactagttcaaccatcgtggaagacagtgtggcgattcctcaaagatctagaactagaaataccatgtgacccagccatcccattactaggtatatacccaaaggattataaatcatgctgctataaagacacatgcacacgcatgtttatagtggcactattctcaatagcaaagacttggaagcaacccaaatttccgtcaatgatagactggattaagaaaatgtggcacatatacaccatggaatactatgcagccataaaaaaggatgagttcatgtcctttgtagagacatggatgaagctagaaaccatcattctgagcaaattatcgcaaggacagaaaaccaaacactgcatgttctcactcataggtgggagttgaacaatgagaacacttggacacagggtggagaacatcacacactggggcctgtcttgtggtggggggaaggaggagggatagcagtaggagatatacctagtgtaaatgacatgttaacgggtgcagcacaccaacatggcacatgtatacatatgtcacaaacctgcacgttgtgcacatgtaccctagaacttaaagtataataataataataataaaaaaggtgggaaacataacagattatcagagaagactgctctggataaaaattgttttgtgaaacctttgtgtatgtgtgtcagttcgcagcataaaaagtattcttgctgtgggacatagtcgaaaaaactttaatgctgctgtttttagagagcttctagtaaaaatttagctggtaaatttacattttcttttcctattttgaggagttaatgtagtaattttgtctaatttgagatgtgcttagaattttggtttacagagtaattgtaagaatttaagattatattgaagttataatattttgaggtgacattttagtaacattctcaggtaaaaggtaatgtaagtgagatgcctaactactgtgttaacagttttggcatgggttgaaaaccattataaatattagtggcttattttcctgtgttttatattattttgatcatatttaaacctaggacattaaagtgtaaggaccctcagatttaaatttgaatatgaaataataaagaaattacattaatataattcattgatatgatgtacacaggatagttttattttaaatagaagcaaatataattagctaacttaaggcaaaactctatactgggttttatttcacatgtaactaaaatattggtgattgtcttatttgcttagttatgagtctcaggaataattaaatggtatgagatttttcatctttgtatagtaactgtatcttgtttatgtcagcaatgcctactataggtctggcaaataatataagaatatattctaaacaatgtaaggaattatttattccctttgcttttaggacattgatatttctgaagtatacgtgccacttattttatggcgtatccctcaatttttatttttctgttgttaattcatgatcagatttagattgtgattttttggttagaatactgtgtaagtgacgttgtgacttttgcagaatatcacacctacaggtgcttgatgttcattagccactttttgataatgttaattttgatcccttgggtaaggtgaggttctccactgtatcactactcttttcttttataaataaagagcagtcgtgggtagatactttgtgactatgtaaacatacaattccacgtgagactttctccactttgattcagtatctactgatgattcttacttgattgaacttcttgtaacttttgattttgatataatttatataattttaaacttacagagaagttgccataatgatgtaaggaagccccatatattctttatcctgattcaccaattgtttacatttgttttacgtttttaatctgtaaaatgggggtaataagcgttacctgtctcacagggttgttagttttctttgtcttcttttttgtatatatagtatagtatatatatgctatatactatagtattttatatatattagtatatatacactatatactatgtaatatacattagtatatatatactatatactaatgtaatatacattagtatatatatactatatactaatgtaatatacattagtatatatatactatatactaatgtaatatacattagtatatatatactatatactaatgtaatatacattagtatatatatactatatactaatgtaatatacattagtatatatatactatatactaatgtaatatacattagtatatatatactatatactaatgtaatatacattagtatatatatactatatactatgtaatatacattagtgtatatatatactatatactatgtgatatacagtatatatatatactatatactatataatatacattagtatatatatactatatactatataatatatattagtatatatagtatagtatatatactgtgctatgtagtatagtattatatagctattaagtattagtttgtaataatagttatcctttctatattttctattcatttaagctttctgaatactgattattctctgtgaagctgtgtgtgtgggtgtttgcatgcacaaacacatatgaggtcagcaattttatttactttttttattactctgtcatatggccatggaacaaatatttttcaatgacaaagtttaatagaaaaggctctggaaattaagaaagccaatccatgaatacttttagtcatgactcttttaaaaattactttccttgtgcatactctttaatttatttcaattcaattctacagatagatgtagaatgtgcttactgtatgcgggacattattttaagtgctccgggtatagcactgataaaaagggcaaaatcctttgttctcaaggagtttagaatcttaggtggtagtcagcaagcaaataaatactatatgttatgatagatggcaaaaagccctaagaaaataaagtgaggcaagtagtgacacagttcacttattagttttctgttatccggggactgagaatacagtttgttaatttattgaccctgcttctccgtcttctggacgtttgttatgtcagtcattcttactgttagttgaggccaaagaaactgtaatctagaagttatttagtcctctacttagggagtgggtagtgaatgagtctttcaaaatttgatgcaattatccaaaattagtgaatgtgtatgcgtttttctgagacaagtttctatacttttcattcagttatcaaatagtctgtgacccaaaatatttaagtggcgactctaatttgtcctttcttctagccacatggctaaggagttttgtgaatgagtaacacagtcttgattaacatgaggtttgcaggctagcctttgtgtacctatctctagttagtaacttttaaaattagagttgtatccttttgtcagatggctttctaataattttctaaaatgaacataataagtataacattgtaaatatttaaaatatgcaattttgtttgtagttttaaaatcaaaatacttgatagtttcttgtgtgatgatatatattttgagtagtattttccaaagacaatttataatatcaacaaagaaggctaactcatggcaatattacaaatatacacgtatctagttggggaaagaatatactgattggacagaacacttaattggagaaattgggaaaggaggtgccactaactcaatatttgacaatgtatcatttaaccctttacaacttagtgaggcaggtcttattgtgtccattttgcagatgagaatatcgaggcccaaagaggtgaatagaatatgtaacttgcttaaggtcaattagtatggaacttcacagcccacactcagctgctactttagcaaaccaaatgaaagctagggtaatgtttactcattataaaaaggatttctggacatgctttggcctgcagataatattgtatgtgtgacaggtgggaggggtatgtgtgtgtgtgtgtatgtgtgtatgtatgtatgtatgtatgtatgtgtatgtgaagaaccaaccaaatattagctctataggttgcagtcctgcctcctaccaaagccatagccaagtggaaatacaactttttttcttcctctttcatacattcattttcatgtgaatacttctccttgaaagtttgtatatgttatgtgattgatcacttgtctgagaggaatctttagtgttgactctgtcagaggctgttgtaggtcacaaggatataaaggtgaataagactccagctgtctcctaatggagattgcactctactctgaggagatagacatgtagacaaattattgcaatacactgatctaaatgttaatagagaaagatgcagagtgctgagggaacagagtagcagactacagagggaagggaaaggaaaaaataacagaggaggtgacactggagtcaaagaagaggcatgtgaaacagcatagtatgttttgggaatcttatttgtttcactgtggctaaattatagataattagtaatatgttttagaacgtaggagtggaaaggttgttatcccatcctgaggggttttgtatatagagtttggattttattttgtaggtagtaaggagctattggagaattttaagaagggaagtgggatgatgggacgaggttctataggaggcaggtagcccagttagaagactattgtgatagtctgggaatatgtggatgatgagaatctgaaatgagtcatgaattttggaaaatatttgaaaaatatttagaagatactgtagaacaaattaggtgaccaaaatgccttatatttataatactttatagtttccaaaatcctttaggtgtgcatgttattggatattatcagtaacccagaaaagtaggtagttcagatggatttatttccattttatatgaggaaattgagatcttgaaagattgtggcttagccacggtcacatagctggtgatagtttaagcatgaaccaaatcataaacttcaaatatagggttctttttaatttgtctgcatcatctctatgcagtgcctaagcatacattagttaatatcaaggcctgatcacagtggggtgtgagttttaatttattcacttgatatctctcttcattagttatgttaagtgcctaatggagagggataggatcaattaaataaggtaaatgcaacattttacaggtctatataaatacctagaaagtgcttttcaattaagacggcatgtatgccagtgcttttttatatatgagaatggttatgacatttattcctattttattggagagtctattgcatgggacttgataatagtggcaggctggtatcagagactatgcttgctgtaatcagtgttaaagatcagtatgtaaagaatccttacttaacatgtaccatgaaattgattttttattagttattatagagatattatagattatatctctacaacatcttccttctttttacccataacctctaaaaggcttagtgccagaaggaacagaactgtatctttattttctcatcacatcctctctcaaatagataatacttccattgctgtctttccaacttggctttgagtcactgctgtgattctagctgttgaacagtctttcaaattaagtgattagtattctagtcaaggaaaaattgtgagcctgccattcttacccagtattgctaaggtagttttactaaatctattattagggtcatgttctcagaggcatatgacaattgcatttcacaaaacttccctaaatattgatacttgagatttacaggaaattaaatctaaaaccttacacttctgaagctggaggcaccatagagctgtgaagttcagtataaagtcacatctgtgctcaatactttataagaaaagttactctgccttagtcttcctttactatttttgtcttacttgattaaaattttgctgttgtattaactaataaattcaaaggaaatgttctgattagtttctgtcataactgggaacgatagtaagagtaccttggaaagtatgatagtctgttgcgtaacacttgctgggtagtagatatcaattctctgcctgtttcaatctcattgtgtctaaaggtgtgaacctcttaccatctggatactttagtttccctctaaattaaaaagaaaaaaagcaaatcttacctgtatagtacctacgcaaagattttggaagatagtgggaagtcattaaagtgcttttcaccaatttatgcaatttactagttgaaatttgtaactatttaaaaatcattagttttaaaaaatactattttaaaatagtaatttactatttaatatttaaaaaccattggctcttttaatatatttcattgcttggtattagaattttttatttttagaatagagtatatttaaagatgacttttgctgttaaatttgacaggcgtggcaggaggccaatctaataagcccaaagggagaattcgcagagtatgcaggttaaaagagccctggaactgactttctgtgaagcctaggctatccatatacattcctgctgagtggagatttgcttaaagttgactgttttcttccttctgtaccatctgattccaatctgcacctgtcttttatagctagagaccgttggatggcagcttaaccttcagatggctcactctgctcaagcaaaactaaaatctcctcaagctgtgttacaactcggagtgaacaatgaagattcaaaggtaagaaatggtatcccattaaaaggatgtattttgtttgttaggacttaaactttttattcttagcagtctttgctctctggatttagaatttaaacataattcagttaaacagttattaataagtggatcttttttgacagaaatagcttatcttgcaaggtgcctttcttacaaaaacatttcataatgtcttcttttaaattctgcagtgaaaaaaaattgttgaagaccatataaaattatgattttaatgttttaggtatttgcagatattcctgagtgtttcatgttttaagctgaatatatgtggtagagagaatattgtttgttgtccagctagagcctggaacaataaatatgatggtgacctgaattgtgtttttgtgtgtgtagtagtatagtatgcctgcatgtgtttaaatcccagcttttgagaaatacaatttatttattttttttgagacggtgtcttgctgtcgcccaggttggagtgcagtggcgcgatctcggctcactgcaggctccgccccctggggttcacgccattctcctgcctcagcctcccgagtagctgggactacaggcgcctgccaccttgtccggctaattttttgtatttttagtagagatggggtttcaccgtgttagccaggatggtctcgatcccctgaccttgtgatccacccccctcagcctcccaaagtgctgggattacaggcgtgagccaccgcgcccggcctacaattttttttataccacaggattttactttattattaatttcagaacaacttgaacgtgattattaaagatcaaagcattgctatgaaatactttttgttactgcggcatatagggaaatatatctttcagatatgataagagctttttatcatattttatactgtaatggattatcttttaaggtagaaaagggggagtgactttttcctcctaagtagataagactatctcatcttaagacaaaatagaattgagaatgaggtattagagaagatctgaggcaggagattacagtgactgaatgataatagaataatggaagaaatgttattatttataacaggaattgaaggatgggaatattattacttttttgttaaaactttcgctattcattctattatgcaggtttctggcttctttaagaagtatctagcccagattatatgactataaaattctgtggaattgacttgagtcttacatataatgtattagtttattacagtgtttcaaaagtatcattttatttcacacattttcactggaacgtaatatgaacttagtggttagagtcaagctattagagtatgtctggtggtttccctttatgtgcagtttcactttccatagtttcagttacccgcggtcaactgccgtttgaaataggtgagtacagtacagtaagatgagagaaagagaccacgtccacataactttattacactatgttgttgtagttgttctattttattattattgttgttaatctcttacagtgcctaatttataaattaaactttatcataggtttgtatatatgggaaaaaacagtatatattgggtttagtactatccatggtttcaggcctccactgggagttttggaatgcatccccccacagtgggcagggggactactgtgtgctctgcagtttagtgtagtgtaacctcaggcaaattacttaatctttgattctcagtttctttatctgtaaaatataggtaatagtatctatctacacaatttttatgaagactaaatacctagtatatgtaaagtgtttagtccagtgcccagtattacagcgtgtgctcaataaatgctggctactaccatcatcatcaataaaacttttttgtttttggctaaaataaagaaatcaatccatttgttttaattcagagctctcactaaatttatttcctgatgaagttattacctcttcccttgttccttgcattccctctcccttttttcttgattatatttttcacatgtatccttactggaaattaggaggggaaaaagagcctgaaaagtcccttttgtttcttctgtgaactgagtaagttattcctttaggtgtaggatgatgatctggaactcactagcatagactggagctattccatgagtgaaaatacatacatacatgcacattccaagtagctatatacttcctttgttttatttttcgtgactacctaatgttaagtctgcgtagctaaaagcattttgtatgttggaagtgtactattttgaccacatacattggatatgctttaagcatcatgagttcagcaatgcttgtctttgggattctcaagtccttctagcttctttgttacatcttcaaagtatgcctatgtgtctgttatatttttaggcagtaggaataaaagagtaatgcttctagtaagacagccatgttaataagacattcagattattcaggaagatgtgaatatctagatgtgaaatctaactcatttgaaatatgagcttgagtacatttatgtttttctgtgtttgtattttgagattttggatagatgcatatatgcacattgattaatcttataacttgcagagctagagcaccattttcattaacaaatatgctgaggaagaagaggagaagcacacatacataaaagatatttctctttcatcttgtatgtagacttaagtgacttctttgtattgtctttctcttctatggcattgtacacattttgtgcctgtgtcttatatctcctaaacaatagacagacacataatgaggtatagagctaccatcacctaggcagaagcatgccatctccaagtgttatggtgtgccctagctgtaaaggaacagttaactactatacctcttttcctcaatgaactgctgcctggaattactgctctttctcttgtttaccttctccttgattttatgatttggtattctattctttgtactcttcatcttattccttatgttaatttttatgtgactcctgttattaaggaccacaaactacttttctttcaaatatttacaaatatgaaatgagaattcttcacaggttggaatattaagtaaaaaggaatgagggtatagagcatgttttaaaaaacaagtttattaaaggaaaggaaagcttttacaaaaagggagattaaaagttaccactgcttagtttatgatataaagtatcttaaagtacaaaactgtcatacttatgaagttggtgttggtttaaaacaggaagcattgggtacagttctcataaatgtgtattttatagggtagttatcctgaaaatatacatatattaaactactgggaggattagaatcactgtaaattgtgagggattattttggttgtatttacttttgagctgttgtactgaaaacttactgtaattcactgaagagtacggtttataaggagctccttatcttctttttcacttctaacatacaaatgaaaaatgcagcctgcagtgaagttttaattgctatcacactggataacactgtttgactgtggtctcctttcttagaacacttctgtctcgaggctttcctgttttgctattaattttatcacaaaaactaggtgattgtagctttcctgcagtattttgatatgtattctagttgtttttggttaattgtcttagtgtttgtctactgtgtttagcaaagtgagattattttcctgttccacagatacctcaaatcgagttttctgacttaaagtttttttcgttagggggcagtagagtgctttgcttacctagccttttctggcattcacagtgttatttgaaataacattcaaaataatttgtgaagtcagtagttgaaggaaatgctaagtgtttacatttcaaatctttatagaacaatagagttctcttatttatttccataaacaaaattaatgcttattaatcatatacatatagaacaaataaatgaaatcatcatgatttggcttttgaaatttgtatatgatcatttgccaaaatgaaatatattaaaagctttctacattattgacttttttgttacattctgtcacttgtattaatttcttcatgagaaaaaagaataaaatagtccataagataattgaatggctctattaggttatgatgtaactagttctaggcccattgtagtcagctgaaaattctttatttctagagagtaatgtcatttgtaacaaatgttgataattttgactgacaccaacactttaactttgaatatcttaaaatacttaaattttgctattaatcttagtacatttttttccccagtaaatttcctgttaaagacaaacctgttttgttaatacagggattccaaattttatttgtgcatcttttgaggaaggatccttgtgtttcatttttttttcttttacagtaactgtggtaaaatcaccctgacagtagaatttttatttatcttaatgttaaattagattataatcagattgcagaaagtactttatgtagaagtaattatgattttgaatgaatttggggcttctaatactagttttctgacttagagctcttcattcttatttccaaaatatatgacaaattctgtttagtgtgagaaaatgggcaaaagttcttttttaaagtgtttactctgtgctacacatagtatcacttctttttgtggttaaaacctctcttccaggcatgatttcttattattcttattttattgataaatggagacacggaagcacagagaagttaaataatattcccatgttatacagatagtaaacagtagacctaggatttgaatccaggcaattttatttgagttccagtttatcagtaggatgctgtatcaccttgttaatttaataacttagcagttgaaattgtaatatgtgtatatgtttcaaggtgttgaaagctgttgtaaaatgtaaggttgttcataggattatcgttacatggactctagatttaatttttctttcccctttatttgactaagttgaaacaattttacatttttagtcaattagaaacaccatttattcttatgtagtaagtaaagtataaatgatgtcagttcaacagaggctgccttttattaacaaatattattgtaagggctacatgacatcaatgatgttgatgtgagcaaataactgcatcagttaaaaagaaaagatgtcctcagatctatttaggatagatttctcagagaaaaatatgtatgctattcaaatcatgaattcttgttatagaaatttaaatcttttcatcttaaaggtggtgttagtattgactgatttggaatgaccttcacattttttagctacttatgtgagttcgtctgcattttccttttttttttcattgaagtatcacgtatcatatctttattagaataaatcacactaaagcatactttctcacccttaattacacatacaaatgagataattcaactgataggacataattcaaatataaataaaatcattctctcacatatttaacattgttgagtggattttaaattgtatatatttaaggtatacggcatgctgttttgatataaatatacatagtaaaatgattgctactattaagaaaattaacccacccatcacctgccattattaccttttttgtgtttgtggttaaagcacgtaaaatctattttcctagcaaaatttcagtttacgatacaatatcattaattatagtcctgatgctgtacatcagatctccagacttatttatcctacataactgcaagtttatatgctttaacctgcttctccccattttttccctttccttgtctctgataatctctgttctaataggcatttttaaaaaattccacatataagtgagatcatgcagtatttttctttctacgtctggcttatttcacttaccataatgtcctccagattcatccatgttgttgcaaatggcactatatcctttttcaaggctgactcatactactatgtgtgtgtgtgtgtgtgtgtgtgtatgtgtctgtctgtatatatgtctatgcgtatatatatgtacacatatggacacatacacataccacaatttatccattgatagatagttacgttgtttccatatcttggctgttatgaataatgctgcaacaaacatgggggtgcagatatctctttaacatactggattcatcttctttgaatatataccaagcaggagattcctggtagttctaatttgaatttttggaggaaccttcaaactgttgtccttaatggctataccaatttacatttccaccatcagtgtacggggttcccttttctccacattctcaccagcgtttgttgtctcttgtctttttgataatagtcattctaacagttgtgagataatatttcattttggttttgtttgcatttccctaatggttagtgatatggaacatcttttcatgtatctgttggccatttttatgtcttctttggagaaatttctatttaggttctttgccccttttaaaatcaattaatcttagtacattattattattttgctattgaattgtgtgagttccttatacatgttgtatattaaccccttatcagatatgtggtttgcaaatttttcttccagtctgtaggctgtgttttttgttgatggtttccttttctgtacaggagcttttagtttgatgtagttctacttgtttattttttgcttttgttcctcaagcttttggtgtgataattcaaaatatcagactaggatgaacatcaaggagctttttctctgtgctttcttctaggagttttatggtttcagatcttatgtttaggtcttttatctcttttgagtttgatttttgtgtatggtgtaaaggtccaatttcattgttttcacatggatattcagttttcccagcaccatttattaaagagacaattctttcgttattgcatcttctcggtagccttgagaaaaattaattgaacatgtatgcttgggttatttctgggctctctatagtattccttttgtctgtgtatctggctttatgccagtaccatactattttggttactataactttataatgtaatttaaaattaggaagtgtgatacatctaactttgttttactttctcaagattattttggttattccatgcgaattttagaattttttttctctatttctgtgaaaaaatgccattggaattttgatggaattgcattgaatccatatattgctatgggtagtatggacattttaacaatgttaattcttccaattcatgaacgtgggatatcttgctatttaattatgtcatcttcaatttctttaatcagtgtgttatagttttcagagctttcacttctttagctatatttatttataggcattttattctttttgctctcctagcaatggtatagtagcggggggctgggaagaggggtggtggctgggaaagtgggagcacataaataagattgttttcttgatttctttttaagctaggtcattatttttgtgaagaaatgcatctgatttttgtatggtgattttgtaaggtgtatgctactttactgaatttatttgttcatttaacttttttgtggcgttttaagggttctttttctttaaatgtaggataatgtcatctgcaaacaggaataattttattgtcctctctcaagtgaaatgattttttaatattgcctgcctttttttaaaaatcatgattcatttttctgttaccaaagctgtatgtgcttactgtagaaaacttagaaattatagaaacgtgaaaggaaaaactgttaaacttaccacaaagatgcaggtaatccatttgttttattttatttagtgtttattcaacataaactttttctccagtctgattataggacttgtttaattttatattctaccttttttcacttaatgctgtaacaaatcattttttatatcatttcaaactcatcattaatatattctaaatgactgcattatgttatggctatgacagacatattaggatttcttaataattcttaccctgtcaaatactgggtttgtttctagtattttcctgttacattgtaataaacatctttgtgaatatatacttagatgctcagtaaacctttatgcattatgaatgaattagagaagccttcttaggatttagggttattcctcaagaggatgattactaggtgaaagggtataaaccaaaataaaacaaaacatcttatttagtttgataaatggctttctgaaatcattttggggaatatacacagaaacgcaaacgttgcattcagaagatttcttagcttctagagaaagatataacactatttcaaaaataggttctttaataactaggtaattaattactttggattttaggaggccagtaaaaagcccagatatttttgtaatattatagcgccccctcttttaaacttttgtattactttagtgcacaaattaaacaagcttttgttatgtgtattttgttttattatagaacatgtagaaggaatctgatcaaatactcaagcagttagagaaaatagaaataactcttatgtgttagataattgccaagatactttgaaaacaaagcctgcttctttggaatcaaatttatttaaatatttttaaggctttgtgactctggtttcctgattctttgttttgtatcctttttcattgtgatcaatttctcaatgaaattatccttcaaggttttacgttttctaaataacagcaatacagaaatgttttccctcaatttaatgtgtgtttttggtttttttttttttttttggttttgtggtcaacatgactttttaaaagacaatattatgtagtcaggtatattgatacaaatcatatgtatataatttctgcataacgcaatgcaaacttcctccatatatgtgggtgtgtgtgtaagattttttcatatttcaggctgtcaagtggaaagtctacatttatccataataagattttataagctaacaaaaatactgtttcagatgctacttacctttgaagagtgaaaatacacaatattaatacaccattagaggttagtatttatgtggagaaaatgataatagagacttggaggagaaaatctctgttaaaaatactccaaacattttaggcaatttagaattaaaatattgttttactaaaattcttttaaaaattttgtgggattccatagtaaagaaacaaatactgtcttcacttgtcttttctagcttctgaatcgtgtagtctctgaaacccagaggcagttgataaatacagaatttttaaaacagaatatgtttagaagtacctttaaatttcattagataccttttcatgtattagaaatgacagtaatgtaaatgaataatataaatattttgacataaaagtattaacaatgaattagacatctggacaagtaaaatgctcaattcaataaagtaaatatgcactaactttttaaacatcttgaattcagttccagaaatagtttttaagcatttactacatgtgagttactaggcaaggtattcgtgatataggcaggttttattttctgtcatggagcttatgggctagcaggaaatacatatgttaagccagtaaatataagtttgatgactagtacaaaggaggaagtacatggaaaccaatagcaaggaattagaaactgtgacaggcagagaagttttcagatggaggaaaaagcacctgaaagacgacaggtttattttttgagcatttcaaatatggaggtacctgagatatccaggtggagattgtcaggtttgtagtctgagacatgggagcaaattgtaaactagaaattgaggtttggaaatcattgagtttataatttcagtcatgagaatggaagagatcacttagaggatatattagaactaacatttaaatgacaagtagaattgaaggagcttatgacagtgattgggaaggaacagccaaataccaaaggaagagagcatttcttaggggtgaatcatgtcacatgttgctactaagtaaagttagagggaagcagggtcagagagagaagataataattctcacagccatgaagtaggtgctagtattttcctattaactagatgaagaaacccagactcagtggttaagtatctttctctaaattggatactagaaagtgatggtgctataatttgaacccaggtctgtctgactccatagtctgagcttataatcactacatagtgttaaaaaatgaatttagtgacatggagatcattggtgatcagtttgtgggacaggagaaggaaatatttcaagatggagggcagtattggatgctatttgagaggtcagaaaagagaagaatggacatgtgactgttggattttgtaaaatggacttctctgataacctagacaattatgatttcaataacaattgagaggagaagaaagaaacctaattgggataaactgacgaaagaatatgaggtgagagtggaagtagtgatacaggtaactttcggaaataggacagtttatgtaggggaatgtggattcagtaaatggagatactagaggaggtttgtatgcagatgccacagatccattgggggagaaaatgatgcagaatggagagggatatattaatacatttcttgagaaagtgagatgtgagattcagagcacaaacggaaaggtaggattcaatcagagtgggaacatttcacttgtcttcatagagaagagtatgggtcaggtgagtggttttgatggtggaaagagaaagttgcaatgatctgattgcttctgttttctcaatgctgctgtcatgaggttgggagaatggggcggttctagtaggtttgagaacagaggacaaagtgtgaaatggttattttggatattggacaattgaacaaactgggtattttagggtatttttactattactacacagtgctgattgcccaattgtgatttgtgatcacgactttgagaggagaactgttggcaggttgtgtagttttcttcatctatttttaattgctcaggtgcacatgtggagtaggtggataattgggtttaatcatgcttttatctttgccgggtgttgtcagtggagggtgaaaaggacaaagggtttgtctgtgtctatgaaagagtaaattttagtaactgaccctggagtctaaattgggccaggtggaaagtgaggatattgtgtatgtgtgttcggggcagggtggtaagtgatgagagggagaaactatctagaaatatgctggaacctagccatactctctgatgtggttaggctttgtgtctgcacccagatctcatcttgaattgcaatcctcacaatccccacaatccccacgtgtcaagggagagaccaggtggaggtagttgaatcatgagggtggttcccccatgctgttctcctgatagtgagtgagttctcacgagatgtgattgttttataaggggctcttacccctttgctcagcacttctccttcctgccaacttaagaagaaggtgtcttgcttcctcttcgccttctgccatgattgtaagtttcttgaggccttcccagccatgctgaactaaactgtgagtcaattaaacctctttcttttataaattaccctttcttgggcagttcttaatagcagtatgaaaatgcagtaatacagctttcctagaggtttatagaggagcctcaaatagatgcattattttccaggatcactcagtgacttttaatttgagtcttgagatgtctgtggcttgacctggtgtacagtttatctgttaagacaaagaagtggatacatgtaaaacttgaaagctggtcttttgcgaacctttaccctgcatcaccttggaaacaagtggtctaattatatgaagatttattctgtatcctaggagttcccaatgtgtgtccagtggctactcgttgatctcttgcttccttggttgataatatacccagcatctgctggagatagtagagtattaatttcataatgagcccattaccccagtgatactatatccagaaatcaattaaaatgtgagaattttgtatgttgtttgaattatattagcttttgaacatcagtggtgatttttggaattgtttttctgaatctggtattcttattttgagggtattattgtaaattttacttcaagacagagtaaagatgtctagattaagttttcttatgagtaatttgcattattggatactgaatccagtcccaattattttggcaataaaaggagttgacaaacacttctttcctggcatagtttaaataagattttaagcatgtttacggtgttagttactatgtgaatacttaaatatgtctttaatggattgtggggattttagtcttttcagattttttctttcctttatatgagaattatttagaggaagttaaacttatatgaagaggaagaatacttgtaactatatatttctcagaagaaattattgggcacttttggctgttttgatggtattgggagaagggaagattattctattaagttttcatataaaatctctttatttttgtttttcaaagtttctcagctgtccttaatacttatgatccaaagctgcaacctttcagaaatgccatgtccatattttaaaaaactaaaatgctttaaggatttaatcagatcctcgagtcttatatcacaggacttatttggaaatgtggccatcccgagatagctaatgatgatgagtctggtttgggtgttttctttttgcatatttagcatcaacccagcaccatcggttctgtgtttttggtgtgtatctggatgatgtatttgagaatctgctgaagacagctgttcggttagtgcacaaggaacagtcaattttagttactttatcatatgctggagattgatattcataaagcagtgggaatataccgtaactagggtcattgatgaacaaagggatagaaatggggttgatgaagcagtattattctttatctcacgaattatcctaacctttgctaccagcacaaagaagagacagataggattaatataatcgaatttttacaaactcattttaacttgcttgtttcgtaaatgtttgattcctaagtataatcaatgaatagcaaattatacagtattttaaaaaatatatcatattttaagcttttaaaaattggttgactatctgaaattgacataaattttgcttatagtcagtaactgctattatgacatcagtgaaactgtatgttgtgattgttgcggctggttaaccaaaacatgtatttcacaaatgacatgtaatgggtgaagatgaaatgtaatggaaaatgaatgtgtagaaagaaattcttgtttatttcatgtttaaagaaccttgattttgtcttttaaaaaattattttatactttttaaaaattacacaagtaatttacattgaggaaaaataaaaaaatgtaagaaaataaaattcacctagaatcctacctagaggtaatcactttgagtgacgtatttaattggcatatatctttccaagtctgtccattgtaaactagttgtctttccccataaagcattatattgtaaacaacatcttttattgtcagtacatgagcttctactcagcaacatcattttaaatgactacataggattctgttgtttgtatgttccatttcttatttctttttttggtaaatataatttatttattcaaatagtccttcagcagtacatttgcctttaaagccatatttaaaatactatatactaacatgttgactaaagtgatcaagaagattttagaaattctattcatgtaaattctgttggaattctagtaattgctaaaatattagatttttattgctgagagacttcctttttcagggattaacatgtttagacatatagtttagaatgtcttttaaaactatatgtgtgtttgttaattcatgaggtttctaaaccatgagattttgctccttccctttcttcctctctttctctttccccctcttggcttcttctttatgatagagtagatacgaagtttctttcagacataaagaagttctaccctatccattataaaggggtaattttacccatatttaatgtgctgctacctccttggtgagagcagtaccataaatatcccaggataacacctttgttgttgtcaacagtaaaatgaccagaattgtctaggtacaacttcatttatggaatcagcaaaggctggtggaattttctagccgaaagggatcttaagtggatttgtcaatggattcttttttttttcttttctgacaatggattcttaatatgacaccaaaagcatgagcaatcaaagagaaaagataaattgaacttcattaaaattgaaaacttttgtgtatcaaagaacattgtcaagaaattgaaaggacaacctgaagaatgggagaacacattttaaaattacatatattatgggatttgtatttgtttttttgtattttattattattatactttaagttttaagttttagggtacatgtgcacaatgcgcaggttagttacatatgtatacatgtgccatgctgatgtgttgcacccaataactcatcatgtagcattaggtatatctcctaaagctatccctcccccctccccccaccccacagcagtccccagagtgtgatattccccttcctgtgtccatgtgttctcattgttcaattcccacctatgacatagtgagaatatgcggtgtttggttttttgttcttgcgatagtttactgagaatgatgatatccaatttcatccatgtccctacaaaggacatgaactcatcattttttatggctgcgtagtattccatggtatatatgtgacacattttcttaatccagtctatcattgttggacatttgggttggttctaagtctttgctattgtgaatagtgccgcaataaacatacgtgtgtgtgtgtctttatagtagcatgatttatagtcctttgggtatataccgagtagtgggatggctgggtcaaatggtatttctagttctagatccctgaggaatcgccacacagacttccacaatggttgaactagtttacagtcccaccaacagtgtaaaagtgttcctatttctccacatgctctccagcacctgttgtttcctgactttttaatgattgccattctaaccggtgtgagatggtatctcattgtggttttgatttgcatttgtctgatggccagtgatggtgagcattttttcatgtgtgttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtcgttgcccatgcctatgtcctgaatggtattgcctaggttttcttctaaggtttttatggttttaggtctaacgtttaagtctttaatccatcttgaattaatttttgtataaggtgtaaggaagggatccattttcagctttctacatatggctagccagtttccccagcaccatttattaaatagggaatactttccccatttcttgtttttgtcaggtttgtcaaagatcagatagttgtagctatgcagtgttacttctgagggctctgttctgttccattgatctatatctctgttttggtaccagtaccatgctgttttggttactgtagccttgtagtatagtttgaagtcaggtagtgtgatgcctccagcttttttctttttgcttaggattgacttggcaatgcgggctcttttttggttccatatgaactttaaagtagttttttccaattctgtgaagaaagtcactggtagcttgatggggatggcattgaatgtataaattaccttgggaagtatggctattttcatgatattgattcttcctacccatgagcatggaatgttcttccatttgtttgtatcctcttttatttcgttgagcagtggtttgtagttctccttgaagaggtccttcacatcccttgtaagttgcattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacagtggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgctagtgttcaaagtgaaagcttccagtttttgcccattcaggtatgatattggctgtgggtttgtcatagatagctcttattattttgaaatacgtcccatcaatacctaatttattgagagtttttggcatgaagcgttgttgaattttgtcaaaggccttttctgcatctattgagataatcatgtggtttttgtttttgcttctgtttatatgctggattacatttattgatttgcgtatattgaaccagccttgcatcccagggatgaagcccacttgttcatggtggataagctttttgatgtgctgctggatttggtttgccagtattttattgaggatttttgcatcaatgttcatcaagcatattggtctaaaattctcttttttggttgtgtctctgcccagctttggtatcaggatgatgctggcctcataaaatgagttagggaggattccctctttttctattgattggaatagtttcagaaggagtggtaccagttcctcctcgtacctctggtagaattcggctgtgaatccatctggtcctggactctttggttggtaagctattgattattgccacaatttcagagcctgttattggtctattcagagagtcaacttcttcctggtttaatcttgggagtgtatatgtgtcgaggaatttatccatttcttttacattttctagtttatttgcatagaggtgttcgtagtattctctgatggtactttgtatttctgtgggatcggtggtgatatcccctttatcatttttgttgtgtctatttgattcttctctcttttcttctttattagtcttgctaatggtctatcaattttgttgatcctttcaaaaaaccagttcctggattcattaattttttgaagggttttttgtgtctgtatttccttcagttctgctctgattttagttatttcttgccttctgctagctttggaatatgtttgctcttgcttttctagttgttttaattgtgatgttagggtgtcagtttttgatctttcctgctttctcttgtgggtatttagtgctataaatttccctctacacactgctttgaatgtgtcccagagattctggtatgttgtgtctttgttctcattggttcaaaagaacatctttatttctgccttcattttgttatgtacccagtagtcattcaggagcaagttgttcagtttccatgtagttgagtggttttgagtgagtttcttaatcctgagttctagtttgattgcactgtggtctgagagacagtttgttataatttgtgttcttttacatttgctgaggagagctttacttaaatgaatatagaagaagaataccacttccttaattactaatattctattgtaggctacttgaactctctccctgtgggattttttttcacagtgacctttcagagagtatgagctgtgaaagaagaaatccacagggatagtatggcagtgtgccaactgtaaatgtagataaaaaatctggctactatatcatcatcctcaattttaatactttgtatttacttagtagctttcagctataggactcaaaagtctacaaatagcctcaaaacaccccattgaggcaagcatagagtaatcattattttttgttaaaagaggaagtgaatggtgttatttaattgtcagttttagaataagagaataaaacatcttttaaaaatatgctgctagttacagcatggtctttttttaaaatgagaaaccagaagtttttctccttcatgttaagggatggtccaattttcatccccattttcctttggttatttttgccacttttttactgattgtaattatgtgttgacctcatttgattctaaagtataagaaaatatgagaattataagcataaactttaagtagtttcattgacctattttaatttgtgaaatctttttttgctataaacagatgagtacaataatttataggtagctttgtgagtgggtattttgtttccagctatacagaagttgcataatagctacccactcaggtattttagattggcatggtagtaactgtttaataataagactgctactacataatagcatatttgtgcatcttttcgacactacacatgaatgacctttatgaataaaatagtgctacctaattctatatattttggctatatgtttcctaaaagtgataatctttggagatggacagatcttacataggttaagatacaggataagtttaaaaatacaaattaaaatggagtctaattaatagtcgttcctgaaaaaatataagcctttcccatgaggacattttctgtcaagaggtaagtgtgggtcaggctcatttggaggctgagggggcatctgatttcttcataatattatataaaatttgtgagtggctaagctacctcattgtttcttctgtggataagggcctgctgccttgaattctagtcagcctggatgggtggggctgatctaagctgagggtcttgatagctgcagagcacacagtaatcatcatacctgataacaccatattgaaatgatcaagacaataatgataatagatagcatttattgaccaattaatatgtgccaggtattgttctgtgggcttttatgtttttttctcattggagctttgcaattaataagcagtgagttacttcttttattggcccagagggctgaaaataatttgcagcttaataaagtagctactttgcttctatagtgattggtttgccacctgttttaagtgtgggccatggcttctctaataaaccctattctttatcttgctcttaaacattttgttttgatagccatgaaaccctcctcagggtaggtgatttatttccatttgccaaatgtgaagagtgagagaatgaccttgataaagggttgggttgagaattgttcctgtttttttcctggtggggctttacgggtgatggagcacttagaatactagagaattagagaatttaggggcataaaatagaatccatactggattttattagagcttagccactcaaccacaataaaagtaggcaagaggtcagctgagatactgattgacttcatatgcccttggaacagacaggcagtgtctgaggggacctgagttcccagccacccagcctcaagctgcgttattacttaactgctttgtagagtgtaaacattatcattttctgtcagtgccagaatgtgagttaggcttgggaagcataatttcactcagaaatggaaagaagaagaaatgttattttgttacttttatttttaaactagttctctctcctattgtttaattgatgatgagatatataaatattcatattggatttaaaacttgaaatttgtactgggtagtttattgttagtgatgtcaaaagttatagcataaaagttacttgcataaaagtgtaaacatttcctgagcaatgcaatatgtggccaccagtcagttgtgttagttgacaaagggcaaacatgacctgttttctgagagtgctgttcacctgggttcttttcattttcagtactccttttggagaagtttggtttactagtagtttcaggtaatctttggagctctgatataaaaattctttcagatagtttaggtaagacttatacattaagtgatttatatggcaagttggcccaaagtcgtatacataggccacctttattcatcacacagttttccttaatcctcatctctgccagccttgaccacagaacttacttttctttttctttttctttttgcacatacattttaaagtgagtgatagcccttcatttttttttttttaatatacagtgggacctcgtttagggagggatggaatttagggtctcactttagtgcaaaaggtaataatctcagagacaaggctgttcttgagagggagcgggagtgctttgggaaagtaccacattggatcccagtataacatttctaaataagtccatgatagctatgctatttttctttagcagttttgttggaactgttgctgtttctttagttaagcactcagaatacatttatgtatcttttaacattggtatcatctttagcacacatgagatcctggaaacatatgagaccttggcatacattgactgagtaaacagcagattcaccttttccatctcacagtcactctagggcttacactttttcaggggaattgtggacttaattgtctgcattatttagttattctatttctggttgcagagtttatagttgaattaatacaagtgaatcatagttaaattcacataaatatgaagtttctattaactgatgacttgggttgtttgtgcattgtccttatgttttatttatatatgccatcagaatcttcagattctcatttctttgaatttaaaaacgctactattttcattaagaaagtctcctgtctgtttccattttctactgattttagcatcagaggctgttaggggagataaaagattcttaaatatatattctatatttgttagataaatgtatttttgtaaaaattttgtagataaacagacatcctgtgtattctggtaagaaaaagagaggatagtatagatgattgctgctaatttttaaattgacaaagtgaggaatgtgactatattggtttaatgagtgcctaatttgaagaattctaacatagttgttttttcccctccatatgtgttgattgtgattctattgctttcagccaaattattttaattagatttagattcaggaatgactgcctcccacagtttctactcttgtaggctttacttacactgctttaaacaataggggtttacctttatattaggagcattaattatctattaattttcctcatttagaaccattaaatttaatatatcacatttattaatataagagaaaattatagaagtcaattatcttaacaaattgaggtcctacaatttttgagaagtgttaagtttattatatttaaaaaagtctagctgaggattactatttgtggtttcttttttcttcatgttaataataatgtagagagtgcttagactttgttactaaatagctgtgtgccctgagaccaaaacatttcacctccctggccttcctgcatttatgtacaaaataaagggttaagctgtcctactatccagttccaaaataactctgtattatatttttgacaaataatagagaataaggtgaaggaccagtggtggcactggtatgtagtaaaaacagtacagggtttgttatcacactgtcttgacacttaggaagttgctagaggatgtcaagcagattacttaactgattgaggctcaaattctgatctgaaaattggaacaatagtaggtgcctcacaaggtttttctggaaattaaatatgacagcaaatataaaagcatctattacagtacagtttcattcattgatatcttcatttccttgaagaggtctttccagattggggctggagaattaaaatgctcaggttcttacaacaccattatttgagctggaaaatatgccctttaagcaacattttcgttctacttcatatctatagaaagttgggggcctgaaggccttttgaattttgaatactttccatctcttttagtctaggtggtatcactttggccagtacaactcttagaatttttgtaggcattctttaatctaattccataaccccctcaagttagaagaagttctttataattcttttagagacattaacaaagggttttgtagttactcttctgctttgatctgtcccagactatattgtatttggagactattttgccagcttatacactggagatgagaagagttgtattttccaaccctgcacagtccttgccccctttattttttctaaattctccttgtaactgatcagttgtttgtttagctcatctctttgttgccatattgccttatggtgtacagttaggaacaaccagttgattttcagttttctgcctagagatctcaggcaaatccaaatgtttattaagtaaatatttcatcctctgagttttatagggaacacaattttgccgattttttgttgctacatatcagaagttcctattttttcagccaccaataacaattttttaatgaatttctagtttttcctaatagattgctcactgtttttcaagctgaaggccactgtttaactccaaaaccaatactacatattttatttttatttttttaaattgtggcaggaccttacctttggtaacatcagttagctattgctaataacataccatttcaaaatgtagtggtttaaaacaataaccatttattattgttcacaagtctgtaggtgggcaaggcagttggctggctgggcttggctgatccaaggctgacttgctcatgtttcagcagtttgccgggtctagtttgggatgattttaatcagtgggatgagtggactttatgtcggttatcatttagcaggttaccctgggctgttcacttggttcagagacagcagaaaagatgtaggataggtctttggagatctggtacagaacaggcacaccgttattttcatcatattctgttggccaaaggaatttgaaagaataggccagatttaaggaatagggaagtagattctaattgttgatggaacatgctgcaaagtcacacttcaaaggttatgtttatagtgagaggtgaagaattggagtcatttttgcaatttaccaaaatatatgtgtttaattttaaagtagttgtacagtttatactcccaccagcagtgtatataagttgtgattgttctacatcatgtccagaactgctagtaacagtctttttagttttagctattttggtgggtgtctagtggtattttattgtggttttaatagtctcaattgctaagatggctttcctttactttttttttttttttagtcaaccatttgaatatctacttttgtgaaagggaaggggaggtgtgcctccaaagtctgtgttaccttttgggctgccatttcttctagatcctggcctgtaaatcatgacttgttaactctccaaggccttcaagcagatgcctgcctgcctgcagattccttcctccctccctcccttcccctccctcccttcccctccctccctcctctccctccgtctcccctctctccgtctcccctctctccgtctcccctctctccgtctcccctctctccgtctcccctctctccgtctcccctctctccgtctcccctctctccgtctcccctctcctcccctctctccctctcccctctctccctctcccctctctccctctcccctctctccctctcccctctctccctctcccctctctccctctcccctctctccctctcccctctctccctctcccctctctccctctcccctctctccctctcccctctctccctctcccctctctccctctcccctctctccctctcctctctccccctcccccccctttctccctcaggctgaagtgcaatggcgtgatcatagctaacggcagccttgatctcttaggttcaagcgatcctctggcttaagcctctcaaagtgctgggattataggaatgggccgccatgcttggacagcaaaacttttaaaattttcattttaaattatgttttcttaagtgtttttacttaatccttagtgtgaaagtctcctattactgaaagactaattcattcctgtctttgtagttttgactttcattaatctaatggatttgaggatccacatctaaaactttaagaattaatgtacattatgtaatgtcatttgccttgcaaacagttgtttttttttttccccccctgaggtcagactaatttattgacagttttgttgtgcttgacaagtaacaggtgctaacatctttttcagtcttgtcacagggactagagggtctaggtcaccatgttcattaatgtagtccaggaaattttatttctcctgtggctaatcatttacatttgacatgaatctgtcatctgtgcctctagtctctctgcttccacctttgtcttctatagtgtgttgttctcataatagtcatacttttaaaatataattcagattatttctttgctctgtatattttacaggctttccttataactcaaagtgaaacccaaaggcctgtaagaacccacatgatctaaactcatgctgcctatttgatttcacctcttaccttgtttcccagcccctccactctgttatgaccatagaagttgccttgtttttcctgacactccaaaatgctcttgcctcatggcatttgcacttttcatttcctcctctagaatgcttcttccctagatatacacatggattgctgtttcccttctgttaggtctctactcaagtatcattggagagaggcctttcctgaacatacattgcaaatacttgcagtgtccctcctgtcactctttatccaagttctgagctaggtgctgagcagataaaaaggatattaaggttcctgctctggacaaagtcagtgatgtgagagaaaaaggcttgtatgcagtgcagttaattgggaaatgtgttaagcccctaaagtggtgccccaaacactagatgcttgtacatgataatgaactgtggaggtttattccaagtacaggctgagtgcagagatgcatggggttgatattgtctagatccatagagaagactccacagaggaaaacatctttgaattaggccttaaaaagtaagtgaaaaaaggaatgcatggtctgggtaaaaggaagagtatacacaatgactaaatttattaagattgaaacttaaatgtattgcctggaaaaatgcttaattctcctccctagtggcttaaaaaaatagttagaaaacatgtcatttacaatatgaatagattgttccaataacattgtattatgacttttcaggatggaatagttatggaccaggaattggaggcagtaaattacctaatgtgatgttgatatgcgagacacttataaatggtagtgaattatagaggtccatttcaagtgcagtgggatagcaaacaagaggttgttttctgcccatttgcctcctttactagacccttgaacctattttctgcctaaagagtaaatgaaactagaaatagagatatgggagagactgtaatgagtatttagatatacgtgttacagaattgttacaacttttgctgcaggttactgttttgaggacaaactatgagtttttaaaaaatataaatttactctgaaaatttagctcaaattcatttgttaatgaatttgttcctgcatttggcaatgagctaaatccattgtattctgaccttctcatagtaacttagcatcctaatatcaggtgctgtattaaaatgtgaagaagacaagatgctctttttaattaaatgtgattgataaagctagaaagacaggaatgcaactgaagttggatgagtctcttaggtacaaggtaatagatttatactctttaacagctggtttgattgcatcagatctaaagattttatttgaagaaaaagcctaaggaagaactgctatctgtgaaagtacaaagtaatgcctgtattgaaaatgaacaatctgctgatactagaaacttctttatttttaaagcctgtataattttcttggtcatcagaaccttggcatataaaaatttcagaaatctcatggctttaattaaggcaacatgcattctctgtaatgaaagtaggaagaggatgtaggagaatgtttcaggttctgttttctgcctctctgttacgggaagcagtgtgattcagtacaattgttctcccttgccagttggtgaacctgtgctattctgtgttgaaaatattggtatgaggcttttttccccagaaggcttttttcttaatttcaggtatttttttcatgttaatatcatttttaaaaaaataatactgatggtaaatagtagggctttgaaaaaatatctcatttcttgggaaataaaatatttatgggcccatgaagcctgccggttggttggtttgtttttggtatatgtgtatgtgcatgtgtatctgtgtatcgtactgatctgtgaaatctaaatgtctgaaaactactgattatgtagaaggatcatgggctttggattcagcaaacctggtttaaattctttctctgctttgttcttatcttcgtcatctttaaaatggggatgtgaatgcttatctcctagggtggttgtgagaattgactaagataatggatatataatggtttagtgccggctgtataatagaagctgaataaatgtatttcttcctttttcttataagttgttggggatagagagaatttcaggtgaagttacaagtgcagttgacccttgaacaataccgggtctaggggtaccagcccctgtgcagtgacaaatcagcatatgacttttgactccccgagacctttattactagttgcctactgttacccagaagccttaccaataacagtcaacacatattttatatattatatgcattatgtactatattttagcaatagagtaagttagagaaaagaaaatgttattaagaaaatcataaggaagagaaaatatattatttcttcataaagtgaaagtagaagcagatcttcataaagatcttcatcctcatcatcttcatgttgaataggaggaagaagagaaagggttgctcttgccatctcaggggtggcagagggagaatagacggaggaggtggaaggagaggcaggtgcacttcatataacttttatggaaaaaataaactcacgtataaatggacccctgcagtgcacacctatgttctgtgggcttttaaatcatcttctgaaaatatgctgctagttacagcatggtcttttttaaaatgagaaaccagaagtttttctccctcatgttaatgatggtccaattttcatcccatttaaattggttattttcgccactttttgactgattgtaatatatgttgacctcatttgattttaaagtacaagaaaatatgaaaattataagcatgccccttaagtagattcattgacctatttaaatttgtgaaatcttttttgctataaatagataagtacaataatttatagatagctttatgagtgtgggtattttgtttccagttatacagaagttgcataatagctacccactcaggtattttggattggcatggtaatgactgtttaataagactgcagtacaagaaaatatgaaaattacaagcatgcaccttaagtagtttcattgacctatttaaatttatgaaatcttttttgctataaacagatgagtacaataatttatagatagctttgtgagtgtgggtattttgtttccagttacacagaagttgcataatagctgcccactcaggtattttagattggcatggcagtgactgtttaataagactgctactacatagtagcacatatagataagtgatatatctatatatgtacataaatagattttctctttttatcatttatcattctctataactgagcttaccaatttagaaataatttggttgaaaacgttaaattgtagaaaacactataattagcaacaaaggtgtgtacttttctatccagagggacagtttgtatactgtttggtcaattttgtgagattaagttgagaaacctaagtgttttagagacatagtggtaaatgtctccatcagtgttgggttatcgcacagaacaccttctagggtctacttcagagtagtagttttggaactattttagatacaacacctttttaaaaaattatcagatattcagagccctaatatgtatctgacaaaaatggagcaactcttgttgggtgaatgggagtgaaggagccaggcattgttaagaatttgtcctgcttatactcctctctcagtttctagaaacctctctgccacctgtggggctccttaccacttctttagaggttcagataagaagagtcttgacttaaagactaagctaaaggaaatactaattattttaccagagtgagtaatttttagataattcagcattagatatatacaaataacttttaatatcaaaagatagaatgtatttcttagtgtctagtagctggatcttagatttttaaaagcatctttgtaattaaaaaaagtattggcgttttcttcttgaaaatgtcttataatttaaaaaaagataaaccagggccaggcatggtagctcactcctgtacttccagcactttgggaggccgaggcaggtggatcacccgaggtcaggagttggagactagcctggccaacatggtgaaaccccacctctacttaaaaaaaaaaaaaaaaaaaagccaggcttggtggcggatgcctgtaatcccagctactcaggaggctgaggcagggaatcacttgcacccgggaagtagaggtttcggtgagccaagattgcaccatcgcgctccagcctgggcaacaatagcaacactctgtctccaaaaaaataaaaataaaataaaataaaccaaaaactcaacacaaggaaactatcttgatgattttgtgaatagtttatagtatatagggttaattttatggtatggcattattgaattagtcagagattattcttttattataaagcactaagttatgtcttcttaaaccactttttgtttagaatactttctatgcttttgagtaaagatgaaattatatgtcttttttaattttttaaattgaatgatgttcaagggaaaagctacccagtttccatttgtgtgaaatttatgtatatttttggttttgtcttgtatatgagtaaataaacgtagtttctaccctttttctaccctttcccattgaagttacaggtttatctacaaaggggtgatggaaatactttgtgtaactattttccttagtcaatataacactctgaggccaggcctggtggctcacgtctgtaatcccagcattttgggaagctaaggagggcggatcacctgacgtcaggagttctggactagctctgcaaacatggtaaaaccctgcctctactaagaatacaaaagaaaattagctgggtatggtggcgcacgcctataatcccagctacccaggaggctgaggcaggagaactgcttgaacccaggaggaggagtttgcagtgagccgagattgggccactgcactccagcctgggcaacacagtgaaactcggtctcaaaaaaaataaaaataaaataaaaaaccactctggattaatttctattttgtatttctggttaatttttcccctacctccaaataagtgggggtaattgacagttgttcacacaaaggttaggtaattctataattaatttttcattggtttagagaagtcttctcagtgagcatgcctttgttgtcaaatgttcatgccattactgctaatgaaataaaaatgttaagcaagaacagtaactgtctattttagtaactgtctattttcagttactttttaaaaccctaattataaaagccaacttgtagtttacaaatgaccacatgtatctttatttcaaggaaattctggattacttcatgtatttactcataataatatctgaaatagtaaaaagagtgtggatctgggtatcaccacttaactaagagttagttgcaaaattttgggggaaaaatttataatgttcttaggggggttgtgttgcacagctcaaatatgatattttatgtactgccacttaataagctataatgtgcccttggcaaggaggatgaagaggaggtatagcctgagccctggaatttgtctgaagtccttgcagactaaagtacccatgaagacttggatttacacagaatgaatcatggccaagacatgaaaagtcagtgataaagtcagtattgatctcagtctgtagcttacagcttttctaattttttaaacttatttaagtaaagtgtatatccctctcaagtttctgacatatccttatgctgttgaggcctgaagagaatctctgagactaagatgagaattgtcattgagcaatgaaaaggaattaaaatgagaaaagtctgaattatctggttccattgatgagggagtgcctatggtgaaaagcatacctcaggctatttaaaatatccccttaatcgagttctcctggctttcatgctttgcttgaaacacagctctgataatgcatatttttggtaattgtatttaaggagtatttttggtaattgtaatttcttattacaaattaatagccactcacatacatcttatgtacttggtgtattagtctgctagggctgccaaaacaaaatatcacagggtgggtagtttgaaaaacagacatttatttctcacagttctggaagaaagtttaaaatcaaggtcttggcaaatttggtttctggtgagggctgtctttctagcttgtagatgcctgtctgccttgtcttcacatgatctttcctaagggtgtgtgtgtgtgtgggtgtatctgtgtgtgtgtttgtgcgcacacacacgcgtgtgcacagggctggtagagagtgagctctctggtgtctcttattgtttctttttcttttttcttaccttgttattttctaatctagtcttcagagagatggtgtctcttcttataaaggcactcatcctaacagatcagtgctgtacccttgtgacctaatttaaccttaaatacttccttagaggccccatctccaaatgcaactacactgctgtttagggctataacatgaattttggggtatacaagaattcagttaataatacttgattaccctttatctgcccctgagagggtggttcatcttacccttttttagtcaaatcacatttggtaacatgaattgaggtgggtcagctatggtggcagactcactaagagtgtcatcctcaactatcctgtattgcttgtggcatacctagacattctatggccgaaagagcttgcatgtttaaatatttctatagttttagtccttggcacatggacttgagtccatttctctgtcaaatggcgatagttgttcctcagagttgttactggtcataatttaagggaaaatatattttgaaccataagatgcaaagattgttttttataaaaatgtacaatgttcctttttctattatttgtagagcttaaggacttgaatccagatcttctaattacaagtataagactctaagtagccagacatacccatttttttcaggataattggaattctccatagacaagcactctaggggaagttctggcaagttttatttgcaccatgtaatgcattgaaataaattgtaccatctaataaattgaaatgctgtgcgtttagccctcaagctctgttaagggacagactgcctcctcaagtgggtccccggcccccgtgcctcctgatggggtgacacctcccagcaggggttgacaggcatctcatacaggagagctccagctgacatctggcgggtgctcctctgagacgaaacttccagaggaaggaacaggcagcaatctttgctgttttgcagcctcctctggtgatacccaggcaaacagggtctggagtggacctccagcaaactccagcagacttgcagcagaggggcctgactgttagaaagaaaactaacaaacagagaaaggaatagaatcaacatcaacaaaacggacatccacacaaaaaccccatccgaaggtcaccaacatcaaagaccaaaggtagataaatccatgaagatgaggaaaaaaaccaatgcagaaaggctgaaaattccctaaaccagaatgcccattctcctccaaaggatcacagttcctcaccagcaagggaacataactggttggagaatgagtttgacgaattgacagaagtgggcttcagaaaatgggttataacaaacttctccgagctaaaggagcatgttctaatccaatgcagggaagctaagaaccttgaaaaaaggttgcaggaattgctaattaaaataaccagtttagagaagaacataaatgagctgatggagctgaaaaacacagcacaagaacttcatgcagcctacacaagtgtcaatagctgaatcaagcagaagtaaggatatcagattgaatatcaacttaatgaagtaaagcatgaaggcaagaatagagaaaaaagaatgaaaaggaatgaacaaagcctccaggaaatatgggactatgtgaaaagaccaaacctgtgtttgattggtgtacctgaaagtgatggggagaatggaaccaagttggaaaacactcttcaggatgttatccagaaggacttccccaacctagcaagacaggacaacattcaaattcaggaaatacagagaacaccacaaagatactcctcgagaagagcaaccccaagacacataatcatcagattcaccaaggtggacatgacggaaaaaatgttaagggcagccagagagacaggtcagggaagcccatcagactaacagcggatctctcggcagaaaccctacaagccagaagagagtgggggccaatattcaacactcttaaagaaaagaattttcaacccagaatttcctatccaacctagctaaattccataagtgaaggagaaataaaatcctttacagacaaccagatactaagggattttgttaccaccagggctgccttacaagagctcctgaaggaaacactaaatatggaaaggaaaaactggtaccagccactgcaaaaacatacaaaattgtaaagaccatcgacactatgaagaaactgcatcaactaacaggcaaaataaccagctactgtcataataacaggatcaaattcacatgaaacaataattaaacttaaatgtaaatggactaaatgccccaattaaaagacacacactggtaaattggatagagtcaagacccattggtgtgctgtattcaggagacccatctcgtgtgcaaagacacacataggctcaaaacaaatggatggaggaatatttacaaagaaaatggaaagcaaaaaaaaaaaaaaaagggattgcagtcctagtgtcagataaaacagactttaaagcaacaaagatcaaaaaagacaaagaagggcattacataatgataaagggatcagtgcaacaagaagagctaactttcttaaatatatatgcacgcaatacaggagcacccagattcataaagcaagttcttagagacctatgaagagacttagactcacacacaataatagtgggagactttaacaccacactttcgatattagatcaatgggacaaaaaattaataaggatacttaggacttgaactcagcgctggaccaagcagacctaatagacatctacagaactctccaccccaatcaacagagtatatattcttctcagcactgcatcccgcacttattctaaaattgaccacataattggaagtaaaacagtcctcagcaaatgcaaaagaatggaaatcataacagactctcagaccacagtgcaatcaaattagaactcaagattaagaaactcactcaaaaccacacaaatacatggaaactgaacaacctgctgctgaatgactactgggtaaataacgaaatgaaggcagaaataaaaagttctttgaaaccaatgagaacaaagacacaatgtaccagaatctctgggacacagctaaagcagtgtgtagagggaaatttatagcactaactgcccacaggagaaagcgggaaagatctaaaattgacaccttaccatcacagttaaaagaaccagagaagcaggagcaaacaaattcaaaagctagcagaagacaagaaataactaagatcagagtagaacgaaaggagatagagacatgaaaaaccaattcaaaaaataaattcattcaaaaaaaaatcaatgaatccaggagctgtttttctgaaaagaattaacaaaatagacctctagccacactaataaagaagaaaagagagaagaattaaatagacacaataaaaaatgataaaggggatatcaccactgatcccacagaaatacaaactaccatcagagaatactataaacacctctatacaaataaactagaaaatctggaagaaatggatacattcctgtacacatacacctcccaagactaaaccaggaataagatgaatctctgaatagaccaataacaagttctgaaattgagtcaataattaatgggctaccaaccaaaaaaaagcccaggaccacacagattcatagctgaattctaccagagatacaaagaggagtttccttcggaaactattctgaacaatagaaaaagagggactcctccctaattcatttaagaggccagcattatcctgataccaaaacctggcagagacacaacaaaaaaagaaaatgtcaggccaacatccctgatgaacattgatgtgaaaatcccaataaaatactggcaaactgaatccagcagcatatcaaatagcttatccaccatgatcaagtcagcttcatccctgggatgcaaggctggttcaacatatgcaaatgaataaacgtgatccattgcgtaaacagaaccaatgacaaaaaccacattattatctcaatagatgtagaaaaggccttcgataaaattcagcacctcttcatgctaaaaacactcaataaactaggtactgatgggacgtatctcaaaataataagagctatttatgacatacccacagccaatatcatactgaatgggcaaaagctggaagtattttctttgaaaaccggcagaagacagcgatgccctctctcaccacccctattcatcatagtatgggaagccctggccagggcaatcagggaagagaaaaaaataaagggtattcaaataggaagagaggaagtaaaattgtctctttttgcagatgacatgattgtatatttagaaaccacattgtctcagcccaaaatctccttaagctgataagcaacttcagcaaagtctcaggatacaaaatcagtgtgcacaaatcacaagcattcctatacaccaataatagacaaactgagagccaaatcatgagcaaactcccattcacaattgctacagagagaacaaaatatctagaaatacaacttacaagggatgtgaaagacctcttcaaggggaactgcaaacaacttctcaaggaaatgagaggacagaaacaaatgaaaaacattctatgctcatgcataggaagaatcaatatcgtgaaaatgaaaatactgcccaaagtaatttgtagattcagtgccatccccatcaagctaccattgaacttcttcacagaattagaggaaactactttaaatttcatgtggaaccaaaaaagaacccgtatagccaagacaatcctaagcaaaaagaacaaagctggaggcatcacactacctaacttaaaactatactacaaggctacagtaaccaaaacagcatggtactggtaccaaaacagatatatataccagtggaacagaacagaggcctcagaaataatgccacacatctacaaccatctgatctttgacaaacctgacaaaaacaaggaatggggaaagggtattctatttaataaattatgttaggaaaactggctagccatgtgcagaaaactgaaactggaccccttccttacaccttatataaaaattaactcaagatggattaaagacttaaacataagacctaaaaccataaaaaccctaggaaaaaatcttggcaatgccattcaagacataggcatgggccaagatttcatggctaaaacaccaaaagcaatggcaacaaaggccaaaattgacaaatgggatctaattaaactaaagagcttctgcacagcaaaagaaactatcatcagagtgaaaagactagctacagaatgagaaaaattttgcaatctgtccatctgagaaaggtctaatatccagaatctacaaataacttaaataaatttacatgaagaaaactgcatcaaaaaatgggcaaaggataggaacagacacttcttaaaagaagacatttatgcagccagcagacatacgaaaaaaagctcatcatcagtggtcattagagaaatgcaaatcaacatcacaatgagataccatctcacgccagttggaatggcgatcattaaaaagtcaggaaacaccagatgctggagagggtgtggagaaatagaaatgcttttacactgttggtgggagtgtaaattagttcaaccattgtggaagacagtgtggcgattcctcagggatctagaaccagaaataccatttgatacagcaatccccttactgggtatatacccagatgattataaatcattctactataaagacacatgcacgtgtatgtttattgcagcacaatttacaatagcaaagacttggaaccaacccaaatgcccatcaatgatatactggataaagaaaatgtggcacatatacaccatggaatactattcagccataaaaaagggtgagtttatgtcctttgcagcatcatggatgaagctggaaaccatcattctgagcaaagtaacacaggaacagaaaaccaaagactgcatgctctcactcataagggggagttgaacagtgagaacacatggacacagggaggggaacatcacacactggggcctgtcacgggtgtggggctaggggagggataacattaggagaaatacctaatgtagatgacgggttgatggtgcaacaaaccaccatggcacgtgtatacctatgtaacaaatctgcatgttctgcacatgtatcctagaacttaaattataataaaaaaatctgtccgttgttttgtgaattatcatatttaaactcagtttctggtggttgatgtccaaaataagattttgcttagtggtatgtccagagcttacagaagaataaccaaaggctggaaaaatatatctttcagcccagcaactttattatagtacatatggtaaactgtgtagaatgttaaggaaacatcccatattggcttaccagctgctatttttatggcaagattttatttaatatgtaaggctggagggaggtgtgagaggaaagtaaagaaaagctttggattattaaaggtgtgggaaagctatttacactgcttcagggataaataggagggaaggagtactcagacagagggagcgagtgattatatgaagaaaaatactatgatgatactaattgtgttttgtaggaatatggatgctgcctctttgtctctaaatgtgctaccctgaattacaagttacctttggctttttgattctacaaaatcataggagctccctgaaatctggagcatttgctcagactattgctttctgttatctaccctaggtcggaaatatttaagtgttttttcttcagtcctacagagttttagtctgatactttagaaaacagaactgagttcctattcgaaaagatttactcacagtgttttgtgttataaagtcatactccagggtatcttttagagcaacagccctgaaccaggctaagaggcatggagaagagcagcacagggcttctgaatcctggctgtgcatagatgtgggttaaaattaaaatattactaacctttcctcatctgagatagtaagattttggagcttgaattcttcatgctttttaattacaaaaaatacgatgaaatttcagtgttcttgcaaaaatttgactaatacaagaattgacaatatgagaggatgtctttaataattttatgtaacacaatcagatctttaacttttgctcatgtaaagtttataaaatttaaactgcttaaaataatggcagtattagaatactgagattcataataatgtaaattaacacatataacccttttttctgtttgtatattatcttttaatatataatgaaaatgtttaggtagtaaatactaaggttaaggtaaagtcatataatcttaattcatctaacagctgcctgttgtttcatatttattccatttttgaagtagtttacaaatgaaaaaaattgtatgaatgccttggcattaaacagcagttcttggaaatcaggaaattcctaagttatacttcctctagcagtgatatatcagcgttatttctatgagtttagttatattcaattttccagttatatatacacctttaaagtgttatataagccaatttaagcaagttagtattagagtagaagtgtaaactttggaatttcctgatttttaacattttactttctatgttattttggtgaactggatcatgcaacttaatttatacagttagtatgaatatacttacaaagagctagattttattttcagccatcacattatgaatagctttttttaaaaaagactatttcatcctctataatgaagtacttagtgtttgccattcacttttggtagcttttaatttttacctcttcagctatgatctgaagtcattccaaaagttatggtctgttctatgtcttcagtagagagttatagtttcataaattatccacctgctctagatgcgttgtagagatacaaatagaattgcacatactaactgcagaagccaaagcattgggtatcaccttccttgttaatccattttttttccaactgtttttgggtttttgttttgttttgttttgtttttgtttttttttttttggaacaaggacagtcataatatagtaatatgaattcattccttaattctttattcaacaaacatctattgaaaatatgccatgtgccatatacttccaggtattgaagatacagcagtaaccaaagcaaagtccttctctcttagagcattcattctaataagtggaaaaagaacatagattgaataagtgtatactctatcaggttgtgattaacactatgaagaaaaattaagtaggatatggagatggagagcaataacggtactattttagggaaggcttttcttcctgataatacctaactggatacctgaaaaagatgtgcatgtcttaaggaaaaacaatccagtaagtaagaacaccaattgcaaaggccctgagatggaagtgtgcttgctaaattcccagaaggaggccagtgtggcaggagtagagtatgtgggaagagaggttcagatgataaggtgagagtaataatgggtatgggaggacatggaattctgtattgccttataggacttggtaaagactttgaattttcctcaaaatggaggatgttgagcagaaacatacatgttctgaattatagtctacaaggatcactatagctactgcacagaaaacagattgcaagggagcaatgatataactgatggataatcaattagtagaataaccattcagtcacgagatggtagtggtttagaccagaatgatgatggtggaggtagtgaaaggggaattccaaaatactttgaagggaatatggtaggatttgttggttagatacaaagtgtgagataaagtgagtcattaaagataaccccaaaatttacctggataacttgtgtctctcttacttgcctatagttgtctttacagaaatcctttcctaaccatgttggatcttctctaggtagtagccactcttactcaatttttaatcaaagctaacagttgtccttgaagtctattaatgtgtcctattttaacttctctataaagaaatggtcagtttctaaatgtttaccaaagtttgaaactcctttaagcaatttaaaacataagattaacttttcgtttttttaaataattgtaccttatggcagatataatatagcttgctgactaagagatgtggagaaccagtttgctggggaacagagctctttgtgatctttcataactatttcctttacttcctgaatgtctttctaaatgccacattcagagtggacttttctcaccaccacatttaaaacactcccgcattactttctatctccttaccttgttttatttgtctcagttgtatttaatatatgatatatatatttgttttttatttttgtgtctgtatcacctcactaaaatacaaatttcttaagggcagtggctttaaaaaaaaattgctgcagctcagtgggctaggtagttagtaacttactataaatgaattgaatgaatagatggttttaagtagatgtccttatgtcacataatgggtgtttattaaatggcagcatgaaaagaataatgggtatccttgtacattaccggtggcaatgaatgtaaaattgtatagccactctggaaaacaatatggcagttcataaaaaattatacatagaattaccatatgacctagcattgctacttctgagtgtatattcaaaagaatagcaaggactcagatatttatccacccatgtttgtagcagcagaattcacaatagccaaaaggtggaggcaacccaagtatttatttggcagatgcatggataagcaaaatatggtatatatatgcaacgggatattattcggtcataaaaaggaatgaaattctgccatacgttgcaacatggatgaaacttgaagacattcagctaagtaaaataagccagtcacaaaaggacaaatgtggtatgattttattttatgaggtacatagagcggtcaaattcatagagacagaaagtagaatggtagttgctagaggccagggggaatgaggagtagggagttattgtttaatgggtacagagcttcagttaaagaagatgaaaaagtctggagatggatggtggtgatggttgcacaacaatatgaatgtacttgttgccacagaactgtactcaaaatggttaatttggcaaattttatgttatgtatattttaccacaatttagaaaaaaaaatgttctgagcttgaatgtcacattcaccttgttggctttttggacttattcactgtttgtttatttgttgagatagattgtctttgtctcccaggctggagtgcagtggcacgatcttggttctctgcaacctccacctacaagattcaagcaattctcatgcctcagcctcctgagtagctgagattacaggcatgtgccaccacgcctagctgattgtttttctatttttagtagagacagcgtttgccaggctgactaggctggactggaattcctggcatcaagtgatccactctcgtcggcctcccaaagtgttgggattacaggtgtgagccaccgtgctcagcctggacttattcactgttctgctttaggcttttacaaatagaatctaaaacatttaacctaacatctgagatgtgggtttaccactgttattccaagtcctttaattttgtatgtcttcattttaaagtccctaagttcatgttattaatggttattttcctatatgttttactttctcatgtatataaaattcatattttaaagtcttaaattctgttttctgatgttgagggtcctataaggttgtactcttaatgggtggcttactttcattttctcatttaattattatttttaaaaaatttcctagttattgattctcatgttatttcttatgattgttgtcagtatctccctaaatctaataaggagacagaaaccacaaagtaattttaaacaggggaagtttaatataaagaattagaaagctatgatacgtgagtaactataaaagtgtaaagagaactgtaacaaacatactaggcctgaaggaggagagtatttaaggaaaagaacaacttggaagagggtccttccccaaagttagagttcagaccttgttagagaaggtacaatctgctaaggccagagttggtctgtagttgctgggcaagcaggaaacaatcttttgggggtgcagtcaagctgaggctcctggatgggcttgcaaaggtagtcacagtgccactgataggtagcatgttctagatcacgtactattgtgttggaagagcctcagagtggtgattaagacagggatccagtggacaaagtgtcttaatggagatgggaaacttgggaggggttgattgtattgggtggaccagaaataagctgggacatttggaatgggttttgagaaaggaaagaaagagacagctttctctctcatcttcatatgtttaaaatacatgtaaatgtaaatgctctttgcattaatatcttttcatcttcattgcttcaactgaagcttttattatctccatcctaagggactgcattattctcctaatttatcttcctgccttcagaatcttcctcttccaacctagtgtcatttttctaaaacaaagttctgatatgatactttcctgcttaaaatgtctaagtgaccccccccaccccactgcagaataatgtgactttgtaggatcagatctctgcctactctgttagtttcttttcatcccactttcccatagtcatcctaggaactttctgtattcaatttttcaaagattttcaagcatcattttcttctcctttgcatattttgtcccttctcttctcccttacctttgcgtctggaaaaatctatcaatcctttaaaacttatatgctaccttgtttgcccaaacctttctcagtactaagtggccatttcactttgaacatgctttcatttgtatatgtatctctcatcccacttcatactgagttttgtttccttattcatatttttccttttggaatttacacagcacatagtgggtgcttaataaacgtttattatctgaacaaataaacctgcatacttggctttaatattcttttactcagataatatgagcatgtaccttaacttaaaaagatagggttcagaatggtacacactatacttgagagttatttgggctcttttgtgttttctgcctgtaaaagaaataaatacttcattttcctaatgtttaggtatttagctgtatgatagataaagcaagttagagataaggaaagtaaggtgaaaatgagccaactgcttaaatgaatgatggagttgagatagaaaccacttcattttggattgtcttcttttattctcattagtattataagattgcttagataagtatttatttattgagcctctactatgtaacaaacattgtgttagacctgtgattctaggttctttcccacttcttaagattctgcgattaattagtaagattaaagccttaaacaaaacttactttataaaattgttctaaagtatatgattacattacatatttggagttattataaagttactatcaaattaacggataataaagtacaataaaatccctgaaggcaccaaaaatgtatcttgggtatgcaaatgtaaatgtgtaaatatttataattttaaaaatgtgtgcataactataataacggggatgatgccccctatttgagttcctgtccctaaaaacattcactattctaattcctaagaagcacttaatattatagcatcaggagatatatcatctcaggccaagtttactttctagcctagatgggccttttgcagttagttgactctgcttttcttagcagcattaaggaaagttggtttataataaggttttagcacaaaagttaatgccctgatttattctcagaagtggttagctgtagttgatgcagatggccactagaatgtattcatataaacatcttccattccaaaatgttaagaaaatataacattgtataccttaattattcaattacattagatacatgttatttaataatatacctgaaccagaggcttagggatttcagacgctctgtgttaaaggaatacaaaataagcttgttttaaaatgtaatacatcatgcttctgtccccatgtttacctatgtaattttatgattccataggtaaaatagctgaaagagaaccattatgttatcaaacactgtgtcatgcttgctgagtttgcaaaaatgtaaaacgtacaatgtgtaacttttatcttcaggaagtttataacctaataaataagattcaatacacataaaacctttaatgtacgattaagtgataaagtattaagactataagtgttgtgggagttaaataattttaaaacagattttaggaataatctaatatctcattttattgacgaggaaacaaaagtctggactagctgtttaactcaaaaatctgcccagagttacactactggataatgtcagaaccagactaagaacgcaggtttcctgactttggcctggtactctttccattcgtaaatacccacgagcctgtgtggaatgggcttgattcaaagcatgtagaagaaatgagacattgaaggttatgggtaggtggtggggagaagagctgttccacaatggaaggaacaagaaggaagcttaaaagacctggcacagagcataaggaatggcctaatgagagtagaaggtatacaataggaattaatttcagttagtaacctgggcctggattgaagcagtccttgcaaaccaggtagtttttatgggataggcaccagaatgcttttatagatttcttgagcaggatgacttgataaaaattatatcagttttatcaactggaaggtcagtgtgatggtaaccatgaaagattgaagtaatattgaggcaggaaaaggtagtagtagtaggaatgaagtagaaaactcaaatctacaagacatttcttgggggaaaatgattggacgagatggcagttttctatagaaaataaaggtaagaagagtgtagcaagcagaatgctatttccatggacagaaataaaataacttggaaggagggctgggatgaattgaggttttttgttgttactcttgatattaaaaagattattactcagtattaaagcttactgtaaaatataggattttaggtttttgagagctttccatatctttggacagtcaatactgaaatttttgaatttagggttaattgattatatctgttgtatacacttagagacgcttgggttacctctgtacattttcagttatatgtataaaacatttttgaatggaataatacgtacattcaggtttatagaaaccttgatggatatgatttaatacaaattagcaatagtatatctaaatttgtaattgtcactgatccattgcttaggatatattttaaaatatgttcactaaattctgttttcagttaagttattcatttatcttttgtttaggtcctaggccactgaaatggagtacaagagaagtgggtattttttctaatttgatttttttcctgtattagtgttgggataatggatttgtatttcatacataattttaagtgcctcatatttttaataatagttgcctagacaatacaatttattgtgaaattttctattagcagttcattctaaatgtttaagaaattatacgtttttctctttttgtgaccttcaatcttaaaagtttatttgaaaaacgaatttagtgaaaccaaaattaaaaaaaaataaactccctaactaaaaaaatatattcttaaaactatttttataaaatcaatttttttgacttgggatcatttagggggatcgcatatattgtagtatatcagctattgacgacattttaattcttatcattttaatgagttttttgttgtaatttttaggagaaaatgatgaaatgcttatttaaaaagtctttattaggctcatgtctctcatcccagcactttgggaggctgaggcgggcagattgcctgagcttagtagttcgagaccagcctggacaacatggtgaaaccctgtttctacaaaaattacctgggcatgatgacacacacctgtagttccagctacttggtgggctaaggtgggaggatcacttgagcctgggaggttgaagctgcagtgagctgagattgtgccactgtacttcagcctgggcgacagagtgagaccctgtctccaaaaattataaaataaaaaagtctttattattattgctgtactttcattttaattagaaatctgtttctgtagtgtacttctctgttggattacattgagatctctggaagtagtatgtgaatgtatggtcagttgataatatgtgaattctaaatgctgaaatttatgcttttggggtgtttgtttatcagtgttcttattattgaccaagattatgctttatatcttctatcttctgaagttgtgtgaaatagtgatacaatacaaattaaagctgagctggtgttttacatctagtatgaaagaaattagcagaaatcagagcagtttaaacctatctacattattgctactgagttttgagtcatagatttttttaaaaagtatgaaacatggttaatcataaaaatccacataaagaaggaaataataataggaagtctgttttgtcgaattctagaaatatttttagagaactattattttgaaatgtgcaggatgcttctggtccaaggaccatactttgagaatcattgttataaatcatggtggaaccgtttgacctaatcaaaattaaaatgagaaggaaggttttttaatttaagaaagttatctttaacttctggcaacatgatcttgcttatcacagtagtaggatattataaaattggccaacatctcagcatttctttaaacttgctactatattcatttattcagtaaatatttactaaacatctaatatgtgccaggcatatttcgagctggagataaagagtaggatagacatagctcctgcccccatggagtttatattctcttaggggacatatatatgaacaaaaacaggtaaacagacaaattatgtagttgccagttgaaatatgtcatgtgaaggacaagaacaaggagatgattgatactattagcaaactattttaggtgtagtgatctctgaggagatgacattgaaattgagacccacagaagagaaacaactaggtctgttaagaggagggaggcgcattattcaagcagacaattgaatgtatacaggctttgaggcaacaacaacaacaaaaagtttctttactctaagaactgatagtagtttagctctaggctactatttaatattaagattatggatggaaggcagggagggaggtgaaagagaaagaggagagaaattaagaacaataggtttccgatttatgtaaattaattaatggtagtattgtttactgaaatggggaagaggtgtggggggtgggtgtcagtgagctcagctgttttgagagagtttgagcaaaaaaaaagtcagttgaggtgattaaaaattgatacattaaagtgagaaatcaaagaagaaactttgttgctgagacatttagactatttctcagatattaataaaatttagagaacaaaacagtattctagagaaacactaaggttattaattaagaggaaagcaatctatttggggaggtttaagggaatgttgacatatacaaatactaaaaaattagaaagccaagtaaaaagggattaaaattctatctccaagtggaaaaaatcaggttgtccagaaaataataaatacatgattgatatggtttggctgtgtctcctcacccaaaatctcatctttaattgtaatccccataatcctcaagggcaggaccaagtagatgtaattggatcatgggggcagtttcccccatgctgtccttatgatagtgagtctcaagagatctgatggttttttaagcatgtggcatttcccctgcttgcactcactccatcctgccaccctgtgaagaaggtgcctgcttctcctttgccttctgccatgattgtaagtttcctgaggcctctccagcaatgcagaaatgtgagtcagtgaaaccgcttttctttgcaaattacccagtcttcggtatttcttcatagcaatgtgagaacagactaatataatgatcataaagagattgttggtgagagaggccattgactcaccagagaacctagaaataaattaccatgggcatataatatctaacattatattgagttagtcaaaatatgaaatgttaatatttataggggagactaaggatgatgccagaactgaaagaaaaatgtttctagaagacctaaaacctaaagaacttagcagactccttgagaaaaatgtaaatgcctgaagtagttttgaaaatctgggtttagctagctcatgccctagaatttcagtgactacatagactcattaaaatgaaattcaatcttgtttttattttaaacatatttttcaggtatccaagggactgttaggaggacttaaataacccatatccttatgaaagtgaattataggcctccttgaaattaataaaaatcttcaaagtagtatttaatttaaacttgtaactttctttgtgttctgagagagtgctgtttctttatattttaaagaaatagaccatttctgttttgttcaccaatatattcactgcacttagcacactgacacagagtaaccatttaataaatactttctgaatgaatgtataaatataaattttacatttagttttgggttacctggatagctgataattaatgaagcagttcctttgtggcccttaggaaatgtctctactgtgaccatattcaggtatatatggtggcaggctatacgtgaatagaattagtgcttattagaaatgaggtaggatgtttttgagattatatgtttccatgcactgcagagcatactggtgttattttaaacaaaatataaataacttttggattttgtgtggattttaattattttaatcagtcatccgttaagggttaataatccagttaactatgttgttctcaaattccaaatactaaattactgaggtcatgatgctttggggaacaaatactattaatgactagtgaaagaagttttatagatctcacattgtttctggaagaccaatagatgtatttattaccataataacacgtagaaaaaggacagacatttctatgtggttcttagttctgtctctctttttttttttaatccaggatgtcaatccttttgtgttcactccctaattatgtatttacattttctttatttttcttaactatatatctgacctttttttttttttctcaaggtcttgattaaaatcagctttactctacaataagttgaattgatttgggcttctttttctcatgatcctattatttagtgactgttttcttcaaatatttgtttccatgacttttgttacttctttatagacatatttttagtagttgcaatttcacctccaccccgcctttctgggttgataatattggttaacactgactcctagggtacagtctcatcaatgttggtgtagaaataagatataatgaacaccaaacctaaaaaagcagcgtcaacttttactccagcagcagtggagttgttatttaccaaaagaaaacagattcagcagagatctgttagaatgcctatgttatgccctattaatctaaaacagttccatgataattctctagggttgaactgtttttaatggtatgtatgagaaaacgttttatgggcttttagccagaagattttatatataaatggtagtagaggaacattgttaaattcatgaatcttggaggcaatgtaatataatcgattttggggcttttaaatcagctttgaatcctgaccccttcacttattaactttgtgactttaggcaagttacttgactcctctgggccttaacttcctattttgcaaaatgagaataatatgacttcctgacaagaattttgaaagaatagaaggcagttatacaaaatgtgtgataaaagttttggcacatacaggtttcttcccaaagatgaacaagtcctactgctaagtatagaaagggagatataagtacaagttcctcgttatttcttagagctttgcgcccatagatctttatattgtcttaacctatgtgatccacaatgacccaaactacaatgtatgtcttaagaaagcatagaatttttacttttttttcagtttgaacaaaaatggtcagttgtgctctgagtcctaggtgtcttctagatataaatatgtgggaaggacaaaggcaaggggcatttaacagaacctcaggtcctacttctagcagagcagctatacttttctgttttaccatttgtatttctgtgcaagatattgattgaacaaaggggtctgtgtattacaaaaaagcttgaaaaaacaaaagcagggtcaagcagtctatttcttggctttcctttttctccgatgccaccctgctttctccttggcgttttaaagtttgtgggaatgggtgggagttagggtggggaagtagggaggaattccattctgtcttattgcatggagttctctgagaacaaaacatagcaaaaggacaagggtcctatgtaaagagggcatttctggtggaaaaattccttgacctccttagctcttgcgttgaactctatcaacaaagagctatgttttgagccttgattacaaattttaaaactggtaaataacaaatacatcttgcctctgattgcttcctcctctgactacattgagatatctttattagacccttaatattttcattatcttcttatcttagactctaatcactttactctcatttcagtgtctgcaagttcttttcccattagtcttctctgtaccaaccagcaagaactctgaccctggatgaatgttacctgactttactgccatcaagcatttttggagaaaataacacattgggctaatggttacctatgatttcctgaggtctgggttcgaccccttttaatcatctgaggaatttttctttcctccatcttcattatctttctccctgtagactttttactgtcaacgtttaaacatgttcaaataaatccaagcatcgaatgaaggtaacaaattaatcaacttattggttcagctgcaactctgtttctcaccccgcagtcaaactttttaaacaaattgtttattttcattgtctttagcccattccaatacagcttctgctcccataaccccaaactgcttttgtaaatttgtttcatttccgcacttaacagctttcccattaccttctgatagtctcatatccctaacattatatttgcacaattctacctctcctttctagctctaagcacttttttcatttcatgaaatacagttaatattctccttctctgggtttttgcaggttctatcctttaactgggaaacactctctgccttcctcaactcctcccacctaactgttcagttatcagatgtgatcttctgaaggaggtttaccttgacctgaactggctgagttctcctacttcataccttctcttcacagcacttgtcacatttgtaataatgtatttgtcattctccctgtgccttttaatgttggcttctagagattagggatcccactggttataggactggagaggggagctcaagaaatatttgttgaagaaatgactgaataaattaacaactgtagcttttcccagttcagtgcatcagttgtgtccttggccttattggagtttctcttccttagcagcataatgaattttaagtggaggaaaaactattagtgattccactagagttattaagcactgtagcccgtaatgcatcataggcgcacaacatatatacttttccattattgtcctctcctttttgctttaaaaataactagaaatatgtaataatttcaaatactaggaagctgagtattttgtttcttatggcacttttaatcaaatcacattatttattgagtactactcagtgtatatcctaaagtaaaaaataataataaacaaatgaatcaagtttctaaaaatcaaaacaaaaaactttaaaaacagtatgggaatacatgtgttcaaaagagaccccagaaagtgttttcttcctgaatatattagacccttttcagctcctaatgctgtagaataaatgaagtgttatgaaacttataattaggaactatctgaaagccaaatgtttagctaaaatgtgtgataaattaatgaacatacaaatgaatagatagcagtggcagtgtatttgttttgtgaattttatttatatgcaaaataataattgtatatgcatttaaatataattgaatggtatacatatgtatagagattgctaccatatttgatggattggtaaatagtattagaggtaatttctgaagatattttagtgtaaagatattgatgtaaaaaaaaattcagcaacctatctatatatggctgtaacaaagaagagtgatttggactactgctacaaagtaggttaaatgatctctacattacttcatgcattaacattctctaaattacttcatatattaacatttacatgtaatatatttgtagtatattctaatttaaatatccaacggaaatttggaaatgaatatagtttgtgtttaactgagttgagaaagcatagtatggtaattaaattctttttttaaccaaacattattataaataaaattgctgaattccaagtatttatacttaaataactttatgttgtaaacagtgtttttttaaagtactttctttataccttacactttattttagttaagttatagccatgtgtcttgggtagaattctgagagaataataagggactttaccctgtaatcacagaagcagtttggtaatataggaaccaagtgacagcttttctttttcaagtatatagattcagatctggacaggaatctttaagggtgacctaaaacatcattacgtcagtttacaacagaaggtttactctgttagtttccagtaactataatggaaactaacctagatgaacattggtacctactttgcagttagtgactgattttatttgaccaattagtactcatgatggagaggaaaataacttgtctgtgacctgtcatgatcaactcctaagggacaagctttgattacctcttaggtttattgtttttgccttatcaagtccacttgacttaaagtatgttctacaggcggaatacactgggggtggcgggcatggaatttttttttgctagaattagagctaataagtttgatttagagtaatcagtttttgcctctgttctcccaacaattgtgtgatattaggaatatctttcttgtgtttctttttaatagtttttattttatttaaaaaaaatggaacacttcacaaatttgtgcaggggccatgctaatcttccctttgtctttccaattttagcatatatgctactgaagtaagtgagcacatggtttttctctttctttcttctttctttctttctttcttttcttctttttccttccttccttccttctttctttctctctctctcttttttttttttgacaaggtctggctctatcatcctccaggttggagtgcagtggcacgatcttggctcagcttccacctcccggctcaagcaatcctcccacctcagcctcccaagtagctgagactacaggtgcacaccaccacacttgactaatctttgtatttttttgtagagagggggtttctccatgttgcccaggctagtcgtgaacttgtgagttcaagcagttcacccaccttggccttccatagttctgggattataggcgtaagccactgcacccagcccatatgtttgttattaatgaaggttgtgctatcagacacataatatcactgtgaaaacaacatttgccacctaattccttaaacagtgttctacaagaataaaaaatttattgatggctcattgtatgttagggtttattctgagtgccttaggttccacttccctctgtggaagccaaagtggggcagatagttcctctcataactcctgtgacagctagagtttggggcatatgacctcctgtgacagctagagtttccatcaactagttggaaatcgctgcatgagacttcacatctaggaaaagtgatgcaaagacatagcaacagtttagaatttattcttctagtggtttccaactcccaggctcaagcagtcctcccacctcagcctctagtggctagagcagcatccagtgtctcataccagtggagatactggtaccagcagtggtggtggtgccacattctcagcagaggcttcctaggctgtcttttttccagcatgattttggttgcagttctggcttcctaaccttctttagtgccatcttgtttcccaagtctgtttcttcagcttcatcattttgtgtgccatccgaattgtttcctacttaacttaaccagaaatcacttccattctttgtgaccaagaactggactagtacaattctcttggaaaaattggccttaatccctagctgtttggcaatatcttattatgattaattttttatagccacagctgccagaaccctaaatttcagttaacactgtaaagagaatttaagaaagaggaaataagtttatttaagtcatgacatcagaagaaaacagtaatgaaaatctaatgaacagtactattttcaagaaattgttcatgtattttagcaaaatgaaaaccacttaaagcatattttcagttgttgctgtttattaatattatctttattatgaaaggaggtaatttgtactaggcatgtactcctgaccttctgaaaaacctcccttcatttttctttgaagaatctttccctttcctgctcttagagtagggctacctccaccaattcagaggtgatgtatgtgacctatgcctaagcaatcagcacgctttatctccttcaacacagtgattggttgagattggatgagtatatatcagggtacctccactgaaagatagctattgcagcttcaagcaccacagcctcacacatcacatggagctgagaagaccaaaatatcagaaagtaggactgagaggatggagggaaagaaactgagtcctgatggtgtattttgaggcctatatatatatatctagtagaaaatgttatgaaacttttataattaggaactgtttgaaagttaaatatgcagctaaaatatatgattaattaatgaatgtacagaggaacagatagcagtgacagtgtatgttgtggaattctacttacatacaaaataattgtatgtgcatttaaatgcaactaagtggtacacatatgtacagaaattgctaccatattttatagtttgataaatacccagctattttaaaaactatttctaatcctacagtttcagttccataacccattacactgcttttttgcctatgccagtttgggttagattttctgtcactggcaaccaagagttctctgtttctttggaatataaatgctaaatcatcttgagttgggattgtaaagtcttgctaccatgttttgaggaatacctcttatttatgttttagttacatataacttttgtacctaaaatattaacaaggaaagcaactaacaactttaagctgaaatactaatcctgaaagataagaatgaaaactcaaaccttaagttctataaaactttgagatagctacatgtttactttcagaataatttaaattggtagagtacaagttgggaaacaaacactttaagtgaatatttaagtcatgtaaaatatgtatttttaaaagtcaaattaaacatattaccaaatttgctggaactatatattttatttataataagcacttttctacattttacaccctgttgccttacataactttccacagttttgacattataacattgtgattttctgtcaaacatgaatgaaaatacgagtttatggatgatagactcatgctatttccagatttcagaggggtagaggaagcagcagaaaggccctggagctcgctggatcccctagcaggccattcctgcatgacaccacagggatccatcaggagggtggccagaggagcagggggcaaaactccacagagagaagtaaatctctagctgaactttgtaacaatttgaatggggtgagaagcctcctggccagaactcgggtgaggacacaaatctggagggcacactcaacaggtgggggaagaatgaagccctattcttttgcaactgggtggcggatagcctggggcaagttttcaagcctgtgtcacccaccacctggaaacagacttggggctcttgtggggctcggtgggagtgagactggccctttggtttgcataagagctgggtgacgcctgtgactgccagctttcccccacttccctgacaacctgcatgactcagcagaggcagccataatcctcctaggtacacagctctagtgacctgggaatctcaccccaacccccaacagcagccacagcaagacccacccaaggagagtctgagctcagacatacctagccctgcccccacttgatggtccttccctacccaccctagtagcggaagacagagtgcatataatcttgggagttctaagcccctgcccattgctggtccctctctgcactactacagctgatgctctctggaaagcaccacctcctggcaggaggccaaccagcactaaaatagagcattaaaccaccaaagctaagaaccctcatggagtccgttgcacaaccccccatcctcccaccccccactaactccactggaacaggtgctggtatctacggagaagagacacatagatggttcacatcacaggatgtgatattgtgcagacaacccccagtaccagcctggagccgggtagactcggtggctagacccagaagagagacagtaatcactgcacacagtaatcacaggaagccacgtccataggaaaatggagagagtactacatcaagggaacaccccatgggacaaaagaatctgaacaacagccttcagccctagaccttccctctgacagagcctacctaaatgagaaggaaccaaaaaaccaactctggtaatatgacaaaagaaggctctttaacaacccccccccccaaaaataacactagttcacaagcagtggatccaaaccaagaagaaatccctgatttacctgaaaaagagttcaggaggtgagttatttaggtaatcagggaggcaccagagaaaggtgaagcccaatgcaaggaaatccaaaaaacaatacaagaagtgaagggggaaatattcaaggaaatagatactttaaagaaaaaacaataaaaaattcaggaaactttggacaaacttatagaaatgtgaaatgctctggaaagtctcaacaatagaattgaacaattataagaaagaaattcagagctcaaagataaggtcttcaaattaatccaatccaacaaagacaaaaaagaataagaaaatatgaacaaagtttccaagaagtctgggattatgttaaacaacaaacctaagaataatcagtattactgaggaagaagagatttctacaagcttggaaaacatatttgatggaatcatccaggaaaacttcgccagccttgctaggaacctagacatccaaatacaagaagcacagagaacacttgggaaatttatcacaaagagatcatggcacactgactgtcatcaggttatccaaagttaagacgaaagaatcttaagagctgtgagacagaagcaccaggtaactaacttataaaggaaagcctattggattaacagcagatttctcagcagaaaccctataagctagaagggattagccttatcttcagcctcctcacacaaaacaattatcagccaagaattttgtatccagcgaagctaagcatcatatataaaggaaagatagtctttttcggaaaaacaaatgctgcgtgaattcaccattaccaagccaccactacaggaactgctaaaaggaggtctaaatcttgaaacaaatcctggaaacacattaaaacagaacctcttcaaagaataaatagcacaggacctataaaacaaaaatacaccttaaaaagcaaaaacaaagtacgcaggcaacaaagagccggatgaatgcagtggtacctcacatatcaatactgacattgaatgtaaatggcctaaatgttccacttaaaagatacagagtggcataatggataagaatttaccaacaaactatctgctgccttcaggagactcacctaacacctaacacataaggactcacataaactgaaagtaaaggggtggaaaaaggcatttcatgcaaatggacaccaaaagcaaatagggaaagctactcttatgtcagacaaaacaaactttaaagcaacagcagttaaaacaaagagggacattatgtaatggtaaaaggccttgtccaacaggaaaatgtcacaatcctaaacatatgcacctaacactggagctcccaaatatataaaacaattactaatagacctaagaaatgagatagacagcaacatgataatagtggaggacttcagtactccactgacggtactagacaggtcatcaagacaaagtcaacaaagaaacaatgaatttgtaccttggaacaaatggacttagcagatacatgcagaacattttatccaacaaccacagaatatgcattctattcaacagtgcatgcaactttttccaagatagaccatataattgaggccataaaatgagcctcaataaatttaagaaaactgaaatgatatcaagccactctctcagaccacagtggaataaaactggaaatcaactccaaaaggaaccttcaaaaccatgcaaatacatggaaattaaataacttgctcctgaatgagcattgggtcaaaaacaaaatcaagatggaaatttaaaaattctttgaactgaacaacaataatgacacaacctaccaaaacctctgggatacagcaaaggtagtgctaagaggaaagttcatagccctaaatgcctaaatccctaaaaagactgaaggagcacaaactgacattccaaggtcacacttcaaggaactagagaaacaagaacaaaccaaacccaaacccagcaaaagaaaggaaataaccaagatcagagcagaactaaatgaaatggaaacaaaaacaatgaaaaagataaatgaaacaaaaagctgattctttgaaaagataaaaaaattgatagaccattagcaagtttaaccaagaaaagaagggagaaaatccaaatgacctcactaagaaacaaaacaggagatattacaactgacactcctgaactacaaaagatcattcaaggctactgtgaacaactttatgcacataaactagaaaaccaagaagagatggataaattcctggaaagatgcaactctcttagctgcttacatcaggaagaattggattccttgaacagaccaataacaagcagtgagattgaaatggtaagttaaaaaattaccaacaagagaagtccaggaccagacagattcacagcagaattctaccagacattcaaagaattggtaccaatccttttgatactattccacaagataaagaaggagcccttcctaattaattatgtgaagctagcattaccctaataccaaaatcaggaaaggacataaccaaaaaaagaaaactacagaccaatacccttgatgaacatagatgctaaaatccttaacaaaatactagctaaccaaatccaacaacatatcaaaaagataatccactatgatcaagtgggtttcacaccagggatgcaggtatagcttaacatatacaagtcaataaatgtgattcaccacataaagagaattaaaaacaaaaatcacatgattatctcaatcgatgcagaaaaagcattcaacaaaatccagcattctttatgattaaaactctcaacaaaatcggcatacaagggacgtaccataatgtaataaaagccatcaatgacaaacccacagccaacataatactgaatgaggaaaagttgaaagcatttcctctgagaactggaacaagataaggatacctactctccctactcctcttcagtatagtactgggagtcctagccagagcagtcagacaagagaaagaaataaagagcatccaaattggtaaagagaaagactgtcagtgtttgacaatatgatcgtttaccttgaaaaccctaaggactcctccagaaagctcctagaactggtaaaagaattcagcaaagtttccggatacaagattaatgtacacaaatcagtagctgttctatacaccaacagcgaccaaacagagaatcaagtcaagaactcaaccccttttacaatagcaaaaaataaataagtaagatacgtaggaatataactaactgaggagtcaaagacctctacaagaaaaactacaaaagactactgaaagaaatcatagatgacccaaacaaatggaagcacatcccatgctcatgaatgggtagaatcagtattgtttaatattactcaaatcagtaagaaaaaaacaatcccatcaaaaagtgggctaaagacatgaatagacaattctcaaaagaaaatataacaaatggccaacaaacatatgaaaaaatgctcagcatcactaatgaccagggaaatacaaatcaaaaccacaatgcaataccaccttactcctgcaagaacagccataatcagaaaatcaataaacagaagatgttggcatggatgcagtgatcaggaaacacgtctacactgctggtgggaatgtaaactagtacagccattatggaagacagtgtggagatttcttaaggaactaaaagcagaactaccatttgatccagcaatcccactactgggtatctacccagaggaaaagaagtcattatttgaaaaagacacttgcaaacacgcatgtttataacagcacaattcacaaatacaaagtcatggaaccaacccaaataaatgcccatcaaccaacgagtggagactattattctaagtgaagtaactcaagaatggaaaaccgaccattgtgcgttctcactgttttgtgggagctaagctatgaggacacagaggcattagaatgatacagtggacttcgaggacttggggtgaagagagggagggggtgagggataaaagactacaaatatggtgcagtgtatactgcttgggtgatgggtgcaccaaaatctcacaaatctccactaaagaacttactcatgtaaccgaataccacctgtaccccagtaacttatggaaaaataaatatgttaaaaaaaaaaagtaatagccaaatctgttaactctgtgattcctgctttggttaatgtagattattatcacatgatattaaagagtcaggattatggagttaatgttttactggtgcttttttttttaaaaaaagaaaaatgtttattatttaaggctgtgtgcagtatgtgcttatattcaaacatcccttatgctgttagtcacagaaatactaactatgtgtatatgaatggcttttcacagtctatataatgattggaaaaataactaatatagtatattctaaatgatgaatctttatcttcctatataaaggacatcatattactaattttcaaatttatcagtaagacactgaacaaagcctaaaaattaatggatattgttttaatgtgatgtatgatttactaaattaagcttaggagcatttctgtcgatgtattcctatctttcagtatgtgcttacatacaaataacaactttgtaagtattttctttttacagattttcagtaatttatatcagaagtatataatcaagaaactttagtgtttctgtccgttaaatatttaaaatattttattctaaagtaaacccttttggcattttttaatgtggggttgcctcatcaaattttgcatagcctacattacaatcatagaatcttgagttttggaagagactgtaaagttcatttcattcattcagcatccatttggtggtagtgtgctttgaagacttactaagaaattaacacctaggataacattttttactttgcaaaatgtcattgtattaatattttacgcaaacaatacatgaaattacagtactttttttctgtttcttgccaaattgtaagtagagttgaaaacagaattattttttggagatatgatcttgccctgttgcccaggctggaatgcagtggtgtgatcttggctcactgcaacctctacctcctgggctcaagtgattcacccacctcagcttcctgagtagctgggacttgagtgccaccaagcctggctaatttttattttattttattttttgtagagacaggttctcactatgttgcccaggctggtctcaaactgagcacaagtgatccatccccctcggcctccctacgttctgggattacaggtgtgagccaccgtgcctggccccagatttttattgtctttgaaacagaaaattcatgaaaggattctgccattttattcacctttctgacactgcagtaaagtgcagattaaagtatagttccctgtgaaatagccagttaccctttgagtagactccagttcacataaagaagtacagggagattacatgacttgcctaggttatatattgagtcagtaggagaagtagaaatactaagtgcagattcacagttcagtttagcccagaactatggatgctttccttatggttattacctggaaggctttacaatcactgatgtaccctccctgctgtctcctctcacttacacatatgcagtcttgattattttgataatttttctacatttatacacacttcacacataatttttgtttttttaaacctcagtttatagccttaagttatactcaggaatgtacattgtactcttaagcagaaagaccttaatattagttacagctgaagagtgagcttaatttctaagtacattttggtttttccctttttgtatgccttttataggtgttcacctttagcagccagtctcttgactttgcctaatactataaagaatagcaaacattgtattgacataattggttgttatggaagtcatttttaatagaatgaccataccttatttattaaaaaataataaactttatttttcagagcagtgttaggttcacagtaaaactgataggaaggtatagagatcccccgtatattcccttcccctatgcatgcatagcctatccaattatcagtatcccctattagagtgatatgtttgtcacaatagatgaacctatatgattatcactcaagaccctagttaatattagggttcacttttggtgtcatacatttcatggatttggacaagtgtataatgacagtacatccaccactgtagtatcatataccataatttctactacacggaaaatcctctacagtcctgttttacattttcagaagtgtcatatacctggaatcatacagtatgaagtcttctcaggttttcttctttcacttattagtatgcatttaaattctccatgtcttttcatgcatcgatagctcatttatttttagtactaaataatctcttgtctgaaggtaccacagtttatttattcatttacctactgaaagacatcttgattgctttccagttttgctaagtataaataaagctgctgtaccatccatgtgcaaatttttgtatgcacgtaagtcttcaactcctttggataaataccaaggaacatgtttggtggattgtatggtaacagcatgtttagttttgtgagaaattgccaaactgtctttcatggtggttgtatctttttgcatttccactaacaatgaaatgagggttcttgttgctccttatcctcaccatcatttggtggtgtcagtgttctagattttggccattttagtaagtgtgtagtagtttctcatttttgttttaatttggatttctctactgacatacggtgtggagcatctttttatatatttatttggcatctgtgtaacttctttgatgaggtttctgtttaggtttttggctcacttttaagctgtgttttcttattgttgagttttaagagttcttcatatattttggataacattcctttatatcagacatgtgatttgcagatattctctcccagtcatctttagcttgtctttttattctcttaacagtgtcttccccagtatagattttttgtttttaatttaatgaagtccagcttgtcacttctttcttttatggactgtagctttgatattgtatctaaaaagtctgtttgttcaaaatagtaatgatttggatctgttagatcaattaagaatgaaacaaagttattttaccattatgtattctttccctaatgctccctctttatgtagatctgagtttctgacctgtctcctttaacatcttttaaagaactttaaaaaacatttcttgtgaggcaggtccactagcctaaaattttcttgatttttatttgcctgagaagatatttatttctccttcagttttaaaataaacagggtctcgctatgttgcccaggttggtcttcaactcctgggctcaagcaatcctccagagtatctgggattacaggtatgtagcaccatgcctggctttcttcttcacttttaaagggtgatttcaaagggcacagaattttaggttgttgggttttttcctcaacactaaatattttactctactctttttgtattttcaatttttgtggatacatactaggtgtatatattaatggggtacttgtgatgttttgatacaggcatacaatgtgtaataatcacatcatgaagaatggggtatccatcccctcaagcatttatcccttgtgttacaaataaattatattattttagttattttaaaatgcacaattaaattattattaactgtggtctccttgtgccatcaaacagtaggtcttattcgttttttctactatatatacttttttgtacccatcactccaccctttttgcttgtactgtttctgaggaaaaattggatgtaattatctttgctcctctgtaagtaaggtgtttttttcaccactttggcatctttcaggatttgtctttatcttcgattttctgtaatttgaagatggtatccttaagtgtagtttctttggcatttatctcttttggtgctctgtgagcttcctggatctatggtttcgtatctgacattaatctgaggacatttttagtcactattgctttacatttttttcctgttcttttctctttcttcttctacaatttttatcacacatacgttataccttttgtagttgtgccacatttcctcctgggttttttgttttgttttgttttgtttttgtctttgcttttcagttttgaagttttctgttgagatattttcaagctcagaggttctttcctgagttttgtccattcaacggcattcttgatttctgttacagtggtttttttggtctctagcatttcttttggttatttcttagatctctcttcttgtacttcccatctgttattgctgtcttcttatcccttagagcccttagcatattaatcacagttgttttaaattcctgatcttatgattccaacatccctgccatagctgtgtttggttctgatgcttgttctgtcctcttcaaactctgtgtttttatgttgggagaagagaagtgttctgttgtcctatgattaggtatcacttttttagtaagcctgtgcctcttgactgtgaatttcacaagtgcttctcagtttttttatccttctccagttggacagatggctagagtgagctggagttgggtattttctttctcccacctggaaggctagtgccaactggagttggatattttccttcctgtaagtcagttaggctctgatagaactccaacaggttaagctctgtttaaatagtttcctctatgggcagaccttggtaagaagcacagagtgatccggcatattttaaaaatggcgtgtcctttcctttgctggaagcatgagtggatttttctccagtattcactgtgagaaccagatcaagtttctggaggttaaactcaacagaagtgaggagcctccttatggctgggtgcccctgcatttttcagtttttacagttgtccacactgactccagcaattaattgctgtttaagttttcttacactggcactagctcccatggaggtttctacttctgggtttctactccaataagttacaattctctgtatttacatctgtctctccaatctggggggcaatggtttaccctatgacttgacttctcttatggatccgagaagaatcgttgatttttcagtttgttgagatttgtatttgttgttaggatgaaatggtgacttccaagcttcttacatgccagaccagaaaccagaaatcccagcttaatgtcacagactgacatggactgcactgcagcattaaagagaataagaagttgtcgttgggtttcaagtctgtgaaacaaagtaaggtttttaatttatccaaagttacacaccctgcaagtgacacaggtgggaatagaatctaaatatttggactcccaattaaattatctttctttttattttattttattattattatactttaagttttagggtacatgtgcacaatgtgcaggttagttacatatgtatacatgtgccatgctggtgtgctgcacccattaactcgtcatctagcattaggtatatctcctaatgctatctctccccctccccccaccccacaacagtccccagagtgtgatgttccccttcctgtgtccatgtgttctcattgttcaattcccacctatgaatgagaacatgcagtgtttgtttttttgtcctcgcgatagtttactgagaatgatgatttccaatttcatccatgtccctacaaaggacatgaactcatcatttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttatagtcctttgggtatatacccagtaatggaatggctgggtcaaatggtatttctagttctagatccctgaggaatcgccacacagacttccacaatggttgaactagtttacagtcccaccaacagtgtaaaagtgttcctatttctccacatcctctccagcacctgttgtttcctgactttttaatgattgccattctaagtggtgtgagatggtatctcattgtggttttgatttgcatttgtctgatggccagtgatgatgagcattttttcatgtgtcttttggctgcatcagtgtcttcttttgagaagtgtctgttcatatcctttgcccactttttgatggggttgtttgtttttttcttgtaaatttgtttgagttcattgtagattctggatattagccctttgtcagatgagtaggttgcgaaaattttctcccattctgtaggtttcctgttcactccgatggtagtttcttttgctgtgcagaagctctttggtttaattaaatcccatttgtcaattttggcttttgttgccattgcttttggtgttttagacatgaaggccttgcccatgcctatgtcctgaatggtattgcctaggttttcttctagggtttttatggttttaggtctaacatttaagtcttgaatccatcttgaattgatttttgtataaggtgtaaggaagggatccagtttcagctttctacatatggctagccagttttcccagcaccatttattaaatagggaatcctttccctatgaatgaaatgaagcgagaaggaaagtttagagaaaaaagaataaaaagaaacgcagaaaacctccaagaaatatgggactatgtgaaaagaccaaatctacgtctgattagtgtacctgaaagtgacagggagaatggaaccaagttggaaaacactctgcaggatattgtccaggagaacttccccaatctagcaaggcaggccaacattcagattcaggaaatacagagaacgccacaaagatactccttgagaagagcaactccgagacacataattgtcacattcaccaaagttgcaatgaaggaaaaaatgttaagggcagccagagagaaaggtcgggttacccacaaagggaagcccatcagactaacagcggatctctcggcagaaactctacaagccagaagagagtgggggccaatattcaacattcttaaagaaaagaattttcaacccagaatttcatatccaaccaaactaagcttcatgagtgaaggagaaataaaatactttacagacaagcaaatgctgagagattttgtcaccaccaggcctgccctaaaagagctcctgaaggaagcactaaacatggaaaggcacaactggtaccagccacagcaaaatcatgccaaaatgtaaagaccatcgagactaggaagaaactgcatcaactaaggagcacaataaccagctaacatcataatgacaggatcaaattcacacataacaatattaactttaaatgtaaatggactaaatgctccaattaaaagacacaggctggcaaattggataaagagtcaagacccatcagtgtgctgtattcaggaaacccatctcacgtgcagagacacacataggctcaaaataaaaggatggaggaagatctcccaagcaaatggaaaacaaaaaaaggcaggggttgcatcctagtctctgataaaacagactttaaaccaacaaagatcaaaagagacaaagaaggccattacatcatggtaaagggatcaattcaacaagaagagctatctatcctaaatatatatgcacccaatacaggagcacccggattcataaagcaagtcctaagtgacctacaaggagacttagactcccacacaataataatggaagactttaaattatctttctatttcactaaattccacttttctgaaaggtgatatgaatggttcatatagggaaatattacagtgaggcttgttattgtttgtaataccatattcatttagatgttttctccatcctcctttttttttctttttttaccttctttataattttccttttagttctggttcctgatggtactgaatattaagaagattatctgccatttttgaggaggaaatatctaatagtataatctttttcctctatgttacaggcagaagtataactgcagcagcaatctgcctttcccctttatttgaatttacagaatatgttaaaatcaataataagatgcaaataaaaaatcactcattgacacttaatatgctgaatacaaattcagcaccataattaaattgcaaagtttaacattatactccattttgatattaatatttgatcttgcaatgaatgtctgcttgtcaaccttttatttactgtggaggtcgtggtatacggtattaaagaagacattcaactagagctcaatttttctgatgagctcccaggttcccatcgcaattttagacaacacatgctgttttactggaagagtatctaaaggatatagtctgatcactctctacctcccatggtaaaccttctgtttgttttttgaatttggtagttaaaggtgcatgataaaacttgccatctctgttagatgctgctaaatgagactagtaaaatgactgccaagctccagccgctctttattttattgctttaaacatagatttcctagatggtcatgatctggtttgtccaaatccaccttaactcttaaagcaataataaatataaattttaaattctaaatgaaagagaggaaggggtctcttcataagtgaaaacattccttaaacaaatgaaagcaaacagaatttttttcatggacctgtattttcatttttctgaccattatacgattttcctagcaatataaaagaattctgcagtccctccctatttagttgttggaagagaaaaatacattaaatcttaattagtatactacctatagtagcatctggtgttactgaatttttaccatcttctgaaagcagtaatcattctttacctggaggaaaagattccagtaatctgttttattaggaaacttttctagccttcctttcagttacgggatttattgaaaactacctcatatacatatgcacatatacccatatatgcatatgtatatatacatgtgtgaatacatatatggctatagatctgtgtgtatgtacacatatagacacgtgtgtatgtttttgtgtgtatatgtttttatgtgtatctgtatgttcctttctaaatagcattctatttcataccttggaaaaatataaaattaaaaaatgaggtcaagatggcgccttttaagaaataagttgttataacagttcctttcagcttcacatcataagtgttaagaacacttgagtatttttaatgtaaacatattttagcatctatttgatttttactttattttcttgatactttcagatatatatttgctttacattattctcagggtttcttatttcccgaaaacactttgaatcatttccactgattctttttcctcccttgttagtttacatgtatcatttgtatgatagtgtctggaagtaaaagggcacttgagaaacaaagttgaataaaatttcatcatacttaattctgaaaattgttttctgaaattattagctcactgctgaaatatcttcagatcaaacgttcagaacatcagctcccaaggagcttcatatttagtttatggtggggtatgattgtgtatttcacaaaattcatgaaggaaatttgtacaaatttattatggattttaggccagcggaactgtttaaacttcctactctatttgttccattgagtagccttagagttgaaacagcagtttccatttttctcatgggtagatcaacccatatgcacatttatcattgatttctagcactggaaaagcatagacattggagacggtggtcgggcacggtggctcatgcttgtaatcccagcactttgggaggccaaggtgggcagatcacctgaggtcaggagttcaagaccagcctggctaacatggtgaaacccagtttccactaaaaatacaaaaaattaactgggtgtggtggtgcacgcctgtaatcccagctacttgggaggctgaggcaggagaattgcttgaatccgggaggcagagattgcagagagccaagatagtgccattgtactccagcttgggcaacaagagtgaaactccatctcaaaaaaagaaaaaaagaaaagaaaaaaattggagacagctgttcacgtatttaaaggagggagaatattcttggagaatataattggtgaaataaaaatacaattcatatgtactctatggaagataaactgcaataagcaaacctctttggcagattttaaaatcagaaatatattccagccagtgtgggatattcaatctaatttcctttgagaacctgattctgttggattggtaggcattaggaagcaacagctcttctctctccatctcctcaaaaaattgtaaacggaaatgttgtatgaaaaaaacttcaaagatacattctaatttttttcttttgctattttaataggcttttttattttttaagaactgaggttagtgaacatgtgagagaatctgaagtacttttcatatgtttttgtccttgaactgagttatttgaatctggcaaatttctctattaataattacaattattatatcactatgtcagtatgtgtgttatattcaatctagaatatttgctctttttactcccatggttttgaaataagcatataggcatttaatttttaggagttataaatgtccaatagctatgttttatatcaatatgaactgcattgtgttttattactaatagtttagataaatctgtatatccaaattgtgaaccactgaaatgaataattccctttcttagagaaggacatgaatatagtgagagatctgttactttctggattcttctttttggtccttcaagaagttgtacaaagataatatcgatgttctcttttattcatcagtttctctcaactggtttcagaacattgcagtatcagagaggggaaaaaaataagtatttcagatttttttttcttgagacaaagtctcactctgtcacccaagctggagtgcagtggcatgatctgggctcactgcagcctccgcctcctgggttcaagcgattcttatgcctcagcctcccaagtagctgggaccccaggcatgcatcaccacacccagctaatttctgtgtttttagtagagatgaggtttcaccacgttggccaggctagtctctaactcccagtgatccacctgcctcagccccacaaagtgctgggattacaggtgtgagccaccatgccctgccaaaaatcagtattttctctgtatcacactcccaacctttaacattgcctcccattctttcttttggctgttatttaatgagagactactatgggtaggacattgtgttaatctctgggaataagagaccttcatattcctgctattatggagttgcggtttagtagagatggtaggtaagaacatgggctcctgaattgcaatgcctgggttctgttcttggttgtggttgtactgcttactagaaaagttgaagaaatcacttcattatttgtttgagtttccttcttgctgaaataaatataactctatcttaaataagataatgtatgggttaaacaatgcatgtaaaacatttggcactgatgttagaaaagggaacatacaggttagtatctctaaccatgttgtaaaagtgatttgaccagctgtattcagttataaacattttattgcacttttggagccttttccaagtcctgtgtaacctttggaataccctctgttcacctccccccaccaaaaaggctcctgtaagtccatcacttcttggaagcttcctcatttaacatcccctgtctagccattcctatacatgaagcagacacgactccttggtatgcactgtgcagtaatgaacagttattccctccttgtacatgttgctaatgtggattatttatttgaattctgactctttgggatccctttgtttataattttaagttcttagaaggatagggaccacagtaatctaccttggtctatgtgacacttgcacctttagtattcaataattgaaacacataaaagtgatttcagtggaggtgagcacaagcttccttttttcactgtgtgaatagacatagaggtgaccacacgtttttttcttgtcttgctttttcactaagctttctctgtgattgagaacaaacagggaagtctgaacggttccctgttattttatcttttggatgtagaggcatacatacaaatttctgttgaatgctttgtaagggttacctcatttattcttaaacttttacacagttactgctgtgtatttatgggatgcaggtactgtttatccattgtaattatagttcgtttgttagaccaaacattgggaaaatcttttgttgtgaatggtgattttctaaatttttacttttgttttttatttgccagattctgtctctcttttctttgttcttggtgtactaatctgattcctcttccatggctattccactttttccaagtcttaccctaaagccttttaaagcgatacgtttagatcaactttttttttctttttgtttgtagtttgcacattatatgctgtactttgactaatttaataattttttcttataattccatgtggaaattttaattttagttttgttttcccctgacctttataaaaacaagagattaagtgtaatattttctacttactgcttcaggctttgtaaatttggcacttaatggtttcattgttttagaacagaaaagattatcttaactgaccactaacaacatagttgccagtttggcgcaccaaatctgtagttaatactgatttcaaaatagtgtttcttggcaaatcacaaccaaaagcttagaatattctgtatgacttttagttctaaagtaccttgcaagtattactgttaatctcattttgtagcagaaataatagaccaggagcattaaaaggacgtatttgtttattcatatggctagtatgtgtggtactactgaactgaacccatgcttctgcctagttaaatggtctcaaaacactaagaaaaaaagccaacgtataaaattcaatagcggttagtagcaaggaatgagtgttatctgaagtcatagcgtgcttgttaaagtattttcaattaactttctccacgcgtctcttaaatatatgtttttgtatatatttacagtttttttggacagatctatttggcagtcttctttaagatattgtcagctactcattcacaagaatggtgacatcttaattttaaaaaacattttatatagttactctctttattctggtgcaataataatactacacactgggtaaattgtaaagaatagagatttatttgacccatagttctgaaggctgagaaatctgagagcaggatgctggcatctggtaagggccttcttgctgcatcattatgtggcagaaggcatcacatgaagaggagttgtgcttagaagacagagaaaaaatcggggccaaacttattctttttataactacctacttccttgataactaactcactcctgcaataacagtcttaatccattcacaagggtggtatccacctgacctaatcacctcctaaaggtctgacctctcaatacatttgcaatggcaattaaatttcaatgtgagtttttgaggagacaaaccatagcagttatgtattttgttaaacttaagcattttattctgttaaattatgtatgtatttatatatatatatacatatatatacacgcaagcacacatatacaggcatacttatgtgtttatatgtgtgtttatagatctttttcttaggaagataattatattttaaaagtcattgatggtagggatgatagcagaggaagttgtgaaatacaatctaagtaatattatagagcatacgttcagtattttgaaaactgctcaataagggtatatttgttgacaagtaatagatcacattacaaacttactattagacattgtttatctagtcagcatttatgaatagtctgtggtgatctgtgtgtttatattccacatacagtctatcaacaaatcctgtcatttctactttcagaatatatgctaaatgcaaccacttcttactacctttatcactgccaccttatttcaaaaccaggttttacttatttactatacgatcttgtccaagtgtttatagtgttaggatttttcttttcacaatcattcgtcataggtaaagaacttatttttctctcacatggtacattaaaaatagaagcaagcaagtaattgtctttaaaaattttttgctttgcctattattattcctctagaaaagataataataatacatagttacaagaacatttacattgaagaaggtgacttaatatttgaaattattgtgtttaatattatttcggtttttattaatgcttggtatattttgttaataatttaaatattgctaaattttggaaaaaattataatggaatcattatattagagttcttcagagaaattcaaccaataagggatggttatatctctatataattatgtttatgtgtgtgtttatgtatatgtatgtatatttgtatgtatatgcagtcatgcatcacttaatgacagggatacattctaagaaatgtgttgttaggcaatctgatccctgtgcaaacatcatagagtatacttacacaaacctagatggtatagcctactacacagctatgctatatcatatagcctgttactctaagactgtaaacctatacagcatgttactgtgctgaatactataggcaattgtaaaacagtggtaagtatttgtatatttaaacatagaaaaggtaatgggttgcactaccacattatgatggctacagcatcactaggccataggaaattttggttctattttaatcttatggggccaccattgtatgtgcagttcatcattgaccaaaacatcattattcagtgcatgactatatatatatttgtcacttattagcacattaatatggatttgtataaataaatttctagtaacgctcaaataacatacatggatgcattttcaattgcttctcaaatatatggagtattttaaataagtagattccaaaaagcaaaacaagtttaataaatgtctatttgcagctacattacacactcatacacacacatgcacacgcacactctctcacagaggcagtcaactgttcatgaaatattaagattatattttacaatgatatttaaaacttgaaacatacatacaaaacaatgaagtgtgatagctaacagcacagacttggatcagatagaatgacatttgacttccagctctgactttctgagccttggttttcttatgtgtcaagtaatgataatacctgcttctttgtgttgattaaatgagaatatatgtaaactacttgccatggtgccctgtacacatcatacacagtaaactattaccatctgtattttaattcttaattccttcccctgaacacaacttgataaatattctttaggtttctgttcctcctttcaaaagttgatttaattcataatgtaacttagcgtaatataaataataccatagaaataaccatctgtagcagtggtttgatgggaaaatacagtcacagctacaatttgataagccaggaactgtatttttccctcctgaagttataaaagtagaagtagtaatcctctctccaggcatccttttatcttttgaagaatagaagtaaatatatctacatatccaagccagtggtagtccttctgtattggggctttttgcagaggattggggctttttgcagagcaggcctgcaaggggaatgaatatcagaaatgaggttccagtgacagaaggtactgaaatgctgtgtgtgtgtgtgtgtgtgtgtgtgtagaatgtgaggggggttggataggttcatgtgggtgtaaagtgaagagataggccagggtgatagatgtatagaacttctgattttaaaataagcatgtaagctgtatactatttaatgaaattactattgacattttattgaaattaaataatgaattcatcacattttatgagaccaactttaagaaaactagctggatttttaatggtttgcttcaacttaatagtggtatataacttagtacaaacatcgaaggctatcagaaaatgtatgttagaattttaatgattatagaaactgtggaatattctgtatatatctgacacttaaaattacttgttctggggtatccataataaaatttatgtcatgtggttttttgggtcagtattttcaggtataagcctggtgtgtaacagtgaatgctcttagaagattgggtctgtatcttttgtctctgtaaattacacaatgataggaagttaatatgttagggatttaataagtatgttaatgattatctataaagataatatgctttattttttgattggtttgtcatattttattggcctgctttctgctagaataccattatgatataacttgccaaggagccctagggtatgaaaaaacagtcttccctttttaattatgagaagttcagagaccttctgaatatattaatgattactactaaagcaattcttaataatttttccactaataggagttgtaaagatgccagactcaaacagatgtgaatactaggctcccttgctagttgagttcttgttacttcacatcagtcttacagctttctgttagtgtgagtcacatgtgggtctcagcaaaatgataaattagcatagaccctggacctctgggtcatggtaaaaataatcactgaatattaaggatctgtgtaaagattcttaacctgtatagggtctgtgttcagaagatctgtgaaactcctgaaattgtctgccacattttgtgtatacgtgcatacacattttttctgtgaaggatatatgagtattttcaagtctgtaacccatgaaaggttaaggaccaacggatttataacctgttcagaagtcttttacattgagttaccatttgccatctcatttcctcactaattgcatattagtgaggaaaaacttagataccatatatttttttattagtcttattttaattttccagaaaatttgtgaccttttcataatacagtgttatttcttctttatgtgattcgtattttagtacaaataccatgttaaggtgcttgataaaatgtgaatgatttatgaaattttacttatatacccaaatttgttgttaaaagggacaaaaaggaatttttttgtattttacattcagtccttttcatggaatagaatattttaaaacaactttggcttgaatttttaattatcatatttagaaatcctgcttttatgaaaatacagaaccctcactctgtggcttacagacaatagtagtatattatgtagggtagcctaaacaatggttgattattgtgtttgtgtatatttcattctctctgaattggacttgagaggcaaactttgtctttaaacctttagctgttgctttctggacctttgtattgcctaagggatgcaaacttcttggaaagtagaaccataaagttgtaaatgaacaagggaagaaatagaaaatataatttttgtcttcattaatgtttctaaagtagacagtaatttcacaattacagtatccactctcatgaaatttactaactacattaatgagcaaatgtgaagctgttttgctaatgtggaaattaaattttttaaaacaaaacttttttattctgtcaccaaagaaagaagcacattggttatgttaataaaaataatagaataaacagtcattcattggatgtttaattgttacaggcacttttacatattaccttactggatcttaaccactgtaagcattaaatggtattgccattttgatgaggaaactaaaacatgtagaagtttcttcaaggtgttctatgtgaccttcaaaaccaggcaattaatgggtgcttaatatttgttaaattgaattgcattgaaatctctttttactctgatcttttcattagtattatcattttttcatttatctgcggttaaattatggcctcaattttgggactccaggcctcagtatacattaacataggaaatatacccatttaaatgtctgctacattgtttcctgcagtgattcttctttttataatcaaagcagtgtgtagcaagcttttatcataatattttggaaaaatacgatctcttttataatcctaactgttagctaagtgaagcagattttctatactttcattcccacttattagtcacaaattatggggctggagatgagttgagatattggaggtcttttctccccagccttctatgcaaatagaggattttcattttttcttaatagtttgtggtgtttttcctaaaaagtaatccttaatatagtttttacccatattggtttagtttcttttgagagaaaatatattttattgatatataataattatacttttggtatctctcattttaaggtattagcctcatttttaaatagtgtttgaatcggcaaatgggtaaaaaatttgggtgttatggaatataagaaaaagaaatgaatagttgtatagtcaacattttatacagatgtaagtatataaagtttatatcaaagaaaatacttcaaaatattttaagtattatagctagtattgatgcagtatggtcaaattcatttagtgagggagtcattactgctacatctagcttttataaaatttgaaaaattcatgaatattatattaaatattttaccactttgggaggccaaggctggtggatcatgaggccaggagatcaagaccatcctcgccaacaaggtgaaaccctgtctctactaaaaatacaaaaatgagccaggcgtggtggcgtgtgcctgtagttccagctactcaggaggctgaggcaagagaatcgcttgatcccgggaggcggaggttgcagtgagctgagatcaggccactgcactccagcctgggcgacagagtgggagtccagctaaaaaaagaaatatatatatatatatatatatatatatatatatatgtatatataattcatataaatatagtactttatttaaaaataaatagcattttctcctcttctcatttgtttatacttttaatatgttctgtttacttgtaatcaatgtggagtcttcttttaaaaaaaaattaacattgctgttgtgaagaaaatttgcagatgaatattggaaaatatactgaatacctagaaggaaaataatgttttttgtccttcttaatatagaggtcaaaatagaaaagctatttctaaagttgccattcgtgggaaaggaaaggccttatcatttatagaatttgatatcagggaacagttgttctgaagtaaaacaatccagaccattaccacattgataattttctccaattagacagattagaggtttaatcctaaaagaaccccagtatccaatatttttgcctacatctttaacattaaggaaatcctgtttttaaatttatatttttaaccattacacaagatctttattattggaaaaaggacagacgcaaattaatcagaaaatttctcattgaggaagattgagtttttaaatgtatgttaacaaaaggtagaaaaactcatcacacttagcatgtatacagtacttatatggactagaaagtttgttcttgtgctttcagtagaagcataaaacaaatctgatgttgtcatagagatagtttcataataggttatgtttttgtacaagtcccatattttcactagaactattacaaacattacagtcatcagcagatgttacacatgtctagcatagaaatttctttttttgtttttgttgtttgtttgtttgagacggagtcttgctctgtcaccaggctggagttcagtggcgcgatctcggctcactgcaacctgtgcctcccggaggttcaagcagttcccctgcctcagcctcccgagtagctgggactacaggtgtgcgccaccacgcccagcttatttttgcatttttagtagagatggggaatttcaccatgttggccaggatggtctcgatctcttgacctcatgatctgcctgccttaggctcccaaagtgctgggattacaggcgtgagccactgcaccgggccctagcatagaaatttctaaagtggatataaattaatcatatcaattctaaattacagtttagttaacattttttaacctgttcttcagttattacactgtatttttagtccaaaaaaagatgaaaggatttatcaggatgttttgaggggatagatttttaaataggtcattttgaagatacttttgagtagacatagtcattacatagtcattaaaaaaccagagctttacatatttttataaaataatttttaaattctaaaagtaataaatgaccttagggaagatttggaaaatacaaacaagtatgaagaagaaaaaaaaaagtccccgcaatcccactgtgcaaatcaaccactcttttttttttttccaagccaaactgtatccagctttattaaagatactttccataaacagtcgtggtatttcaggcagaacatgggcagacagtcattaacagtacacaacaactttcaaacttaactaccttcttcaatggactaccgaaaatcagaaagccactataaaacccaatgaagtcttcatctgatgctctgaacaggcaaagtttagagtgagggttgacatgtcacatttagcatgttgtttaacaacttttcacaagctgaccctgactatcaggaagtgaaatgaaaacggcagaatttatctgaagatccacaatctagaaacggaaccactgctcttttgacaggtgccatctcagtggcatcccggaaaagtccagattgcctgacacactggtaaccaatgactggaggtcaggtcccaacagatgtctgggcttaagggagttaagtctgtgctgatagatgggaagggagaagagagataaaaatgattttgtttttccataccacaaggcttttgtgccaaggtggccatatgtgtcaaagtcgcggaatccctcctgggagccaagagtaagtctctcaaaactagaagggaaaagtgttttccccacatcaatccagcttcgaagacaccctattagtgacatatgccccttccccacaaaacaacaatgaagtgttctgtgtgctaacagcatagctcaaaaaaaaaaagtaaaacaaaattttgcatttttataaaacttggtaaaaatagtatttcaaactgttcagtcaccagaagtacacagttatcaaaaatgcacacacttctcttggcacctccagcaccttcagctttctgtgcctgatctgttttgacatctccattttctgcagggttattcccctccttgccagcatcagcttttccctttctccctttgggtaccttctctcccttctttgcaggggcctttttaggcctgggctctggctttggagaagcaggtttagcggacaaccttgcagatcttctctgtggttcgtcctttaccttggctttatctcctttagcatccccttcagcctttctcttgggcatggtggtggcagtgatggtggtgggacataggcactgggcgtaggatgcagaggcatgtgggctttggtgagtccaggggtcgttcttgcctcttgttcatactgctccaaatcaaccactcttaatagtaaattctttataaatattgactattgtgtacatttaagttgtttattacttttcactgttaaaaatagtttttcctcacacaatttctaaggatgcttcttaatgacagcaaaatgcaattttctaaagaaatttatccaacttgataaaaccaagagtcctttacttaggacaggtatatggggtagtggtaagagcttccctattccctgtttgacacaaattttcttggaagcaaggaaagtagaaccatattcccaagaagcattctcttggtgaggcagaatagaagaaagaataaatactatgagaacattttagggacagtcctgaatagtagtcgagtagtaagggctccaaaagaacttacattccttcctttgtcactggaaaatcccagttagctttgaatagggcgttgactctacccccatattaatatttttagacagtgttatagattgaattgtgcttcctcaaaatttgtatgttgaagctgtcactcccaatgtgtctgtatttggagatagggcctttaatgatgtaattaaggttaaatgagatcataaggatagggctattatccagtatgactggtgtctttgtaagaaaaagactagctaccaggtgtctgctttaatagagaaaacctatgagacaagaccatctaaaagccaaggagggaagccacaggagaaaccagccctgcggacaacttgatcttggactttcagcttccagaactgaaagtctggaggctgttgttgaaaatctggaggctattgttggtggctgttgtttaagccacccagtctgtggcatttcgttaatggcagccctagcaaaccgatacatacagttttctccctttcccttccccttccccttcccattttagtagtagtgcagtaggcggaataacagctcctcacagatagaaactgctactctgtggactgtgtaagcattaccttaaaaggaaaaaagattgggagactatcccgggttatctaggtaggccataagcacaataataaatgtccttataagagagaggcagagggagatttgacacagacatacataagagaaggtggtacgatcactaaggtagagactgggataatggccacaagtcaagaaatgctggcagctagaaggaggaagaggcaaaaagcagatttccaagagggaatatagccctgctgactccttgttttctgcccagtgaaactattttggactttgtgagggaatatatttctttttgtttaagctattgagtttgtagtaatttgttttcagcagccataggtaactaatgcaaatagctgctgaaaataccaaatacttttctgtgtctaatgatgtaatcttatggttttgaatcatatgatgtttgctttctaatttgtgaaaaaatcatatcgattactttgctatttttttgtaaactgcctctttctggtatttttttcaaacactgatggatttgataatattttgatagagttttttattaaggaattaaatagtctctactttttcttttttatactgtctttgtcaggtttgggtcataaggttatatgttaaattgttttggatacatagtcggagcccaggttattctaaccttgaaagtcagttatcaaagctgaagctttctatgatagacaattgggagataattttggttcttaagtagaagaaaccatattaaagtgtgttttttaagataataagacataacagtacatccaaaaattgtttgtaggtacctagggagcaaaatcaggcataaagtctcagataacaatctaggtactgagtttctcaaacacattctgtctcattcatgttcttcaggagtgaagactacgtgaattgagttttgggggatttaatcaggaagtaaaggaattctaagcccctagagaatgtcacagtagatgactgagaggtgatcatgtttatcttttccctgtaattctttcattccattttttttttctttggaagaggtgaacatcgtagataataaactttgggagtgttaggggatggaagggaacatgtctgtataggtcagagtttctgaggttggtagccttggactttttgtgagagaaagaagagtagagttataaggatccagggatacatatgcaacccaagcattgtataaacactggaaaaataatataactcacacgtctgttattccacattttcaaatgtacttaattactttgtaaatctaaatcatcaactgaaaaattatgtttctaaatttgtggcacctgtagttaatgctttcaaacaacaaataataacagcttatacctattaccctatgggaatctgtagagtgggtttaaaaaattattttaaagggaccatcttttaaatgaaaccctccctataaacttataaaattaatcagggaagaagggatggggagaaacaaaaaccaagcttgcagcacattcagcgttaatcactaggtgaggcttgctctctggtctgcttcttcatagttgtttggtgcctattgtcctacaatcacaaagaccttagattataattctccttaactgctccatagaaaacaacttgaacattatgaaacattaagttttccctttgagatactctttttttttttttttttaactgttccaaaggcacattggcacctttgagatacactttcaggtcctgcataccagtgaaactacaggcaccagctggtctgacggtgagctgtctcagcaaatgcactcggtatcttcatgatttcatctcccttattccaaccaatcaatgaccccaaatttccagccccttgccctctactatctccttaaaatccccagcccagaactcctctgggagatggatttgagggtctcctcccatctcctttctcagccaccctgtggttattaaattctttctgtgttacaaaccctgctatctcagtatattggtccgttactgtagatcaggcgtacaaatttgttggtcttgaatctaaacaccagtcccttaatcttattactgaggatactcttggctatgtagttactcatggttacattgctagttagttacagaaccctggtgagagcctgtgttttcaagatctcttagaaatgctgtgaagaaaaggtcttaggtttaggtcttagtagtaattatttggtttgactttggaaaagtgtagatacctgcatctcctcactgtgggctatgcacagatgaaatgtagcattattacgttttgaaaggtgcaggatagcttctgtttttcaacattatgctttagttgttctagccaccattctttatttaaatgagtaggaagccaagagcaaagtaaagatggatttttggagtcctttgcttattttcccacattttttcttaccagagaacacataacatagacaggtagataggaagggagggaggtagataggcaggcagttcaaccagaaaaaaatcaagcctgttttagcaggttgtgaaaagatgaactgaatctgtcaatgtccgcatcttctttagttaccaggagtggatgtgggtaagccttggtgcagcagataatactgataagtgtatatgttccaaatagagatgtggtcataggaggaaaaagaatgttaatgccatctgggatgttaagaagttagggaaggacacagagcataattgagatgaaattgtaacttcttactctcttcagtgatagtcaaatctaatttaagtctgttactctattctcatgaaaacattctcaagagttgaagaaaataaatagtaaggcagtctgtatggaccttaacaaaacttagttttgactattggaattaaattttaatattttaatttggaaatctcatcctgaaatctcttttggtaaaaacatggaatctttttagtatgaattagaattattctggtcaacaattatagtttctgtacccattagggtatcaaagtcttatattcaaattatattaaattgactcattgactcatctagttcagtgggaatatgattttagaagtagaataaagtctacttgtatttgtaaagttgacactatgttttatgagggaatttaatgttcttttcaggaacatgaggctggacagaaagataatcttacaagaaattatctcagtttttcattttggccttttgttcacaaaagagctagaattcaaaagaaaacaacatttagcctatttatttatttgtttattattttttgagagggagtcttgctctgttgcccaggctggaatgcagtggtgccatctcggctcactgcaacctctgcctcccaggtttaagcgattctcctgcctcagcctcccaagtagctgggactacagttacatgccaccacgcctggctaattttttgtatttttggtagggacagggtttcaccatgttgatcaggcttgtcttgaacacctgaccttgtgatccacccacctcagcctccaaagtgctgggattacaagtgtgagccactgcgctcagccgccctttttaatactatggttattttagttgatatcttcagattgctcttgattggagtatataaaatatgtcatagattgtgttattttaattttacttgtctatgttcttatttctttgaagttgctatttttcactatattttgctgtcacctataaattataaatattagtcttaacagaagtcagatattttctatattggatttttttttgaaaaaaaggagataggataaaatgtaaggaaatcaaatctaggaactaatttagaaaagtcagaggatttttatttagtattgagaagtataagataagttaaatgtatacaccagagaaaaaaagttcttattacaatgtaatatgtggaacaaaaaaaaatagtaaggatatggctatctatattttattttaatgtttatttaacaaatatttactcagctccaaattaggtactagaaactgtctcagactctgggaatatatttccacacatcctggtcaatgaaacattaaatttctaattagaaattttagaagttctaagaaagcaaaaagctcatggtgcttttggaacatagtccagggagatttaacctaatccagagaagctcgggaaaaatttgtgccagactataaggtgagaccgtaaggttgagtcagagagggacagaaggggtttggagagaatgttattggagtgtaggaatagtatgttcaaaaactctgaagcgactataatgtattgtaagataccctgaaagaagttcatgatcgtaggagtggaggcagtgagaagaggtgaagccagactggaatggttcaaaggcaacacttgaaattacctgattaaaataaggcactcaacatagccttaagaatgaaggttattccatttggtattctttgctgaactgcttaacagtatttttatgtttccatgtgctgaattcattttataaatttttttaaaagtaatgcatgtgtttggagcagcattataagaccatggaaatggttttactgtttgtctcttttacgttttttaagaacaaagcttccattttccacttccatctcttggactattcatttaacggtgatctttctgtttcttaatccaggttctaaggattctggggttggtagtttaactcttaatccttttaaaaaattgaaccaatgtatcttttcaatgagaaatagttcataaatcttgctactcaaataaatcatgagtctatatgaggacttcagttgggaattcgtttattcctgttcactagaattaggaaactctatgtagataggagccatctctgtgtttacttactgtctctacagttcccagccattgcctagtatattaatccatttttgttggtataaaggaatatctgagactgggtaatttacaaaggaatgatatttattttggctcatgtttctgcagactgtacaggaagtgtagtgctctcatctgcttctggtaaggcctcaggaagcttacaatcatggtggaaggcaaaaggggagttggcatatcacatggtgagaggagggaacaagggtccggggccgcggtgccgcactcttttaaacaaccagatctcatatgaactcagagcgagaactcatttattgtgaggacagcaccaagccattcatgagggatcttcccccaagccccaaacacctccctctaggcccacctccagcattagacatcctatttcaacatgaggtttggaggggacaaaacattcaaaccgtatcacccgggatattgttgatgaagtatttgttgattgaattaatactaaattttgttggcattacattttattttgactttaaatgctgatgagtatttgatagttcatggttctgtgataacatttaggcttgtagtgaataaaacattacaatattgtttaaatcttttcttttacatttaaataaaagatggataagaatgttactttaacattttatataatatcctttaacaatctgtaggctaatctttagtttatggggcttctaacccataatgcagttgtactgattcttttgccatttccaatttgttgctgtgaccatttggtgaatattttatttcacttattatactttttagatctagagttttctgtttttgttgtttctttttttctcttgagatttattctgtgttcactcactgatagcatatttttcttcagttctttgaatatatttataatagcttttttgaattactttacttgctaaattcaatgtctgagcccagttagagtcatttgtattgagtgtattttttcttaagtaatttcctgaagactttcctgtttgtttttttggggatttttttttttttttttgcatatgtagaaatttctggttgaaaactagacattgggaaacatatggtgaaatgactctgggttctgtcatattcttttgaggaccttggttttttgttctagtaggcaattaacttccttgggttgaaaccacaaactgtctcctgtgaggtattcagcttacacctttcctctgctgctttgttagcctgaacacctataggtcccccttgtatatgcacagtgtggtagcccaaagattttggcagatgctcatcttctttgttgtttctttgtgtctcagaatttcctcctaattgacagtagccatgccagctttgggccctatactctgacacatcaagcctgtctagattcatctttctaccactcaagctgtaaatgattgaaaaatgttctcagttaataaaagaatcacagattctaaaatcttgtttttttttttttctcttcctgctttttcactaggcttcataggcctcccttgctcatgtgtaaattttgttgtcagctaggaatttgtgtagcttgtgctctgaatttgagtctcgtgccttctgtgattagcttggtgctaacatttttcctttaaattttcagctctttttccagctctccactccaagttctagcatctttagccagtgcgatgccatttttttcttctccttttttgtagctgtagctatggagtttggtcagtgccttgcagccagtatgaactctcaattcttaccccttctagttttcaaaataaaactctcttcagccttatgtctgcatttgaaagtttgaagtatcttcaagtagtttgtttgctttaatctagtatcttattattggtatctctggggttttgtatgaccacgtcagtttttcagcatgatcagaagttaaactacttcatccctattgatttcaaatagtacatttaaaacaagggcttctaaacattcaatgaaattcaaatgatgttttagacattaacttacacctcaactcttccaaatttgtaagttcatgtttgcactttgtacttcccttttttttttttttttgagaacagcaaattatatttcagctgatggactttcctcagtttctgttaattacatgtgtgtctctatttagtagtgcatttagagtcactatttttcactgctgcagatatctagacatttgattggaaaatagttcggcattgaacttagtagcaatattgggggacttgggactaaaaagcaccaatcaacttagaaaaccaagccctgtagtaacacaagggaaaaaaaaaattcctgaagccaataccttgggaaataaagataatagaaatgaaatcatctaagtagatggccttaatatttctggacatgttccataaccctcacaggtaacagtggactggcatctgggagacaggacaaaacataaatgtggaatttcaaggatattcctattttctgttaaagttgcaggaagtatgaattactaaagactttacatatggtcagattgctgagtttcagtttcaaatattaaacactctttttcagacgttctcccatttcactctcatttcatatgagttcatattattttatgccccaggcccgaagtgtagataagtttactgctccattgtatactgtttatctgattcactctccccctcttttgccttctggtgttacagagtggtaagcaggaaagcagggtctgtatctatctgtgctataggttcactatccttgccataaattaagttgatcgcttaaaaagtatcactactttagcactagatttagctcgcttttaacagaaatttcatggtgatcttttctcatttcaaggcccttgaaataagggccttgttttctcgttaatggagcatctcattctccttcaacagggcttgatttcctttgaacaaacattattcttaccaataattctgataactttctggtaatttaattgtggttatccagcctctttattctccatcagttcattttagatattcttctgatttccttttgtctttcacaagatctttgaaatcccattttctctacatctttaatatgacctgaaaaaaatgtttgttcaatttatacatcctgccacaaaatagtactctgcttcaaattccacatttatgttttgtctcctctgccacaggtaataacccgtccactattacctgtgggggttatggaacatgtccagaaatactaaggctgcccacttaggtgattttattcttattatcttcattttccaaggcattggcttcaggatgttttttctccttgtgttttctgacttgattggtgatgccgagcattcacacagcttttcagtttctcagcttagaagcaaggaatgttaaaaagttactatcagtgcctttaatcatgaaaaagacaagtagaaggaattagttctctcacccagggacatcagtgtgtatgtataccagtgggaaccagacatcgtgtctaggtaaaatcacttatcacactgcagctaattttttcacctggtaattttagccaaactaggtcatgttataaatgtcagcaaggcaaaagagagaataaaatgtcatcagaataatgcacatacatttcaatggaggttaaaatcttttataggaaacaggattatgaggtaggagatttttttcattgcagcagtgaatgtgaatacagttactatgattcttaaggtattcactttggcctcattcctgctttctttaaattagaaaaaatatctcaagtttgcttacaggtaagagttttaagccaaataaataacagttattgtagtgatttggttgaaaaataaacttctaattcccctttaaaaactgagaagaaatgaaatatagtgcaacgtcagccacaaaatcattattttgatagctaacatcatttgtattctaggctagaattttaaaatttaaagttcaaaaaataaaattttattcacattgttgattttgcccaatgacacaagctatatgttaatattaaattaatatagacaaattaaagaaagtaccacatttatcactttcatatgtagtaatttttatttcaataaccagaattgtaggtttcaaaaaatgtttgaaaatttgctttaattaatagttttgacaaagaacctttaatagaccgctgcttttcttttcaaagtttcagttaaacctgaagaaataatatggtcctgctgtgatttttgaatgaatgcttttgtggttgcataaattgtgttttttcatgaatattaggattgtaaatgaaaattaagtctggattctgatccttttcctttcaagcttattaaaataagatcttttaggatcactgtgactctctccttgttagttttatgtcataacttagccctgattataaacaaactttaactgtttcttaattcagttttttcttttgtcatgagcaaagaaaaattactgaaataaataagcattgagacatattcttgtagttgaaaacttagtgtgggaatcatatttttgactcccagctcaggatagtattaggtagggtagattattttatcttcttgtaaaatagtgtaaaataaatatttgcctatagacattacagtttagagtagagaagtttcacattagaaagatgctgattcgtctttacatttaggcataaaagagggagtacatagagagcatttataatttatctactttaaacataattattttttattatttccctttgcactatttttaatcctactcatagaatgaaagatgaggcattgaacttgtatctaagattgatgatttgttttgagtctggggcagacagacacagtaatggcttagtctgatacaggcattttgggttcagtctctagggacaggtattcatatgtaataaaaccacttgaactggcattgattgccattgttgataatcctagcaggatcaacattgattgagtaaataaaaagatcgaatttaccttcttctggcaaggcaggcagagaagcaggacaaagcataaagacttgacagcactgtagcattacctctattcaactgtgcttcagagaaaagaagtggcaatgattaagggtactgttcaattcagcaagcaattattgagcagttctgtagcgcaacactgttagctgctaaaggactcaaaaggagaagacagtatgattttgcactaaagtagtttatcatctaaattggaagacaaacggttcatatgtgaaacagctagaaaacaaattatgacagtatataattgagtgtacagttgttcatgcaacagaatacaagcacaatttatttgtccagcaagtgaaaagatatatctttataatgtttataatgttaaattttgtgtggcaacataaagtaacatagcctgagttaattcaggtctttggttatttaagatgaaaaaacccccagcaatttaaatggtatttatttaaaatatcctttattttatttatcgtcctttatttagaccacctaaaaacactagatatatgattattcatacctgagcccccccaaaaaaaaatcaagactagcttactccctgttaatgattcaatcaattgagtataaactttattaggttttgttcactattgattctttgcctcatatatcataaaggttcattctgtctattttgcagtattttccaatgtctaggtattctgaattatgttcactaaaaagtaggtctcaaagagcatcgtaatctccttagctttgtataaggaagccatgtaacaaagcagccttactacgtttctgtttttgcttttgttttatttttatctccattacttgttaagtggtaatggtgtagtagcatcttaaaataccatactattaagattgagccggggaaccttctcctattctttgctcttcagatatttctctactgtaaccccatagctcttgaacatctcatgacatatatcattgtattttaatttaataaattcatttttctatgcactagactggcttctttgcattataaccaggacttcacatagatgctggtacctcatagatttctaataaatacctgctgaattaaggaaacacaaatttatgttctacatcacgatgttagtgaaaatttgttgctgtgtttatttctcacaataaataaacatggggtgcctcctgtagtagtgtcctatgggaatcaattattgatacccagtgatgtagacaagttgttttaaaaaagaaaagattgaaggaaagcagtctcctcttttaccagcccccacctcaactatataattttaagaaaattgatatcaaaagctgtgatatccgtttctctttaccatccaaagttcttgaagttgccttgacaagcagagattccttgaatcagtccaaatacatgatatatagataaataatacgtgtgtgtgtgtagacatctttagtagaaacagcttttcagatactgatttcatactgtcttcctcctggctttccattgacttactgatttcagatacagtttcaaattgcatcttaattgtggggagtggggatagtagctagcctctggctcctcttttttaaggttatttctgagactgccttggagtggttcaaaccagaataaatgcagtttactgcctatcactccatactcttaagatggttttgccagcttttagagcctctcagatgttctaaaataaggtcaagctgattctacatcctattggtggtaggtgttagtgatgtcaatttggcacaatgtttttgacttgagatagaatcattaatccagggatatcttgttaataaatttaccgactactcacttggaatttttgatgtagcagtttttaataatatagctttttcatgtcaacaagagtacattctgactgattctatttataaaagtatgcaatactaatgtttaatattagaacagttagcagtagttaactttggagaacaaaaatggtagaggtaaggggtcagtaagaggacttctgaggatgcaggtaatgtatttattcagcgagtcgtggttatatgggtgtgtttattttgtagtaactcattgagctgtatgattgctatacttcactaaaatctatggagatcaaaggctactttggcagctttagtctaatgacaaacttattattttcttaaacaatgggcaaaattttcttctgactttcagattcctacagtctaaagggaaagataaaactattttagtatgatagctaaaatgcttttgctcttttaaaattctcattataaagtgtattgtttattttaacttttatatgactgttattggctacttaaaagtctttaaagaaattaattgggaaataacagttgaacatgaatatgggagtacttacttcaagacaatccagaaaaaaaaacaacagaatataaaatgtaatgtttaacaaaaaacaaatgtcattttgtatttaaagaacagtttaaggtatgtttaaaacaactacttctgaactgaatgatactacttctcaccccctccatggcaaaggggtcatctaaattagttgtagtcagctgcaccaagctgaagagccactttacactgaactgaattttgtatggaagctggaaagaaccacagactttactaccacattctaattggcaggaaccctgcttctgatgctaaacagcatgtcaggattgcatactgtatcaatttcagaagtccaagttacatttgggtttattgtttatccagccacaagtaagctgccttctgtaacttacccattggcttactgggttatgattttctaattagaaatggaggactttgagatgttaaaagtgggggcccaataatgagtattgcactgcagatacacagactgaatatcactgtcctaaaaaaaaaaaggcttttaaattgaaatatcaaaatcatgattaaaatcgaaaggtaaacaagcaagataggataaattcaatccatggtgttggtaccagtactcttcacgtgaaaaggacctcggcataagtgttcagaaataacaaagatcaaccagcttggccaacatggagaaaccccatctctactaaaaatacaaaaattagctggacgtggtagcgggtgcctgtaatcccagctactctggaggctgagacaagagaattgcttaaaccccaggggggcagaggttgcagtgagccaggatcacaccactgcactccagcctgggcaacagagcaagactccgtctcaaaaaattagcaaaaataacaaaaatcaataagctgaaaaatgttataaaatttgacgttgaataattcattagacatgaaattacagagtgcttacatttgttgggtactcttttaattgctttacatatattaacttgttaaattctcaagcaacctatgagatacaggacaagacaaagagaagttaagtacatgtagaaggtcacacaaatgacatttaaatccaggcagtctgattgtaattctatgctcttacccttaaaaggattcgtcaattccggctaaatggtgtgcctgaataaaatgtggagcacggtagcatttataatatttattcattcaacaaatatttattgaacgcttacgattgggccaggcactatgctaggtatttatggttataatattcccccacttatttttggggttttacttttcatagttacctttggttaactgtggtctgaaaataggtgagtacagtacaataagataatgtatgtgtgagagagaaagactacattctcatgactcttattacagtatatagttataattattctattttattattagttattgttaatcttttacagtgcttaatatacaaattaaattttatcataggtatgcataataggaaaaaacatagtatatataagggtcagtgctatcagcagtttcaggcatcctttggaggacttgaaatatatctcccacagataagggggaactatacataacagtttatgaaagtccttgacccttgtgaagtctgtattctagtagaggtctacagacaataaacaaaaaagtaaaacaactaggttgtctaataaaatatttacatagaagctatgaaggggactgtaatttcataaggtggtcaaggaagacctcactgataaggtgacacttgagtaaagatttgaaagatgtgagaggataaaccacgaggaatgttctggaagcagaacattccaggtaaagaaatcagcaaggacaaagtccctgagaagaaagtgagcttggtatcttcatgaacaaggagagagttttaatgaagcacagtaagcaagagggagattggaagaggagaggtgagaggggtgtggtaggacagatgatgtaaagccattgttaggattttagctctcgttttcagatgggaagctatttgaggaatttgcatagaaaatcaaacctcaaaatgttgagagaagggttctagaagaatccttgataactggaaaggtgaagtttttacattaacagaagaggtaaagagtaataatcaaaaataggaagatcttcagtcagtgatgctaatgtgtctgaagagtcagggtccccagtaggggaaggaagaggaagaaagtgaaaggaggctaaaattttcactggcattgtaggtagaaagactagggtttgagtggacatctgctatggaagtcaggtgacagtggaggccaaagtaacaaaagcaggcagggaaattctcagcagcatcagagtaatacaatgaaattcctcatagaaatactatcaaggaaagacagagaaagccattggacacctatgtcaatcaactagggcagctttgctaacgaacacactcttaaatctggcaatcgaaagctgcctgtttaaaaacaaaaaagtaatgaatagcaatgaaaagaaaaaaatttcaattttagaataattattagcacaaggtcacatggacaggaacaattacccattgtttacataaattctcatggtagcaataatgtaatgcatatggctttgaagatgggtaaaattattactttaatacagtaaaacaggtaaatcatgaatgatgtagactgcttgtgccagtatatttgaagtaaagtaaaattcagtgttcaaatggagaaaccattgaagtgtccagtaatgatgcatttaaataaggtgatttggctgcaactgcattcatctgtaaataatttacacacagatcgagttaggaacttccgaaaaaatagtactcgttctaaaaacatccaattggataatttcacttataagggtaaagagtactgattttaaaaggttctcagagtctgttttgtgaagagatcccttaaagtataatggtggcggagcacagggaagagctcacatgcagccgcaggagagctagggaaaaagggtgacagctctgctaagccgccacttagaaaagagttggataagagcagtctcttcagagtctgacacctttcattttacggaaaaccttcacctagtctgtctatctcttaccagtgaacttcttcaaatgtaaaggtgtttgtaaaaggacataaaaatcaatcatttgtataatataatttcagatctgtgccttttatatatatacttttaccacttattttttccatctgtgaaatgtgctgacacctactttaacaaactgatacaattgagaagagagagtgtgggctgctaataagaagctctcagtcaaaacatagtcaaaaacagagaacagattgataatgaatacttaattctttttaggagtgtttttggtcctacaggattcagaattataaaagctgtaattccctttggctgcaaattgtaggcatgttgcttgcttgttacatttcgagttccaagttgaatcagttgctttcttgaacagttgaaaagctgtcatttaagcatttcaggtatttcattttcctgttacaatcctgggttagatttgctgttacttagctctcacctcttcatctattacagttttctccctcatttaattggagtatatcctcaaagatcttccacagaaaaggcatactggagatacaatttcagagttcttgaaggtctgaattatctgtttgctttcatatttaatagatagtttgggtatatagaattctgttttcaaaatcattctcctatagaaccttgaagacatttcctccattgtgtcctggaatttagggttgctgatgagaaatagaattccaatttgattcacattcttgtgttggtaacatctttttccctccttggaatctcttaagggttttcttctttatcttcgatggataaaacttcaagagaatatatttggattcaagtattttattcattcagttcgcttgatacttgctcagcccttccatcttaaaatcaatagttttcttcaagtctggtggtttttaaaaattacttgtctgattttctttctatagcatacatacattatttgtgcccacctgttatctttggttatctttgaacactcttttatatgttttatttgcggcattatgttacttagaaataagaacatcatatagtttgttagaaaaggatacatgttattgtaacagaagaagtagagcagaggaggaaatgtagataaccttgggtatggaagcatccaagatgtcttccagaggataagtaaacttggtacaaccagacaatggaatattattcagtgctaaaaagaaatgattcggctggacccagtggctcacacctgtaatcccagcactttgggaagctgaggtgggtggatcacctgagcacaggagttcaagaccaacctggccaacatggtgaaactctgtctctactaaaagtacaaaaattagctggtcatggtggcaggcacctgtaatcccagctactagggagactgaggcactagaatagcttgatcccaggaggcggaggttgcggtgtgccgagatcacactactgcactctagcctgggtgacaagagcaagactccgtctcaaaaaaaaaaaaaaaaaaaagaagtgatccgttgggccgtgaaaggacatggagaccccttaaatacacattactaactcaagccaatgtgaaaagactctatactgcatgattccaactatatgacattctagaagagacaaaactgtgaagagagtaaaaaagatcaggggttgggggtgggagatgagtagatggaacacagatgatttttagggctccagtaaataccatgtatgatactataatttattcaaactcacagaatttacaacaccaagagtgaaccctaatgtaaactatggacgttggttgattatgatctgtcagtataggttcattgactgtaacaaatgtactactctggtgggggatactgataatagtaggggttatatgggaaatttttatatcttcctctcaattttgctgcgaaactaaagccgatctaaaatagatttttttaaaaagtagagcagagtaaaggggttaatgtattggggtgggggtatgcaaattgcaattattgaatagaatgatcaaggtaggcctcattgagaagctgacgtgagcactgagcaaagactgtggctatctgaatgaagaatgttacgggcagaggatataactagtacaaggatcctaaagcagaatgtctctgatatgtttgatgaacagcaagcaggttaatgtggctcaagtgaattgagtgagggagagagaatggtgggaaataagatcagagaggtaaattgaaatgggctgcgtcactagtctagactttgtaggctagtgtaaagatttcttagtgtgacagagatgggaagtgtttacagagtagaatagtaatggttatatttgagtatttttctctttggtagttttattaaaacagatgtaacattgcagttttacaaatcacatgattttcaatttagttctatcataagttcataaacttgaaaaaaaatactacatcaagcttttattttaaaatgtagataaacgttacagaaaaaaaattgccaagcgcaatggcacatgctatatagtccagctacttgggaggctgaggtgggaggatcactggagcgcaaaagtttgaggctagcctgggcaacgtattgagaccctgcttctagaaaaaaaagaggcaagatttttaagctgaagtactcttaggaaatatttcacatgagcaggtattatctttaatctgctttttattatcatggttaaattatgagcaaagctcataaaatgcaataaatgcattttgtatttcttgcaagttagcagtggtgttaaatcttaaatctctgatctgtactaatatcatcaactcctactgagaattagaataacagtagaaactttgggaaagattttaaatgacaacaaagctaaagggtcagaatgtcgtcgtttcaaagcaattttcttagttgtaataaaggtaaatttaataaaagtaaaagcaatctgctcccagaatgttacagtattttgttttgaataaatttatattatctggaaatcaatatggctcatgttgcacaaaaaacaaggtctgaaaatagtaatgccctagagttccagtaggaggccatcgccttgaactgtttagaccaatatgaaaggctacttcctggaagaaacaatgcttctcagcaagatatttcttaaaataccattttcagaattatttgtagccactataataaaactatcagtaaattgtcagattgttcttggcattggtgacagaaaaactgcacatatttactggactgcatgacaattaagaacagagtttttcatgattaatgggttaaaaggcaagagttttgaatgaacttaaattgggcaattctcaaatctttgatgattttattatatgtcatcctgaccacttttagctggtttaatgtaattttgaaatgtttccctaaatgttacatctgttaatagttagaaaccagcttaaattcccattaagttttattcaacaaacctaaagcttctgttctgagaacctcataagtaagtaccctctgtgccatagaaggactaacagtatacttcaacattttacaattggttttgaaaattaaaaaatatgtaggctccccaggagttcatattcaatttaacaacatcaattctacttaagacataaaaatctatttctactggcaacaagatgaaaatctccagctcatactccttatatggggtaaacacccagggaatgattccagcaaagcacagaaccaggtttgtgagggagagactgggctttgacatagtaccactggataatacatacatcagtaattgtttctgtcacttacaaatatgtatctgtttaatgtcttcagttgtttagacgaacgatttggatgatcctaaatttctttgaaacttttacatttagagttccaaaaatttgtttttctccaagattaaagcaattctagcatagtagcagcatgctgcatcaacaagttgatttttttttaaagtgtatgtcttctattgaagagctcgatgaagttcttaactgttgtctctttaattaaacagagaacagcaaagcttgtttttttgccaatcgcaaatttatactcaatttaaaccatggcttttaacaaaattcctatactaaaataactcttcacacaagaatcttagtggattttttataggttcttggttaaccagcaaaactcaacaaaatttgttggcattagtaacaaatactttttaaatatgcttctatttctcccatcagaactttgatttctcttcaaagaagcctcatcatagacttactcacacatttgtgagagttattagaattgccataatcaatggatactgaagaaaagggaagatttgagggttggtttttgtttttaatttttaaaaaactcgtatcatgattctggagctaaaagcagctcacatgggccttatatgagctttgcctctctttgagcagtacattttaaaagtcaggaagaaaataaaatctgactcttgtagcatttagctttgtattggagtggcctttgcaggtaatgccaacttccacgacatttagaagattcataaagtgctggtcaaaataatggaaaaaatagcagctgtcatttgatcagaatctgtgtgcaaaccaattaaaagccctgtcataactatttaagcatgtaaggtgatttatgattacctttcataaattaatgaattctaccaataagagcagggtgctacattgggtgctcctgttctcgcagagtttacagctacacattacatgaggactgctccaggtttgctgtgtttaaatgattgacaaggcagaaactttgtcttttcttcaactgattggcactatctacttataacttataacttagcttatttttcactcccccccaaggagagtagagtccagaatggccggtggtagtctcagagtagaagagttgaggtgtcataagataacgacacccttgaatttatttctcctatactttgctttataaaagtgagcacaaggacagacaggcagaaaatagtagatcactatgtgaggctagagagagtcctctttcaggttcaacaaaggaaagacagaagaaaagtgaataaggtacataaatataagaacataagtgtagacaggtagatgatgaaaaatgggagaaatggaagacgtaacaaaaaagaaaaaagatgaagaaaaatatgggaagagaaaggtaaggtgagatgaggagggcaaaagaaacagaatggagaagagagaaaagaatggaggcaaaggaaagaagggagaatacagcaatctcctcctgaaatctgcctgtcccaagcataaagattaattgtaatattttaattacaaattagcttttcctgagaaaacttcataagcacataattcttataaaattgtgttacctcaaatatttaaaatgctttctagtcaaatatttagggggtcatcattctccaaaactagctagccttatgcagctggtaggagttcttcacagctgttctttaagccatgttgcatgagaacttcatagagaacctgagaagttccattttaagagtttctcctgcttcggtatcctaggcaagaaatcaggagaaaggaatgagaaggaagaatcactagtgtcaagtgacacatgaaactccagtaaatctgggtattacttaggtcaactagagtaattcaacataaaggtagaatagttgttaagattttaaaagccaagtggtgatttcgaacttgtagctattgttctaatatgatgggtaatcacttcctgcaatggtgaactatttataaactgctggctcctcaaaatgtaaataaagaaaaattattccaggctacaagattaattttcctctatgtctttaatctgaggtagatccattttttgttaaaacacacttgttttatttatttagtcaaattcttcacattaagaaggaggaatctgagacccagtaagattaagtgactagtttatggtccttgggtagaacaggaatgaagcagaggtttccattcctaggtcacttcagaactactaattgaggttcatcagaaaaaagacataagccaaagaaattagaacatgaagttgagtatcatctttagtaaaaaggatctagtcattgcttccttataatattgaaaattagtttaaccgtaggtggacatttctttgaaatggtttctaccactaaaaataaaactgaaggtagaggattaggttagaccctggagcaaaatcaaaacagcttatttcagcctaagaacttttttaaagtaaatggcaagccccaaatacctacatatctgtaattttctgagccaccataaaatctgcatactctgtaccaaagtaaaaaacttcacttactgacacaacctttactaaaaagtgccacagactgtacgtaagaatacttttatttagagaagaataaaatacaagctgtctagttcttaatatggtaaaactctctatcctcttacactctgctttcttatttatttatttatttatttatttatttatttatttatttattttgagatggagtctcgctctgtcgcccaggctggagtgcagtggcgcaatctcagctcactgaatgctccgcctcccgggttctcgccattcttctgccttagccttctgagtagctgggactacaggcgcccgccaccacgcccagctaattttttgtattttctttttagtagagacgggatttcaccatgttagccaggatggtctctatctcctgacctcgtgatccacccacctcggcctcccaaagtgctgggattacaggcgtgagccaccacgcccagccaatttgtcttttagttagcctgaataaatttaacctctcagaggatccctcaactcatgtgaaaaaatccttaatagtttctgtcttacattaaacaaaaaggcagacctatgtcacctggagtcataggaccctgagttatctcctaaggtaactctaatgtacattccttaactctgaagctaacagctatgaaggtgaatgccgatagctgctgtaggtttcacagagagactcaatgattatgaagattctgaccgtatctaataacagacaacagataattgtacagtaagatttaggaaaaaaaagtcatttcagttttgaaagttttgttaaggtatataaatgcatatctgttgcctattagtatgatgatatggtagacaaattgcctttgtcaggttttagttttggctctgccattaattagctatgtggtttttgagaatttcagtcactttaacacatgtttatagatggttacataccaggcaccgtgcaagtcattttaacagttatcttaggaaatcctctcagcaaccctgagggtttgacattattattatcatcatcttacaggaaagagaactggggtttagattgagttttttctcaaggttcagtagctagtggcctgcttccaaagcttgtattattttgaaaagcagccagtttctggaactatgtccttaacaagtacttttgacccagtgggaatgaaaggggagtgcagaaagaggtatataggattccagccctcctacttctgcttcagccagagcaattgcctgttcattgttttaatatattgagcttttcaggtaagattttagaggggagagggttctgtagcattaaatgcctgatctcacagtattatgcttcactagaatgaaggggtaaaagtggtattaagctaatataagaaaagtaaataataatcgttggataggcttcaaaaaagaaatgcatttgagatggaccttgacaagcagataaaatcttgatttagttgaaggactccatctggggaaacattaatgaaagtgcttaaattttcaatgctaattaaaatgtttatttttaaaatgtttcctttgatcctgtttttctttattaaataataccctggacaggaattaagagcacagcctgaagtgattgtgatgtccaagaagtactactcatggaacaaatagacaacttgtcatatttcaaaattaaatgctgactgcactatgaatatagaaaagtacagttgtaaacactatattctgtaccatgtaacatcttatgtatgatttcagttctttttaagaccaccagactacagttacaagaaagccaagatcagactgactcaatttgcattacatacatgttcagggaaagcctaattagggaaaacagaaacttcaaatttcactcttttaaactgaataggagagtatcttacatccactgccagaaaatatcaccccagaagtgaaaatttacatgttttaatttctgaaataatgactttgaggaaaacagttagaaattataaaacatacaaattcctatttgtcacactatggagactttggagaatatgattctccaagtatcttggtgtttaaacaaataaaaatatagttcagccaaaaataaactagctcacatgaaaaagctgtagtattaaaaactgctacatcagaaagtcgaagtgagtattcagtaaatttattaacaagatatccctggattaatgattctatctcaagtcaaaaacattttgccaaagtgacagcactaacacctaccaccagtagtatgtagaatcagcttgaccttatttcagaacatctgagaggcactaaaagctggcaaaaccatcttaagagtatggagtgataggcagtaaactgcatttattctgggcttgaaccacatcaaggcagtttcagaaataaccttaaaaaagaggagccagagattaaatactatccccactccccataattaagatgcaatttgaaactttatctgaaatcattgagtcaatggaaagccgggaggaaaacaatgttaaatcaatatctgaaaagctgtttctactaaagatgtctatacacacacacatattatatatctatatatcatgtatttggactgattcaaggaatctgtgcttctcaaggcaacttcaagaactgttgatagtacagagaaatggatatcacagcttttttcttaaagaaaatataggttgaggtagggactggtaaaagaagagactgctttctttcattttttttcttttttaaaacaacttgtctacatcaccaggtatcagtaattgattcccactggacacaactacaggatacactccatgtttattccttgtgagaaataaacacagtaacaaattttcactagcatcattatgtagaacataaattcatgtttccttaattcagtaggtatttattagaaatctatgaggtaccaacatctatgtgaagtcctggttataatgcaaagaagccagtctagtgaatagacaaatgaatttattaaattaaaatacaatgatatatgtcatgagatgttcaagagctatgggggtacagtagagaaatatctgaggaggggtaaagaataggagaagtttccccggctgaatcttaaaagtaaggtattttaagatgctactataccattaccacttaacaagtaaggaaaaaaaaaattacaaaaaaaaaaaaaaaaaagaaaacagccatatgattacatgaaaattgaataccttctcctgaatgatttttaggtagacaatgaaattaaggcagaaatcaagaagttacttgaaactgctgagaacagagatacaaaataccggaatctatggaatccgactaaggcagtattaagagggaaatgtatagcactgaatgcccatatcacaagttagaaagatctcaagttaacttacaacttaacatcacaactaaaagaactaggaaaccaagagcaaacaaatcccaaagctagcagtagacaagaaataaccaaaatcagagctgaattgaaggagattgagataagaaaaatcattcaaaacataaatccaggagctggttttttgaaaaaaaaaattaataaaatacatagatcactagctagactaataaagaagaaaagagaatattcatataaacacaaaatattcaaataaacacaatcagaaatgataaggggcgattgcaactgaccccacagaaatataaccatcggaggatattatgaatacttccgtgcacataaactagaacatctagaagcaatggataaattcctcaacacagctaccctcccaagagtgaaccaggaagaaactggatctctaaacagacaatatcaagcttggaaattgagacagtaataaatagcttaccaaccaataatgtccaggaccagacgtattcacatctgaattctcccagatgtatgaagaagagctggtaccatttctactgaaactatttcaaaagttgatgagcaactcctccctaactcatcctgtgaggctagcatcaccctgataccaaaacctggcagagataaaacaaaaaaagaaaacctcaggtcactatgcttggtggacattgatacaaaagtcctcaacaaaatactggcaaaataaatccagcggcacatcaaaaagcttacccacccccatcaagtaggctttatccctgggctgcaaggtcggttcaacatatgcaaatcaataaatgtcattcatcacataagcagagctaaagacaaaaaccacatgattatctcaatagatgcagaaaaggcatttgatacaattcataccttcgtgtttaaaactcatagcaaactaggtattgaaggaacatacttcaaaatgagagtcttctatgacaaacccacagccaacatcatactgaatgagcaaaagctggaagcattccccttaaaaattggcacaaaacaaggatgccctctctcaccactcctattcaacatagtattggaagtactggccagggcaaataggccagagaaagaaataaagggcatccaaataggaagagaggaagtcagactatccctgtttgcagatgaaatgatccaatttctagaaaaccacatagtctcagccaaaagcttcttaagctgataaacaacttcagcagagtctcagaatacaacatgagtgtgcaaaaatcgctaggattcctatacatcaacagcagtcaatccaagagccaaatgaggaacatactcccattcacaatggccacaaaaagaataaaatacctaagaatacagctaactagggaagcaaaatatctctacaagaaaaactacaaaacactgcttaaagaaatcagaagtgacacaaatggaaaaacatttcatgctcatgaacaagaagaatcaatgtcattaaaaatggccatacttcccaaagcaatttatagattcagtgctattcctattaaacctccattgagattctttgtagaactaggaaaaaaaaaaaactatcttaaagttcatctggaaccaaaaaagagactgaatagccaaagcaattttaagcaaaaagagcaaagctggaggtatcccattacttgacttcaaactatattacagggctacaataatcaaaacagcatggtattagtacaaaaaaagacacatagcctaatggaacagaatagagaacccagatataaggccatatacctacaactatctgatgttcaacaaacctgacaaaagcaagcaatggggaaaggattcctattaaataaatagtgttgggataattggctagccgtatgcagaaggttgaaactggaccgtttccttacaccataaacaaaaatggattaaagactgtaatgtaaagcacaaaagtataaaacccctggaagacaacctaggcaataccatgcaggacaatggcacgggcaaagatttcatgatgaagacaccgaaagcgattgcaacaaaagcaaaaattgataaatgcgatctgattaaagagcttcagtacagcaaaagaagctatcaacagagtaaacagagaacctaaagaatgggagaaaatctttgcaaactttgcatccaacaaaggtctaatatctagtatctatacggaacttaaatttccaaagaaaaaaacaaaacaacctcattaaaaactgggcaaaggatataaacagatacttttcaaaagaagatatacatatggtcaacagtcatatgaaaaaaagctcaacatcactgattattagagaaatgcaaatcagaaccacaatgagatacccatctcagtcagaaaggttattattaaaaagtcaaaaaataacagatgttggtgaggttgtggagaaaagagaacacttatacactgttggtggcagtgtaaattgcttgaaccattgtggaagacagcgtggtgattccttgaagacctaacagcagaaataccattcaagccagcaatctcattgctgggtatatacccaaaggaatatattaataaaccattttattataaagacacatacgtatgttcattgcagcactattcacaacagcaaagacagggaatcaagctaaacgcctgtcactggataaagaaaatgtggtacatacacaccatggaatactatgcagccataaaaaagaacgagatcatatcctttgcagggacatggatggagctggaggccattatccttagcaaattaatgcaggaacagaaagcaacaaccacatgttctcccttataagtgggagctaaatgatgagaacacatggatacatacaggggaacaacacaaactctggggtctattggagggtgaaggtgggaggaaggaaaggatcaggaaaaataactaatggatactaggcttaatatctggttgatgaaataatctgtacaacagatccccatgacacaagtttacctatgtagcaaatatgcacatgtacccctgaacttaaaagttaaaaagataacacaatatcaaaattttatgcaatacctacaaatttaataaaagttgtacaaagaattactgacagaaatttcaagacctaagcaaacaaaagaatcatattcactgaccaagaataccacttttactgctgtgagtagaaaatattgtgctaagccaaaaaaaaaaaaataactgagcatttttctttaagctctataccagcatgtgctcacatcagaatatttattaaacagtcatccttctatgaccttgaatttctcttaattacaatttaggagtgcataaattgacttaagtgtagcttttggacagcattgaaagtttcagatacagatggatacagatggaactacaaggcagccctgtgagggataattagaaaaagtataatattaagagttaggcatttgtaaagcaggtaacctgtttgacagaaaaagaattaaggttatttacaacaaagactccggaaaggtaaaggaagataggagagagtaaagcccttagtgctgatctatgccaggtgtgcgagaccctagttaggtatcaaaatagcctgtacagttctgtttttgttgtaatttggttttgttttgttttaatacatttgtcctggtctaaagacttgcacaatttctgggagtggccttctgtatagcagttattcatacaggtctctgttggttctgttagagacaaagttgagttactgtggcctggctgtgcaaatactcttgttttccttttctaccaactttaaaaacaacactaaaataaaaacaaaatgtgtcatgtgaagcaactcatgtatgttgctatctcttggatccggaaatatactgacaaaattgaaatggaagaccagagacagaaaaaaacaaaaaagcaatttctcaccatgcatattatttgaaacaaaagaaatttaagttactgacatcttgtttgaacatcttgtttggagatttctaaaatcaagtaataataagtaacagtaaatggtactgtgcccattattatacttttaagctgtgttaaatgttaatgatattgtctttagcaatttttattgtttttagtgaaagaaaaatatattcacatcagagcatggttaccattcatattcttcctttaaagtcatatttttcatcataaattcttattaccttggtatatttgggactgctatggttggggctatttcagataacaaataattgcaaagaagtatttacttttcattgaaatattctttaattttgttttatgacaggattgaggtatgccctcaaacattatttcagtgattattgtagataagtattcgaatctttcatctgttggatatctggataaatcaaatggcctggccatggcaaaccacaaaatccagtttcgtagagctcatttgtttcaatgaaagattttaattaatcatattggttgcatcacaatgattttgaagttactttgatattaaataaaaaagaattcttatataagcaatggtaataaagtactaaagtattaataaagtattgagaatttgaaattgactagagaattcaaaaatgagaagagacaagtcaaggtaaattccctcatattcacatctacaccttatgggttacaaacatttgaattctgaaagataatgctggcacgactgtgatggtcaatgggtttatatcaaataaactatattgtagtttataaaatggttttctcttactatagccaattaaaatcttaaaaatagagtgtgtaatgtagtacagattttaagttgcctttatatggcttatgcttcttgttatatttgtgttttggggggaattcttggcaagagattaggtccacatctgattttatgaaatgaatcaacaatgacagtaaagtaataaagtcaacataatgatttaattgtctatgattcacataagtcacttaacaattatatttgtttagtggtatgtttatcataaagttaatatgtttccagattgttcaagttttatattgttatatttttcaaatttcattttatgaataatgataatttatattccctcaaacttccatgtattaccatagttgatcttttctgttcattctctgttttgaaagaaatctgactttttactttcaaacatctagttttcattatcttggagctaattcaatcgctgtgatacctggaaaaaattacattttttatcttttagtttgtaaggagacttttgaacctgaaacagaaactgaatatttttgagattcactagatggattggttttcttaatatgcatttggtatagtaataataacgtgttatctttcaggtataattttcaattcatatgaatatgaacaatttatattgaaatgctgtggcgtttttatttgtttagttcttagaaagggtagctgttctatgggtttacagagacaagatttttatacataattggagatactagatggaagtagtttggctaaaaaggaaaaaaaattctatttgattgaagatggagggctgagcatacatgatgacttcttatccttcctgacacctcacctcatagaggcatatacataaaggaatagatccatgcagcaaagaaaatcagagagacttactagcacttggtatgttttcaagaaattactaggagaaggaaaaatgggaatgagctaactgatggaacaagcagtgcagaggaggagatgggagggaactgatcagcctgcctgaaccttggagagtctctcttctgagaatctgcaaggatgaagatacagagctcaaaacaggagactcaattaaaggaccatatctgcaactgggacaattggctcacctacttcacttttacaacccagattagaaaccagtctgatttcagttcttctgagcaatgaaccatatgggaaagggtgacgtttctgttgtgcctcttggcatgccactactaagcctacattattctggcttgggttggggggtgcagttttcctaccagttcctgccttaagtgaaattcctgcctaaagtgaagcttgcccgtatccaaagctacccatgtgcacagagctcctagttaatgctaccaagtaggcaagaagataggtgcaacctgtttttattattatgcttgttcattgttttctgaagctgtcatttcaaatgcttgatttttccattatgttcttaccttcagtttattgttcattaagtatttgttccccattacacagatttttcaaaaattaaagcagactcttttctttttatttatttatttatttatttatttatttatttattattatactttaagttttagggtacatgtgcacattgtgcaggttagttacatacgtatacatgtgccatgctggtgtgctgcacccactaactcgtcatctagcattaggtatatctcccaatgctatccctcccccttccccccaccacacaacagtccccagagtgtgatgttccccttcttgtgtccatgtgatctcattgttcaattcccacctatgagtgagaatatgcggtgtttggtttttttgttcttgcgatagtttactgagaatgatgatttccaatttcatccatgtccctacaaaggacatgaactcatcattttttatggctgcatagtattccatggtgtatatgtgccacattttcttaatccagtctatcattgatggacatttgggttggttccaagtctttgctattgtgaataatgccacaataaacatacgtgtgcatgtgtctttatagcagcatgatttatagtcccttgggtatatacccagtaatgggatggctggatcacatggtatttctagttctagatccctgaggattcgccacactgacttccacaagggttgaactagttgacagtcccaccaacaatgtaaaagtgttcctatttctccacatcctctccagcacctgttgtttcctgactttttaatgattgccattctaagtggtgtgagaaggtggcaaatctcattgtggttttgatttgcatttgtctgatggccagtgatggtgagcattttttcatgtgtgttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggctgcctgttcactctgatggtagtttcttttgctgtgcagaagctctttagtttaattagatcccatttgtcaattttggcttttgttgccattgcttttggtgttttagacatgaagtccttgcctgtgcctatgtcctgaatggtattgcctaggttttcttctagggtttttatggttttaggtctaacatttaagtcctgaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagctatgtggcattatttctgagggctctgttctgttccattgatctatatctctgttttggtaccagtaccatgctgttttggttactgtagccttgtagtatagtttgaagtcaggtagtgtgatgcctccagctttgtccttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcatgatattgattcttcctacccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgctagtgttcaaagtgaaagcttccagtttttgcccattcagtatgatattggctgtggatttgtcatagatagctcttattattttgaaatatgtcccatcaatacctaatttattgagagtttttagcatgaagcgttgttgaattttgtcaaaggccttttctgcatctgttgagataatcatgtggtttttgtctttggctctgtttatatgctggattacatttattgatttgtgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctttgcccggctttggtatcagaatgatgctggcctcataaaatgagttagggaggattccctctttttctattgattggaatagtttcagaaggaatggtactagttcctccttgtacctctggtagaattcggctgtgaatccatctggtcctggactcttcttggttggtaagctattgattattgccacaatttcagatcctgttattggtcttttcagagattgaacttcttcctggtttattcttgggagagtatatgtgtcaaggactttatccatttcttctagattttctagtttatttgcatagaggtgtttgtagtattctctgatggtagtttgtatttctgtgggatcggtggtgatatcccctttatcattttttattgcgtctatttgattcttctctctttttttctttatcattcttgctagcggtctatcaattttgttgatcctttcaaaaaaccagttcctggattcattaattttttgaaggtttttttgtgtctgtatttccttcagttctgctctgatcttagttatttcttgccttctgctagcttttgaatgtgtttgcccttgcttttctagttcttttaattgtgatgttagggtgttaattttggatctttcctgctttctcttgtgggcatttagtgctataaatttccctctacacactgctttgaatgcgtcccagagattctggtatgttgtgtctttgttcttgttggtttcaaagaacatctttatttctgccttcatttcgttatgtacccagtagtcattcaggagcaggtggttcagtttccatgtagttgagtggttttgagtgagattcttaatcctgagttctagtttgattgcactgtggtctgagagatagtttgttataatttctgatcttttacatttgctgaggagatctttacttccaagtatgtggtcagttttggaataggtgtggtgtggtgctgacaaaaatgtatattctgttgatttggggtggagagttctgtagatgtctattaggtccgcttggtgcagagctgagttcaattcctgggtatccttgttgactttctgtctcgttgatctgtctaatattgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttagcaggatgtaatggccttctttgtctcttttgatctttgttggtttaaagtctgttttatccaagactaggattgcaacccctgcctttttttgttttccatttgcttggtagatcttcctccatccttttattttgagcctatgtgtgtctctgcccgtgagatgggtttcctgaacacagcacactgatgggtcttgactctttatccaatttgccagtctgtgtcttttagttggagcatttagtccatttacatttaaagttaatagtgttatgtgtgaatttgatcctgtcattatgatgttagctggttattttgctcgttagttgatgcagtttcttcctagtcttgatggtcgttacattttggcatgattttgcagcggctggtactggttgttcctttccgtgtttagtgcttccttcaggagctcttttagggcaggcctggtggtgacaaaatctctcagcatttgcttgagcagactctattttcaagagaagtagttgagtcttaggagtctgcagaaactacttttacctctgaagacatttgctaatatgttgatgggatataatttaggaacaattagtgtttacattttatcattttagtttgaatttaataatagcataagctaacactgttatttaatagtgtacgtaaatgctaactgaatatatatgtattcagttacttattctttatatcttacaggcaaaaaagatacaacccatgagtgcttactttttcgggttgtaccttttttgcctgtaagccataaagagtattttattaaaacattaagaaatgttagtctcattaagtagaagagaagaacataattcttatttttaagccatttagtagtgggaattgaatgtagtgttcagaaacgttgcagttagatccactcttaatttttctcatttccttaaatttcatggatatgcatattgagctattttcgtattcaatctcagctaaataaagtagcgcaaatatgcatgactgaaattaccttctataaaaagttccaaaagcatttgaaaaatatcccacgggtgataagtctgtaatattttactttattaaaatgctgtacctggcttctgagtggttatctaagaagaagaaaagaatctacagtataatgagagttaaccatgttttgtccaaaatgattttgaatcaccgttcggacagatcttgaagactagtggaaacttcaaatggcagtatcgaacttctgttccttttggggttgttgagtatatgaagaatattatttttctgtgtctgacagtcggtagctttgacatgattatagtgaagtataatttagatgttagttttaactataatagactgtaactccttgtattttgggtgctgtagaaattacctttccctttgcatgtacgtgacagttaagatctgaagaatcttgattaatggttcttggatttatgtttaaagaaatcaaggatgggcatttttctcatctccgtctttggcatttgaaacagtatacaggttgagtattccttatccaaaatggttggaaccagaaatgtttcagattttggattttttcatattttgtaatgttttcatacacgtaatgagatatgttgggatgggacccaagtcttaacgtgaattcatttattttttatgtatatcataaacatataggttgaaggtaatttaatgtaatattttgaataattttgtgcattaaacaaagtttgcatacattgaatcatcagaaagcaaaggtatccctgtctcagccagccacgtggatactctgtggtgtttggcatcactgtcattcctgactctgaatttgtatgctactgataaacaactcttttattagacttactcacacatatgtacttaacagtgaaaaaaatgagttcagagtaactaagcagcataatagcatcaaacaatggcaggctttcatactttacctacagtgctgtttttgttaaaaggttactctactctgtattttattttttttaggtaagaagaaatattggaaacatttgagagatcaagaaatgggtcctctagggatgaggagaccttctgaataaactatgtcctgtgttcctgcattttgacagcaacccatcacataaggccacttacggaattttctacttgtagtgtcatgtcagtgctcaaaaactttcagatgttggagcatttcagatttcagattttcagattagggatgcacaacctttacaaagggcctttatagagattttaaatatataacttgttgtctactgagtaaaagatgggctgcttctgtttttctcctaacagtattttcagcttctgtactaaccagttccagatgttccacgataaagaaatatttaattttcatatgaaatttatgaaaggaaaatgcataggagggcattttagcaaaacaataagacaaaacagcttttgacagttggtttgctattaataagtacataggagtacacagtaaatggaaggctcatttagacccttagaatttttcttagcagggggccctttacctgaaatcatggtactagttttaaacttcatgttcttttttgtaaagacatttaaggcgatcagctcttttcaaaattaggttaatttttcagaaagaaataatatatcaaataaaaggaatattatggtgggttcagatgaattttaattgaaacataagcaacagaaaattttaagattcttatatgtggaccactttgtataatgtgcctacaaggtaaagattttgtggtcatctgaattttgggagaagtaattttccaagaattaatacttaagctttttgaatcacagttttgtatacccaatttcattatttggttctgtgcgatatagaatgttcaaggctaactataatcatttttgtccaatttgttttaaagagggttcagcagctccaggaatggtataatggtgaatgatgtttccatatcaatacagatctacaaatatgagtatatttgaagaaaagcaaattcatattgaatttaaaggcatataaattggatttcttttccattcatggacatctacttgtataaagaataaaaattacagtttgaatacatccaaaaccttttctcttaccgaatttcaatactcttttctaacaatgtcttagaattttgtagtatatctattcctcccctagataagatctgtagcacacttactctcttcctccctgttactatcctagaatgcttttgtattttaattttagattatttccttttaaaattatgcataaataattatttaaatttagcttcctactttttggacactactattggacaccaccacatctttttttctctggattgatttttttttgttttactggagttgatcatttaataattcttagattgtatctgaaggtattaaactagcctgtttttgcatgactgaaaatgtatatttattctcacttgattgctgattagacttgacatagagtcctatgtttaagtcattttatcttagatctttgaaaatactattctattgacttttctgatattgctaaaaagatttctgatatcaatataatttttgtaccactgtagatgaccctttttcatcccttcgtcctctttctttctctttggaagattttggaatttttatccttggggtttgatactacgctaggatgccatattattaatgctttgcctcatctgcctctccctgcacctctgcttttgtctgaaacccgaatctacctttagctaagggaaattttcttctttcatttctgtgattgctttttctactcagttccgttttattctttttttcagtagctactagaacttctagatctatcctccttttctcttactttatatttcctcattttgcaggggattctgaataatcttttgtctttgtcttctatctcaataattttatctttagctacgtcctttaatttttttttttttttttttcctgagagtctcgctttctcacccaggctgggatgcagtgatgcaatcttggctcactgcaacctctgcttcctgggttcaagtgattctcccacctcagcctccagagtacctgggattacaggtgcacgccaccatgcctggccaatttttgtatttttagtacagacaggatctcaccatgttggccaggctggtcttaaaggtcctttaatttttcattttcttttttaaggctttgtattgtcattattttgttagtcatgtttttaattttgtagcagtcttttccataattgtttttttttgtctgtgtgctatcttttcaaatctcactgagaattacaattatatttaacgttttcctctgtttcttttactctgctgagtgttatttcttcaatatgttaagtttggtgactttcttgctaatttttcctcaagtgtttggtgatttttggttgtttgttgtttgttgaatagttgagagcctaggctgaacagtcttggtggctggagggtatttatttcatcagcccaaatgagaatccctttttacttcttgtactatgtagattctcattacagaagccttcatccaataactgcagggcaaaagaagtgggtgtggctgggcagggtattcccggttgtagaagtttttcacctgggtttcggactacatttccataaattggctgctaccttgttctgtttctctaatctgggactctccatagtcagaaattgcatttgggagaatgtactcctgcttttgttatttattgaccatgagctttgagtttctctgagcctctatagcagactcacactttcttgttttagctgcaggtttctccaatgtgattttgcctttaaactaatcacatctcctctgatttgtgtttgtttacagagcttcttcaaaatttttggtctgcagtggtattattttcctgcactatcattctttcttctttttagtaatatattttatatggaatttgaggggaaaggaaagaggtaaatgtgtcctcattggccatccattcttttttaaagtaaaatggaaaaatacagattttgaaattaagagaactaagagatgatgaaaccatttcaatggagacttatcaacatattatgaagggaggaaaatgtgctgaatattgctgatgtttaatgaatttagaaaggacatttatttagcattagcctctgtcaccaatttattatttttccctgtggaaactaatgactttggagaaatttcttgggtaatgtttattgttagtcatcctgtttaagaacaacttgcttaaggtgatatttttatttcatggtagcaaatggattgttttgacatattcagtgtggacccatttaaagtaggcatgttattttcaaaagtgccatggcatgtcagtatcttgtaaattctaacttaaccaatattaaagaagtaaaccttcatgtactttaatggagatcacaaaaggacttcactgtcttgttctatgcaagatttagtaaaaacagagtattaggtgttatagtaatggtcatgcaaagcagtagctcatctgtacaagaaaattaatggtcttctaaaatggccagagatttgtttataacttcattttaattaattacatttttggaaaatgagttgaatttaagattagaccccaggcttgaatttgtcatattttttataatggtattttgaaacaaagtttgctaatagatgtttaaaagagagtaagaaaatatttacatagggtttatttgtggagtaagtattgtgtctttgtcattattcaaaaatagaaaaaagttgtgaagcaacatgttctctttgtgaatgttgaaaattactaacagatctgtgcgattggttttgtatgccttgtgaagacttgccaaatttgattttatttttctcttttacttttttctagtaaagccaagtcctacttgagagacatcagtagcctatggaaatttgttgcttttctttgaaaagtgcacctgcatccaaaactgagtaaaaacatatttcaggaagaaaactataactaattaaatttctcagtactacctaatttgccaatataactagttttggttaaaaagaagttgattataatgttcataactgtatattgaacagaaaaactggatgcaatcagaaatcataggtgtagtcaaggagatgaaaattgtagatgtgaccgttgctatttgcttttaaggtttcctaatcttgcctagcgtaatgactgagttttatgggtatttggaggattttcttgttccaggtggtggtcgtcctccttattttattttttggtaaggctaggagtaatgtagatgtgtattcttctcataacttagtaaaactcttttatcaaattggtcagtgcagcctgcagctggggacttctaaaaacatgttaccatgactagaaatttttatttcagtgcacttacttgacatctttctggttattattgaccaaaacacttgactcctgcctcttctttctttttatccattttgttgtccttattttgcatatttttgcatatgtacagatttctggcttcctcattcctatcaacaaccagaataacttttagtggtctaacttgtatcttcacttatcaacttaaactgttctttttgaaatgttaccagtgggttcagtgctcctgtctctgttctctgtctctggatctctcttcaacctttggttccactggccagccattcttaactgtttcggtttcagaaatattttttccctttagttttataataataattagctaatttttcttgagcacttactttgtatctttgactattctaagcactttacatgtcatatgatctttaacacaatccttagagatctaagtttgtattattttttccactttcagataaagaaggtaaggcacagagaggttaattactttgtttgaggccacactaataagtggtagaatcaggattcagacacaggcagtctgactaaagagctggtacttttcctctttagatgctatactattctgatgagtgtctcctctcatctttttctgtttggatctagttgtgtatattttcatttgccctacacttacctggttaggttaaaatttctacatccctcaaaactgctgaagtatcagttaaaaatatagttttcaacagaatagaagtttaatacatgttgtgaaccaatttcttcgtgttgccttttgaaattaaatttaaagagagcagtcattaatggctcaaagttagacctaagaggatttataggtgatgtgtatatgtgtttttgttttatccatcattcttcagtttcttaattaccaatactataccaagacaaatgcctgcatttcatcattaaccattaaaatatgattttcttagagttgaagattgaatttagggccagttttttcaagtacattaattatgtttaaatgtgtaagtctactcattataaaagtgaattattttgtaagtgttggttattaagtctgtgtattcccaagattttcagtctgaagtgagctgcagatacaatgcctaagcattttgtcctttgtattttgtaccagcaaaatgaaaatcattttttatagcctcattactcattcccaaaatgacctgaggtaccagttaggtccatttgcacaatatctggcaatatttctatgtcaaatatgttacaatctggtatttaaaatggccactgtaagtattatcaggcactattgttcctttttaaaaaacagtataaaatttgaaaacagtgctttggaaattatgtctttagtggctgtaatataaatggttaaccttacaaagggaaaacatgaaattgtttgaaattggtttatattggttgtcatgctaaacatattttttaatagtttgcttatttggtttgatattggttgtcatgatttaaaatgctatggttgtgtagaagttcttcacgaatatataagccgtttttacttacacatatattttagaaaatgaatagtttatatttttgctgttggaggactttttaaaaacatctatgaaacactaagatacgtctgaattggagctgaggactaagctctcatttatcttgcccaaattcctacataagggatctagagagtcatgccctacaaaccataaattctcatcagatgggttttatttgaccctatgtatcatgacttacttttcaatctgactctggcataacattacgagacaaggaaaaaatatttaaccccaaaatatatttccttgccataccttgaaattgccctgcaaagtctcttgtgggaaaaatccacatcttatagagaatcccctttcctctttgttttccttcctttctttccagatccaggcgataatcaactaagagccaggcacccttttaggtccgataagaaacattttacagcctgctctctctctgaagtctgctctctgagagattcctctgcccaataaaacttggtctccacaatcgtttttcttaacttgaacattcctttccattgatcccaggtcttgagataaactcgaccaattgtcaactagaaaatatttaaatttacctatagcctggaagctccccgcgcccctactttttgttctcctgcctttctgaaccaaaccagtgtatttcttaaatctatttgattgatatctcatgcctccctaaaaatatataaaaccaaaatgtaccccgaccaccttgggcacatgttctcaggacctcctgagggctgtgtcacaagccatggtcgctcatatttggctcagaataaatctcttcaaatgttttacggagtttgactcttttcgtcgacagagcaaaccgtacttcctgaaaagattaagagttagacagctagactttattcagagtgtgaacctatgtacctactatgtaaaatgcaagagctttagagcctttaactaaaggagtggcccctaaatcaagtcaaactcttctgtttcccaactacctcttgctgtataggagccatctggctctgctttctcaggtgtacattcttagaggaattttagtgattaaagtacaggccttggtgctgggggaagaaagagggttttcttctgcaggtttgttaaactgtaattcaggtcaaatttcgaatatacgtatgaaggcacaaaagtgtttaatattttagtttattccctttagtagttacaaaaattactgcttagtgaaaacttagcatcaggatatcccttcactaaaatctaggtctgtaatttgacaattcatttcacagcacctgacattactgttacattcactgtagcacttagcatgcaaagattatattttctacaactctcagtctcctctgttattggatgatgcgagcgcattaactacaaagtcacgtaaaggtcaagtcaaggcttaatttgaaaacagaagcctgagacccatccgtttacataacagacacagcactgtggtctcctgtgtgactgttaggtctgagcactgccccatattgctaatttctcacattgcttttcttaacattttttttctttaggagcttgatggagagatataccatttctgtcaggttttgcaaaatgtcttgagctccttgaaaaatagatgtcatgtaaatgcaaagtacggtcagttcttttagcctaagacattatttgatttttatagcaagtctattccatgtaaatgacatgcagtcatatagcttaccatgaatacgttcatgtcctaaaaatctcagatactgcctatattcagagtagctaacatttaattttgttttcatgtgttctttgaaaagagtagggaaaatgttttttatattattatggcttaatctctggatttggtcaccagtgaaatgaatttcatagcctcattctattacagacattttgtctgcttcgcaaaataacacaattttgcattattggtggtctgtgttcaagagacattacatctaaagagagctagaaattgcaatttaatactaagcaatgtgatgtgggaaaggaggccaactctccacatgctctttctgctagagcataatattctgcatattgacttttttttcactatccccaaaagtcaggatttttcattaagttctgataatactgttgaaattgaccttgattattcatgtaaagggcctctcagacaacctataggtatgagaatagctttcagaattgtaatcatatttaggttatatttaagcagtgatgttacacacttcccaaaaagtaatttattgggacatttacataactctgtgtacttaaatttatctacttattgcttatttaaaacattacatatgagagtttgtgttttccttactcaccattttccatacggctttattttcctcttagtttgaaaacttaaaaaaaattcaagttaacaagcatttattaaacatctgttgtattcaaggccctgggctacgtacatgtggaacataaaaaatgatgatgatgacagtgattgcaaacacttgcaataagtcctcatattgctgtcaagtaggtgctgttgttatgccatattacaaatgaagcagatgagccatagaatatttcataatttgctcaaggtcacacagccagtgatttgagaagactggcttaaaacacatgcagttcgacaccagagatgacactcttaaccactgtgctatactaaaatgaagacaagatcctacccttaagaacctttcatcctactagaaaagtggtaatacatattcagagaaaaaaacaaaaagaaaacagtaagtcagtatgtgttaggtgctgcattactggctcaaatatggaagacattggtgctcagaaagagatgtatttcttttgggaggtggggaaggcctcctggaagaagtgttttagctgacccttaaaaaagcggcaggattttgtcaagtgaagttaattagaggaagaccttctccttaagggggcaatgagaacaaaggcattgttttcaggaaaatgcagtgcccaaagttaatttgactatatgaaaaagaaaaatatttatacctatgcagacctttgaatgtaatgcatgttttcatttaaaattagaaatttatataatttttgaggtattatggatccaaattgtagattttttaaaggttaagctgttatatttttctttttaactaaaggggtatatttcaatggaaaggagttgcccaaactgaaatccgcagcgatgctaaggaataacatttatttcatatgaaaatattgtaaaatattttatggatattgttttttacatctaatcttaacattatctgtaagctgaactttgatgcagtagtagtaaacctactttctacaggaactacttctattacactctttaatttaaatctctttccataacctgtcaatatttaaagtacaacaaaagatagttgcactcagaataaaaatttgttttcacagagaattttagcccattatccctgatgaacatcgatgcaaaaatcctcaataaaacactggcaaactgaatccagcagcacatcaaaaagcttaaccaccatgatcaagtgggcttcatccctgggatgcaaggctggttcaacatacgcaaatcaatgaatgtaatccatcatataaacagaaccaaagacaaaaacgacaagattatctcaatagatgcagaaaaggcctttgacaaaattcaacagccgttcatgctaaacactctcaataaattaggtattgatgggatatatctcaaaataataagagctatttatgacagacccacagccaatatcatactgaatggacaaaaactggaagcattccctttgaaaagtggcacaagacaaggatgccctctctcaccactcctattcaacatagtattggaaattctggccagggcaatcagacaggagaaagaaataaagggtagtcaattaggaaaagaggaagtcaaatggtccctgtttgcagatgacatgattgtgtatttagaaaacctcattgtctccagcccaaaatctccttaagctgataagcaacttcagcaaagtctcaggacacaaaatcaatgtgcaaaaatcacaagcattcctatacaccaataacagacaaacagagagtgaaatcatgagtgaactcccattcacaatggcttcaaagagaataaaatacctaggaatccaatttacaagggatgtgaaggacctcttcaaggagaactacaaaccactgctcaacgaaataaaagaggacacaaacaaatggaagaacattctatgttcatggataggaagaatcaatatcatgaaaatggccatactgcccaaggtaatttacagattcaatgccatccccatcaagctaccactgactttcttcacagaattggaaaaaactactttaaagttcatatggaaccaaaaaagagcctgcattgccaagacaatcataagccaaaagaacaaagctggaggcatcacattacctgacttcagactatactacaaggctacagtaaccaaaacagcatggtactggtaccaaaacagagatatagctcaatggaacagaacagagtcctcagacataataccacacatctacaaccatctgatctttgacaaacctgagaaaaacaagcaatggggaaaggattccctatttaataaatggtgctgggaaaactggctagccatatgtagaaagctgaaactggatcccttccttacaccttatacaaaaattaattcgagatggattaaagacttacatgttagacctaaaaccataaaaaccctagaagaaaacctaggcaataccattcaggacataggcatgggcaaggacttcatgtctaaaacaccaaaagcaatggtaacaaaagccaaaattgacaaatgggatctaattaaactaaagagcttctgcacagcaaaagaaactaccattagaatgaacaggcaacctacagaatggaagaaaatgtttgcaatctacccatctgacaaagggctaatatccagaatctacaaagaacttaaacaaatttacaagaaaaaaatcaaacaactccatcaaaaagtgggtgaaggatatgaacagacacttctcaaaagaagacatttatgcagccaaaaaacacatgaaaaaatgctcatcatcactggccatcagacaaatgcaaatcaaaaccacaatgagataccatctcataccagttagaatggcaatcattaaaaagtcaggaaacaacaggtgctggagaggatgtggagaaataggaacacttttacactattggtgagactgtaaactagttcaaccattgtggaagacagtgtggcgattcctcaaggatctagaactagaaataccatttgacccagccatcccattactgggtatatacccaaaggaatataaatcatgctgctataaagacacacacatatgtttattgcggcactattcacaatagcaaagacttggaaccaacccaaatgcccatcagtgatagactggattaagaaaatgtgacacacatgcaccatggaatactgtgcagccataaaaaaggatgagtttatgtcctttgtacggacatggatgaagctggaaaccatcattctcaggaaactattgcaaggacagaaaaccaaacaccgcatattctcactcataggtgggaattgaacaatgagaacacttggacacagagagaggaacatcacaaaccggagcctgttgtggggtggggggaagggaaagggatagcattaggagatatacctaatgtaaatgacgagttaatgggtgcagcacaccaacatggcacgtgtatacatatgtaacaaacctgcatgttgtgcacatgtaccctagagcttaaagtataataataataatttaaaaagataaaaatgcttaaacagaaaaaaaattggtttttactgtcatgaatttttcccacgtttatgtttattaacaactgacacaaacaaaacctgtacagaaagtactctttattatacactttatttcaaagtactgaaatagtgttttatgatcatagtatttctagaggaaagattttctcccaagcctttaaggggaaagctaatccacttggagaaattttgggccacccaccaaacctgtgatttcctgccccaatttatgaaccaagttatactgagatcgttaaatggtgtgatttctccttatgactttcacattttactttataggttatattgacttttagatttcaggtagtaaaataaaaaatcttatgcagttcaagttagaaaaattggattagtccaagtgatattttcacctggtattttttttcaggcatttcaatgttactttttattacatttataaaattatatgttttaaattgtatggttttcccttatctttttgaaaaataccatactgattcatctcaaatattttagcctcttcttaagtttccctttcccctcaacttttccgtaagcgcacaaaagaaagtattgatttttgccaattattttggttgctgaggttgtaagccatcttggtttgcttacatgtaggttattaaagtacccttcctagtctgacttgccagtcttacttctctaccttttgttagaggaataagggatgaggatgagagaattaatatatattttttaccccatttctgcatattttaatcccatctccagaaaccaggttaatttcacctctgtcacaaatttgaaaggaagggaaaagatgtattaattgccatttttattgttattttctgactttcaagccttctaatctaaggttagtaaatggacagcatttaaaaaaatattcttgttatcttgacataatgaagaattatgtttttgagtattttgtccattgtttcttatttcctactttacatttttatttacagcaaggttttatccttttactaaagggaaggagatgggatgaatggcagactttaactggatgctttatttaggcttttcgaaagcaaaaaaagtttatacattgttacagctgggtgttgggttacaggctgtttgttatattcatgtattagttcctgttattttaacattttaaatatttcataattgaaaaaggaaaaattagactgggaccagtttatagaaagctttaacttctaggcaaaaaaggtagaactttacagttggttgtggagaagatattgactgtcttttgtagagagtagcatttcgaaaaactgaatttggcgtctgtatttagaacggtctagagaatggagatactgatgaaaaggaatgttagcaaattcagcattctgatttctgaaaaatgagtgcttagattaggtagtggcatggggactagaaagaacagggatgctgctgctttgtataatcattcccattatataaaggttatatataaattaggacggacacggtggctcacacctgtaatcccagcactttgggaggccgaggtggatggatcagctgaggtcaggagctcacgaccagcctgacgaacatggtgaaaccccatctctactgaatacagaagaattagttgggcttgatggtgcatacctgtaatccgaacactacttgggaggctgagacaggaaaataacttgtacctgggaggtggaggttgcagtcagccgagatcacaccattacactccagcatgggcaacgagcaaaactctgtctcaaaaaataataataaagattatatataaataaataaaatcacaccatttaacaatctcagtataacttggttcataaattggggcaggaaatcacaggtttggtgggtggcccaaaatttctccaagtggattagctttccccttaaaggcttgggagaaaatctttcctctagaaatatatgatcataaaacactatttcagtactttgaaataaagtgtatattaaagagtactctctgtacaggttttgtttatgtcagtttttaataaacataaacatggggaaaattcacatgatagtaaaaacaattttttttcctgtttaagcatttttatctttttaaatttttatatatttaatatataaaatatatataaaatataaatatatatttatatttatgattatataaaattcctatatctttatattatcatttccataaccattttagtaagcatccccaaatagaagttagggtgtattactaattctgcttaatatactttgtatacttttgtttcctatctcaaatctagtttctattatgtaagtataagtaccctccatgaattgggttaacattctaaaccatgaccagactgagagcatgacgactaatgtggtttttactcctaagctaccagtatggaagatcaacatttaagaaggcattagtcatctgtgctgctgaaaataatggtttcacattagtctggaccaattagaaggagcctatgtctacttggaagagtttgatttgcagcatagtccttggctgcttctacaagacttggcaaacttttgtttaagtcagaccctgcttaaatgtctaaaaggaaactcttaggccattatttccccctactttacataatattgctccatacaaacattccacttttacaaaatcatttactttttcccaactctgtgatacaaatgagttatcttttcgtaaccaccaacctctcagttttatatttgttagctcagatctgacatgaaagtaaaaattacttataaccactttgggattacacaaatttaacctgttcccatgttgtattcagtcctctgtgaaatacgagggtacttcaaaaaggtcaaggaaaaattgaattaaaatataaaaataaaagatgcaaattttatttctcaacataggctccattaaggtcgagacacttttctaagcgataataccagccatttagtccatccctcatttcttttggaattgaggaatttagccatgtcagtgcagtctttttgtaccttactaactgaaaaaaatgggtattctttatagatatttttaagatcaggaaataaaaagtcagaggaggcaaatcaggtttgtaagggggatgcttaatggcttcctattgaaactcttgtaaaattgctctgtgtgattagaggaatgagcaggagctttgtcgtagtggaggaggactctagtgaagctttcttaggtgtttttctgccaaagttttggctaatgctctcaaaacactttcataataagcagatgttatcattctttggcctcccagaaagtcagtaggcaaaatgacttgaacatcccagaacactgttgccatagcctttgctcgtgactggaccactttcatctcttggtagccattgttctgactgtgctttgtcttcaggatcatactggtaatgccatattacatatcctgttaccattcttggaagaaatgcttcggaatctttatcccactcatttaaattttcattgaaagctctgttcttgtctgcagttgatctgggtgttgtaagagttttggcatccatctagtggacagtttgctgaacttatttctcaatcacaatcgtgtaagctgaaccaattgagatgtctgtggtgttggctctggtttctgctcttaatttcggttctcttagggcatgaacaagattatttttttcctctcaaatggatgtggatggtctgtcactgtgggcttcatcttcaatgttgtctcgtcccttcttaaaacaagttatccatttggaaactgctcatttcttttgggcattgtctccatcaagtctttataaaacatcaatgatttcaccacatttcacccacaattcatcttaaatgtgatgcttgttcttgcttcacttttagaagaattcagtttgctctgataggggctatttttaaatgaatgtcctatccttcttagtgcctcaaactagatcctgttcagacatactgtaaaaagttagtatattttggtgcaaaagaattttgaaatccatgcatagttttttcataatatgcatttttcatgagctttttgaagaaccctccttgtaatgtatcttaattccctattccattaaatctatgattttgaaccagccatatgtgacctgtaatcaaaaagtgatgtttgatagatgctgtcaccattctgtcatttttcctcatccaagatagaagatgtcttcgaaagctttgtatatgttccagtcctataaaacaattctacaaaacaatttcaagttcaaaattattattgagaacttttaaacaggatatttagaagtttgttttattaacttggcctaggtcacaaaactcattaatattaatgactagactacagaggcatgtagcctgtctaaacattaacagatacaaaacattaaaccaaattgtgaagcttcgttatgctatgagtcatttcaggcaaagaccaatatagcaagcaaaagctgaacagtccagttgaaatgtttctgatctaagcctttgacttctgtttgtagatgaactggagttttgaaactgacactcaaattttttattgacttcatatgaataaatgattcattaaaatataatacttggaactaaagtcatcattcaaaaaaggcatttattattaataaactacagaaaagagaaaatttgagggtacaatttactttttttaaagtatcttaaaattgcatttattttctcttagagaactttagatgatatcagtcattactaatgtcataaaatgtatgtaaatatgagctaagtgatgtattttatttacccaaagatatgatctaacagcctctgcaactgtcaccaacctttcctataaaacagcaatatattaaatgatagtgaagagggtctgaaatttcaaccttgagatgcacttacactgtattcagtacagcagatttatacttctacttatatatcaacaacaggtctttctaactggcaagtcttgtggtaaacatgagaaatatggatgcttattaggtcacttttggtaaatagaactaataatttgagacatttgtctacaatagagtttggcaaactttcttctgtaaaacaccaaatagtaaattctttaaatttgcagactatacagctctgctgttacaacacaaaagtaggcttagacactatataaaagaatgagtgtggctgtgttccaataaacctttatttacaaaaactgaaagtaggtcagatttttcccaaaagctgacagcaggtcacacttggcctgcggactatcaatccctgagctacatttgcttgattttcttactgtatactcattcctctgttcagctgggcttggcttttccccatcactgcaccaaaatacttttgccaatatcagtaacattctcatcattgaattaaaatgaacacttaccagtccttgtctcatttggattcttgggagcagttgacattctaatcaatctgtccttaaaattttttctttctttagtgtccctgacctacctctagtttttaacccacctctcaaggcagtctcttaattattggtgtgccttaaggatttattattgatcttcttgacacatttgccttaagcagtactttgtgttactatagctctaatttctgtctgtttttctccctcctgagcactcttaagtattaatctgtagcccagattcctaatttaaatactgagtttgtacatctaatggcctgctggtattttctacatgcttatccaaagatacttggaaatacctgtcttaaactgaacttgaaattcccaacctctatttcatccccaagattacttccctcaacccccattctatctcaatgaatggccctacccatctttcacttgcccaaggcagatacttgtgcttcatctttgattcctaactcttcatctcacccatgtctttcattgaaagaatcagttttgtggatgtacctccaaaatagctcttaaatctgtatgtgttatagtctgttgcttctatgctagttcaagccaccatcatcacaaatttaaattactagtagactgctctgcttttccctttcatgttctcttttgctggtgggaatatcccccatcctgctttattcccaataatttatctttcaggtatcagattagatatcagttctactaggaatcctttattgactccagaatgtaggtgtagtgtttgttctctgtgccctatactttgcctgttagggcaaagtatgtcattttgtaacctcagtttatttgtctctattggactcgtaagctcaaggaaaacaaagattgtacacattgtcttcatcattgctgtaaccccaacaccctagcgtgttgctcgtaaatctatgttgaaaacaagtgaaattagtctcaatatccataaaatacaccatgttctgtataaatcaaagcaccagaacatatctgatggcttaatttgcactcaaagtaagtatataattagaaagttgaataaattaatgaaataaagatgtcatacttcacaaagttgtatgtagaacatcagatcctaaatcataaggcataaactgctaatggccagatttgcttcaccatatgttaatgagcgtacaagtaatcactgtgcttataagtaatataagtatcccctattcttatttaatcctggctccttttagagggaaagtaaagaaataaactgaaaaaaaaatgtatatatatatatatggtactacccttgaccttaaggaacacactatgttttggaagccttcattgtaaaatgatcgtaagtactaacacaggtattcttactgtgctgtacagcaccaaagcaagcagcaggtggataggagggggagaggaaatcaggcgaggttttgcagaggaggtaacacttcagaagagtcttaaagtatcagtaagacattgccagaaagaaaaataaaaattaatttcaaataaaatatatataagcatgtgaagcatgattgagaaatatcttcttttttttcttcttttttgagatggacttctgcttttgtcacccaggctgtagtgcaatggcactatctcaacttactgtaacctccacctcccaggttcaagcaattctcctgccccagcctcccaagtagttgggattacacctggctaatttttgtatttttagtagagacagggttttaccattttgccaggttggtctcaaattcctgacctcaggtgatccacccacctcagcctcccagagtgctgagattacaggcatgagccaccatgcccagccgtatcttcttaattgtcaaaggaaaatcaaagtgtgttagtagcattatcatatattatgtttttgtgtcatacatgatttttttattctaaattttaaaatctaaccttaattcagttatttaaattaagatacaagccttgctaaacagaatttttactgatacatgctacaacatggatacatctcaaaaatattatattaaatgaatgaaactggtcacaaaagaccacatatatgatcccatttaaaattgataggatttccagagtaagcaaatctgttagaacaaagtagattgctggttacctaggaccgggagaggagggagcagggggtaagacaggagagttggtggataataactaaaggacatagggtatctttttgggatgatgaaaatgttctaaaattaattgtggtgatagttgcacaactgtatgaacattctaaaaaccattgaattatgcactttaagtgggtgaactgtgtgggacatgaatatttccataaagctgttaccaaaaaatataagttaaattctccagtgttgttattttcactaagttatgaaaaaaacccatgttccatcctttatttaggtatcattgtacaaactgaactatcagctgttgctgcattgaattcacagtagtacacaatagacatatttcaaacataaaataaaaccttattagctccagatatactaaggattatagaaatatatcaactcatttaaaccatgtactttttagaatatgcatcatttgttcacttgattccaagaagattttgtgaatcataatcaggtaattaggttagcagagaactaatgtgcatggaaaaatgaactccagtttttatcagtcatatttagttggaagagcctcattagaggttaaaattttcttctggatagttactgccttaaattaaccacatatcttatcaaattagttattgtacctgcctgtctttaggaatttggttccacaagtgttggaggtaaaatagcatgtttcctattattatgctgcagtttacaatggattttcagttgcctgttgtatgataaactcactgcccttcataacttgaggtaaatgctgaacttgccctttttaatttgttgaaacagagcttccattcactgataagaagtgtaaatttaactaaattgtcaaattaacctcatttaggtgcacacattggttctcttttccttgaagacttacgtgacagcacaagatagagaaaaattaagcctgcacatgttttcagttacctttttcttactctgtgaattacattaggttatttcattcaggatgccaaatacatagtagctcctgaaagtacaaatgcatcatttaaatttctgtctatgaatctaatgcagtcattttataaagaaaagagaaacctaaatttgaatgttgagatcataatctttaaaactacacactagaaacaatagaatttcaatttattgtttaaaatttacccagaatccctcagccaagatagtaacacatgtcttgagaagttaaataatgtacctattacaaatgatgtttcagtcatcagatatgtacttatccttagaataaattataaatacttagaaaaatataccattacctatagtattgagtacagaaaaagctccattgtttttagctgtcaatgctcttttcaacctagtttctcactgttaaaaaagcttcaaataatcatattcaaaacctcttaacttgctgattatattcagcaaccatagctaaatatttcagtaccaaagctgaaaaatcataatggcatatcagcacacacataataaattatggttaatgaatactatacaaggtgtgttttgattggctccaagtttgtgatctgctcatggatagcacattgtatttttaagaggaaggaaaatatagtgatgatatgactgccaagcatattgctttacactgaagcaaagtggtattttagccaaactcaaaatgtaacatatagacaacaagtcaagtgacctaatagccaaaatgaatatatctaattaaacatttcatgaaaatatttcatgcgctctcttatacgatttttatactgaataaaggtttctggtcaaagacagtttgttatgttgacagctaaaactgttgtatgttttagctaaacatgtataaaacacaaaagcatttgccttaaccagcttgaggtggggaccttcaagtgtgaggtgctacctttttaagctaactacagaataaatacttagagtgtaattactatttagcccatatattttctgagtaaacaagacttataagacctgtaagactactaccattggggtcaaatactacaatataattagaaaatattgaaatcatttagacaaaatccacttattctgatattttccatatccaatatttttttccttcaggggaaaaatgacttgatgtcaactgaactatactaaaagatctagctaaatgaaatcactggtgtatgcatgtatgccctaggatgtgcatgcatgcaattggaagcactgttgggagaacacaagagacaacatgaaaaaagacccagagagaagtatgtaaaaccctactggtacttccgtactgcctggacatgcagtgcattaagaggatattgagagatgagtccgtaggaatcatgggccagagtttggaagtcttgaatgctatgctaacaagtttagagtttttgctgcttacattcttaaataggtaatcattttgttaaactgtacttttcaaaaattaaaagttattcgattgatttaacactgggaaaatgccttttgttgtgtattccatgtatttgttgcagttgtccttttgtaacttttatcaaactttgatgtaagctcaggagtttccgtttgcccagtgcccttcttaaagaatggggacattcctgtgaggttttggaaactgctggactgcataatattttaatgaagtctttggaatcacagggcttgaggtagcaacagagatcagctgaaattcaggtgaaaatgataattatgtagtatattcactggactaactttttttatttgtttcatattagaattttaacctgaatgaaacctagctttttaacttggcaatggtattgcattgatgtttgtaaaatgctcacagtggctgtgaaaattttgttggtctaattggtgtaacagatacaaagagatttgattacattttttcagaccatttttgagaaattgaagactttaaccttgcattacctcttattattaagacagtgtgacaccccatccgctatatttatcaaaataccctcagcaaagcttttaaatatttctgtatagaatgagttactgaatggaagtaattgtgcaaactgattaggacataggttctatgtattatcttgatatacaggtgaaagtgctatagcgatctgaagttaccacagtaatgcaatggcaagaacaatgacatgtttcacttttatgtattttatgagttatttcaccgttatgggcgccattttcctcatctattaaataagaggattgggcaaggatactgctgaagtgttttgttactgacatttcgtggttctacctacttccattcactagtttaacttgcatacataggtgtacttttcaacattcttgaatcatagaattggaaagaatcttgggtagccaggctgcctcacagaaaagtagaaatttattcattcactctgcctaggatgctttgcttgcactttctcaggctggtgccctttgagccagagctggttgtgacatcaattattatccctttggttgccaagattgatttcatggtttggagagatgggaagagaatcctattctccctcgttgccccacgtacagttcttcccaaatttgggagcttagttataaaaggcaacctgcagacataaagaaggatctttctttggttaaacgtctattccttgccatggtacattcatctttgtatcatgagcacttttctcgggcagcacatgttactcttaaatgtttactgaatgactgaatatagtggatgacaaaaatgactaacagttgtaaatgtaagtagagtttcatggtttatttagcctatggtggagctgaaattatatctctaggtttttgaacaatgatgcttagtaaagattgtcaacaaataataatagagatattggaatatgtttacaatcatctataattatattgttatagagaatatatctgtagacatatttaataaatggtgcctaatgagttttgttttataaactcattcagtaagacttgaaatattatttacattttatctctgccttttatttctgtaactaagaagaaaacttcctctttaagtacctaccaaagtatttttacattcaacttggacaagagtttagtactatttcttttactgaaatattctatctcctgattttctagttgaaaagataattgcatcatttctaattctgatatccaatttaaggtttaaagctaagcaatgtaaatttggtttaattcttacctagtttatatctgtattatttagaggatatttctgcttgggtaatttgtgaagaggttaatgcatttctgtcttgaaaaatgtatatgtgttcctaattcctaactaatgggaaaacagagggtatttttagtgtcagctttcatcaagtcagacctttctgaagaccttactgaattctatttccatgggaattttgctaatgggtatgtgcaacattatctaggtactcatagataggattacaaattaaaaataaaaaggaatgggtggtgaacaaacacatctttcttttcttttaagaaattgacagaatattaatctttgcactttcattttcactttcgtttcactttgcattgtttttagattaggtgcagaaagtccaagtttggtactaatgcatgagatcagcatagacaatataagtaatgcatttattaaggaagttcttagttgtaatcttatatgtacaagcagaagagagaaagtcttccagtttctctatatttagttaacaatattagtgacttcaatgtgttttacaggaaaatggaaaatttaaaaataagccatccagttgtattgcctgtatactcgtttactgatttattttgattcatgtaatgcatgtgcactgtacatgtcaaaatactgtgcagaaaacgttaatgaagctggtgatattcaacatttattgaacacctgcataccctggatattggaatttccttatggctcagcctcaggctacctctgttttcatactactacttttttttggtcccatgtgatctgggaaaataccttcttttcctgggcaatttcatgtactttcatggttttaaatatcatcaatatatcagtgactcccaaattctcttttctggctctccagacatatattgtcaaggaaatcttgcagatatatcaagctaattgtgtctgaaactgtactttggatcctgcccttcttcagatctgcagctcttaagaatttctaatctcactcagttccatccctccagcttctgccagaaacctgagagtcatttttgactcgttttattttttcactacccttcatcccaattcaagtctgtcatcaagtgctgtctcatctacctctaaacattacctcagaatttttcacttttctctgtcattgctgccatcacatttgatcaagccactgtgtcttgcctggactaatgtagtttggagaaactccaaactggtttctccatatacagttcagccagttctaattcatttccaaataaaagccaaagtaagttcttaaatatgtaaacataattatatcactcttatatctaaaactctataatgcttttacattgctcttatgataaagatctcttttatctatcccagaagaggtgtttggtcttaaattagcttcctagggcgaccataacaaagtaacacaaacgaggtagcttaaacaacagaaaattattttatcacaattctgtaggctagaagactaaaatcaatttggtttcttctaaagcatctctccttggcttgtaaatggttgtctttctctggtgtctttgcatggtcttccttttgtattatctgtatccttgtctcttattagggataccattcatttggattaggggccaccctcattgactacattttaccttaattacctccaagctctgtctccaaacaaagtcacctcctgtggtactaggcgttaggacttcaacttaaaaattttgagaacacagaattcagaccataacagagcctaaactcatagttgatagacgaggaataaacatgtacacataggagcagagacttctggtgggttttgtgggaactaagcaagttagattagagaagattctgtagaaccaagaatggaagactaagaaaaatgttatcctgctttattctcccttaagcaggtatcatttgcagtagcctccaaaacatcttacatataaatgcttttatctcaagaggaatcatgcaatactgcagatgactcagtaaaaatccatcacctctcctacaaaaacaaccattctacctacaacaaaaacgatgacagcaataaaacaaaaactctaccttatttactgacttcatctttatgttttaaaacttattcatttgtatggaagggtgtgtatgtatatcaatatcttggcctatctagctatcacaaaataacaactttttttttttttaagacagtgtcttgctctgtcacccaggctggagtgcagaggcacagtcttggctcactgcaacctccacctcccgggttcaagcgattctcctgcctcatcctcctgagcagctggaattacaggcacccaccaccacgcccagctaatttttgtatttttagtagagacagggtttcaccatgttgtccaggctggtctcgaactcctgacctcaggtgatctgcctgccttggcttcccaaagtgctggtattacaggcttaagcctcaaaataagacctgttattttgaggcctggcctcaaaataacaactttttaaccaaatctgatcaatgtttcgtattagtcttactgcataatggcagtatccattgatactgctgttaaacaaccaataaaaaatccttccagaaataatttatattacatatccagttattatattcctttgaaagaattcctgttacaattatcagcaaaggccaggtacagtggctcatgcctgtaatcccaacactttgggaggctaaggtgggaggatcacttgagctcaggggtttgaaaccagcttgggcaatatagtgagaccctgtctctacaaacaataaaaataacttactgggtgtggaagcgcacttctaatcccagctactcacaggctgaggcaggaggttcgtttacacccaggagttagttcgaggctgcagtgagctgtgattataccattgcactccagcctgggcaacagagcaagaccccatctcaaaaataaacaaacaaaaaagaatgatcagcaaatttaatttctttaaaatcttttaacctaaaatccaattttgcattatatgaaaatatccttgtatctggtttctggaagaatggagatgtaatgtcattaacttttatgctaaagacagctatttttaaaaactacgcacagtatcatctaaaggattgtatgtgtgtgtgtatgtatgtgtgtgtgtgtgtatatatatgtatttagatagatatactttggtttaattcaagatagttttggcttatggatgacaagatgtggatgtgttttcataactcacagctgtcgtttatgccataagggtaattctcttcttattcagtatgacataatatgctacattttattatccagactatctttctgactctgaggaaaaaaataggtccaaatagtcaaattccattatctaatgacagtggtaggcaggaagcacatggataattatatatacattgtcagattcagcctatgaaactactttaaccaggagtttctacattttccaccatgaagtctgttgttagagttgctactgataactaagatgacaggtctgaatttcattttattttctctttttcttcccttaacaaagatactaatgaactatgagttgactcataggccagaagtatataaaattaaggacgaaatatgtagagcctagacaatccaaagagaagcacctttaatactagtaattgaactttcattgaacttaatgcatttcatatatctttgttgggtgggggctgcaactggtttgtgttcaaactgaagataaattgtttgaaaatccacttaattgatggataaaaccttctgtacattttatgacaggtaaaaaatgaagttagttgattctggttttataagcaaacttgtgacttcctagttatagtcctaaggaaagctgaatgtgttttcctcctaaaaatgcaatgactccagggtagcttttgatcaaacccactcctaatatttgtaagacctgaaacaagagtaaaaatggagacccatatcatacatgtaaatgtaaaagtcatttaaaaagctaccgaactcttaaatgtgctctatactccttacttgataagataacttcttgatatcttggaaagacagatttaaatttaaaatttttggactccttgggattctatgtcagaacatgataatgtggggagttggcccttggcctgccaccctttcctttttatcctgcacatctaagctccattcttacttccccacaaaacaactgccctgggccaccccttggaagactatggagtatatgctgtctacaaatagacatgaaacacttaccactgctgtattccccatggtcttctctaagtcattatggattgaaagagaaatggcaatgattatgacagacataagtcagatgcttttctgtatcaatttagatgattatgtgtctttccacctttattctgttaatgcagtgtaatacactaatcaattttcatatgctgaaccatgcttgcattgtagaaataaatactacttgtataatgatatgtagtataccatggtgtataaaccctttaatgtgctcttgactttagtttgctagtgttttgttgaggatttttgcgtcaatacttacggatattggtctgtagttttcttgtagtgtctttgtctgactttggaaccaggataatactggcctcattagaataagcttggaagtatctcctcttgttcaagtttttggaagagtttcaggacaatggatgttaattctttaaatgttttgtagaattgtccagtgaagccatctggtcctgggcatttctttgttgaggagtttttaactactgattcaatctctgtattcattattgatctgttcatattttctatttattcatgatttagtcttagtaggttgtttctaggaatttatccatcttgtcttaggttattcaacttgttagcaaacagttgttcatagtggtcttttataacacttttttatttctatggcatctgttataatgtcctctctttcatttttaatgttagttatttgggtcttccttctttttttcttaattagtctagctaaggatttgtcaattttattgatctttttaaaaaactaactcaatttctatgaatttttatattgttttttgatttttctatgtcatttatctctgttgtaatctatattattttcttcttcctgcttactttgaccttagggttttttttttttcctagttccttggatgtaaagttaggttgttaagttgagatatatatgtattttacattatacacttaacagctataaacttaaccctttaacactagtttcactccatcccaaaattttggcatgttgtgttttcactttcatttgtcttaagatatttcccagttccagttccccttattacttatttggcccattgattgtatgagaatgtgtttaatttccacgtatttgtagatttcccagttttccttgtgctactggtttgtagttttattccattgtaatcagaaaagatactttgtatgatttcagtcttctggaatttaagatttgttttgtggcccaatgcatggtcttatcccagagaatgttccatgggtactcaacaatacatgttctgctatttttgattagagtgttccgtatatgtctgttaggtctaattggtctataaggttattcaaatcttgtttccttgttgattttctgaataattctgttcattgttgaaagtggaatattgaagtctcctactattattgtgttgttgtcaaatttcttcaatcctgccaaagtttgttccatatatttagattcatgtaaatacagtaagtcctcatataacattgtgataggttcttggaaattgcatctttaagcaaaacaatgtacagcaggcttttaaataatgtcattttgttcagtgtccttttatcataatgttgagggaaaaaatggctttgttgtttgtactttttcttaaagctgcagttttcaaaaaactgtgacaacattgagaacttactgtatttatgcaccaaagctatgaggtttggtgcataaatatttataattgttttattttcctggtaaattgacccttttgtcattatataatgtctttctttgtgtcttgtaatggttttttatttaaagtatattttgtctgactttaatgtagccacttctgctctcttttgttaccatttacacgggatatctttttccatcctttcactttcagcctatgtgtattgttagatctaaagtatgtctcttgtaaacagggtatagttggattctgttattttatccagttaaccagcctgtatcttttgattggggagtttaatctgtttacatttaaaataattaccgataggcaaggacttattgccgttttgttagttgctgtctatgtcttgttcctttcctctctcattgcctttctttgtgtttcattgatttttttttctagtggtatgctttcattcccttctcacttccttttgtgtgtattctacagatattttctttgtggttaccattgtaaatccataaaacatctcaaagttatagtattctatttcaaactgataacaacctaactctaatcacatatgaaaactttctcctttactgctccacttctccatttgttactgatgttacaaattacatttctatatattacatgtacattaatatagatttatgggttttgttttgttttggggttttttcatttaaatttcacatactaaatttacagtattacgtattactatatttttccatgtatttacctttattgagaaccttatatttttatacagctttgtgtttttgcctgctgtcctttcatttcaacttaaagaacttcctttagcattttgtatagattagctctaggtgatgaactcccatggcttttctttatctgggaaaatgttaatttcttcttcacttttgaagaactgttttgccagatgcagtattcctgattaatagtttttttgtttttgtttttgtttcctttcagcactttgagtatatcatcctactcctttctggccttcaaagtttctgctgagaaatttgctgataatattatggaagctccctcatatgtgataaatcacttttctcttgctgctcttaagtttctgtctttgactttacacagtttgactataatgtttcttagtatggttatctttggattttcctcgttggagttctttgaatttcttgatctgtatgtacatttctgtccacagattggggaagttttcagccattttttcttcagataagctctcttatttttttctctcttactttcccttctggaatacccatcatgcatatatggacctggttgatattgtcctaaatcccttatcatctcttcacatttcttctttcttttttctcctctgctcagtgatttcagataacttgtctgcaagttcactgattcttcattctgcctaaaactgttgttgaatacctctaataagtttttccattccgttactgtatttttcagctccaggatttctgtttggttcttttttatagtttctgtgtttttcttgatgttctcgttttgttcatgtatcattttcctgattgttttcaattgttggtgttctctctctttttttttttttttttttttttttttgtgagacagtctcactttaccacccaggctggagtgcagtggcataatcttggctgactgcaacctctgcctcctgggttcaagtgattctcctgcctcagcctcctgagtagctgggattaaaggtgcatgccaccatgcctggctaatttttgtatttttagtagagatggggtttcaccatgttggccatgctggtctcgaactcctgacctcaggtgatccacccacctcagcctcccaaagtactgggattacagatttgagctaccgctcccagccttcttttagctcattaaacatccctataatagttattttaaattcccagtcaggtagctgatagacctttgtttcttcagggtaagtgtcccgagttttattttgttcctttgattaggccatatttccctattgctttgtatgctttgtgatttttgctgggcattttgaaagacaactacctcccctagtctttgcatactggctttgtgcaggggaagaccttcactaataccccagctgggagttctagggcctctcaaatgttttctgatattttgctccctctggcacctgcccgtggaactgcagctctaatatgcctctcacctctgttttcagtgccttccaaacgctggtgctgggcgtgtgagtgcccttctttaattaatacagaaaccagttccttgggaatcccccagaaagccagaatgttggatgtatggttcattcttttatttctgtcctgagggaggagctctggcatggggggtggtgggttcttcttggttgctccgctattccacatgggagagaggcatgcatgaatacactgaacactgtgaaattcatttcctaccactttcattggaattccttcttggttttataatggtgtgggtgctgtagcatctcaactggtctctcaagttctcacaagggtattctgatccgtatattgttaacttggtaccttagtggtggaaagagggcctctagctttctagtctacccctatagctattgttcttttaagaagtatgttttcgaagttacatttcttctctttcctcaatgtaacattttaggaaacaccaccttaaaacaaagcaaagcaaaatatagaaaacaagaacctggcttgactgccacctttaggggtacatcagatcagttgtttacgtgctgattcagccttcattctctcctatctttttggatggaggtgagagtgatgaacttgtcttgcttttctcagaactttagggtaaacctaggcttatcatccttccttaactgctaggagggcatatactatgtatagatgatgctgattaaatctttggagctttaatgatgtgtgacagccaatgaatttttctaatatagtataaaaacttcatgattttatatcattcttaaaggaagaggctttaaagcagatgtacttcttttttcattttaaagcttaagtacttagatatatgagagaaaatgaagaagtatggaaatttgatcctgtacacttagcttcatgaagagtgagatgcattttctgaacatagccccattgactcttctggaattagttggagataatttggtttgaaatgtcggctttgtaaatagaaatggaaatcattaaaacagataaaagtgaacatagaaactgcgaactagaataaacagtatgttggaaatgaccatgtggctcaattttgcatcagttttctacttctttagttcatgatgcccattttatgtcatgtgattacagcagtgtgatcagagcagttagcatattcttggcattttctcctcattaactttcacttcttcagagggaccttgagtaaaataaacacatttgagcagtcttaagcaaattgtttgaattgtttcctcagtatacagaatcaaccaaaagtaggttggattgagttgagttgggtttagtttaatatcatactttactacagcatcatacatacatatacaatattacctagcatctgtagcacccataaaggattctctaatgcatgtgaagtaaaaggaaagagagtgtttaagtcctgactttgaaactgttgtgttaattgtgaacttttgctgagtctatacattgaagaaggtaacactcagcatgttgagatcacaactgctagattagtgcttggaggcagtagctgtgctgatgtgaggcattaatggctgggtgagttcaatcagatatcctgcctccagtgtctttgtgtaatggtatttactagatttcaaacagactgctgagaaagatgaaatataatctcatgtattatctctgtcttgaaaaaattagataataaagttgttctcttactggcatatgttttattaaccttcgtagagtcaacttaaaggacagatgtctgtagaattgaaaccttttgctagagtgttattaagtgcatttttgagttctaggaatcatggggttgagtagagcaggtaagcattttttaaaaccactcagaggacaatcttatgtcatattctgaggttagctggagagaaaaaatgtgatgtaaattgtgtgcaactacattctttttgttgtttttcttccttacagagcctggagaaagttcttgtggaattcagtcacaaggagttgtttgatttctataacaaggtctgtatttttaaaataattttctaatatgtggagtttttttcataatattttgtttcattttatgaattcttatttttaaatgtcatattatggaactaagttctttaaacttcccttataaaagaccttatgtttcacaggaggaagtatagcagaaatgaagagaatttgaaaaactaaatcaggaagaaaaggaaaatagttttaattaaagcaataggattgttgctttaatataaaacattaagtaatgaactttgtgattcctagccacactgacactttaaatatatataatgtcaaatactttaatttctgggcccaagggtaaagggaaacatgcctttagagatttatctgtgagtatatttcatgtctctttctgaagactgattttgtaatccaggaaaatatactccctccaccccccaactttaaaatattatcaagtaggcagttcttctgccagtgtactgccactggagcatgcgtgtggttatcctgttcagcccaccaccactgtacccactccctcatatgtaagcctccaataaaaccccatgtctcattaaaaaaaaaattatggagtgataatttaaaaggaaacagctgaagacacttaaaacaacagtattaagaaatcttctttctttgaaaatttgaaaacttaaattttcaagcacaaattctaatatcttcacctaaaaagaaaaatattctaagtggtaattttattgctatgtgaatggatttaatattcatagttaccagtgctattttttcctttctatttgcatgtgtctgaataacacttgatatgagtttcgttcccttcactaacgtctttttttttttttgtctttgtaaatagctagagactatacaagcacagctggattcccttacatgatgttttcgaagactgtttttttcatcacgctcctgccacctcattattttgcattgaagatacattgccaggttgtgttttctgaaggattcagtgacttgctttctgtaaattatatggcttatcacttcttagacaaataacaaccaatagagatcattgttaagaatactgaggttctaatatactttctttagttctgtgagccaacagtaattattaagaacactttccctttaaaggaaacaaaagtgaataccatattgtttttactgtcatagtgttgctttcttgcctgtcctgcttagtttttacttgctggatgataccataatgtatcaaggagcgtccatggatacaagataagatgtgtaccttagtagaatacagagctttggtaattacatgaataaaattaagaaaatagccatatacaatcaaatacactatggcatttttatttgaatatgatgagtatattttgcttcggaaataatataggaaggaaatgtaaaatagtgagtagtatggtatcagttaattccagtctgagcttctctgtcaacttcagtttctctctcagtttaatgatttaataatagtccaggtttttgtgtgtttttctttatactgcaaattaataatgattcactttatagtttgggagacagaatcaggtcttgaataaaataattgtaatgagtgctaaatgggcaccattattcgaatcagataccttttatattctctttccataaatacgttgatttctgtcaataaaatttttgtgtcttagg

SEQ ID NO: 38370 - DNA, 30796 bp, Homo sapiens
ggcgaggagccgggagcacggtggagcggtggagggcgtcactgggtttcggcgtctggcaagcggttcagctgtctgctccctagcagccggccttcgggtcgggcgtctccgccggctactgccgcttcagttctcccggtgtggccacgagtcgggtgagtctcgggagtccaggccgttccgaacgcgttccgttgttcctcctcaggtccctgatggcgcgtcccgccgagccccttcctgccgcccgtcggccccaggaggtggggaccaggaagacccggctgccgcaggcccacagccgggctgctgcgctggggaggctgcgagcgaggtggctgggcgctcgctggaacacgctggtggccgagacaggccgtgggcgtcgctcggggttgggatccgcccgccactcactcaactggctggtgaccttgggcgcgctcctcccctcccggagccggggcttcctcgccggtaaaatggaccttgaggaatggagccctcaacacagggtttgacacgatgagcgcccaataaagtgttgttattgttgtttatctagcaattgagaatttgcgggtagaaaacgggggccgttcaagcaagtctcagctgcagtgccctgtgatgtgagaacccaccaagagccccatcagtacactttactcttttttctcctttaatgctttttttttccaggaaagtaatacattcatcttgcttttcttgcgtttaaagatcaggcgttttacgtagagtcttaagtaaatcagttttggaagtcttcatttaaaacctcaaaggcatggaagttttcgatggcaaaggaattatgttgtgatgccattcgtatctcctctcctttatatgtatggcttttgcacttgtttagttgatttaaaatgagtttctttttcatccttttcctactgcgttgaggcctgaactagttgtcagtttctgacattccgcgaacatcgattgggcatttaccatgtgcattggcaagaatgctccctcacgagcctgtgcgttccttgagatgtgtgaacgagtattttcctctgaaattcacatgattctggcagagtgctaggcaccttgtaagtcctggtaatgtttattcagggaaagctgcgagggcgcattctctgagaaactcttcggtggaagtcagagtagttaagcccttctccctaggcagcacccccgggtccctcccagaagcagcctggcatggggtctacagtgccagcgccagtcgctttcttagtggtatcggtttagaactggtcctgtgataagtggaagtgggcaggggaggccgtccccgaccgtgtctgcgacctctgctgcagtatggctcatagcttgaaaagttgaaaaataattctttaataccagggccgaaatgtaggccttaaaaatgttttatgttatttatttatatatatatatatttaaattttattttgagacggcgtcttgttttgtcgcccaggctggagtgcagtggcgcgatctcggctcactgcaacctccacctcccgagttctagtgattctcgtgcctcaacctcctgagtagctagggttacaggccacgcctggctaatttttgtatttttagtagagacggggattcaccatgttggccaggcttgtcctgacctcaagtgatctgcctgcctcggcctcccgaagtggtgggattacaggcgtgagccaccgcgcctagcctaaaaagatatattttagaaagcggagtgtttacagtttttttttctggagaacagtttcttcagactctgcacaacagacttttctggccttgttttttgcttattttgcagtagcattagaaattacaactgtagtgtaaatttcctgtgcagccgcacaataggaaaatctttctaaagaaaagccaactggcattaaaatacagggttcttccttgtgattatagatttgctgaagtgagttattagaatgcttacccgttttctttatactagagttaatacagcgctggctcttggtttattttctaaaattgtgccacctggtggttgaaatctgtcttagactactcttgaggaaaattgtacctcagagtcagtagacaaagattgaaggagtgagtaaaagaaagctataatttttatatcttcactaagagtaccctaccgcttctaccctcccagcttactccccaggaaaagttaaaattgcccttatgggccccttagctagctatcaaaacacatttgacagctgaaaattttaaggaatttcagtggactgttttggtatcattgtgtgcatacacagtggatggggctggattgaggagggaggtggtggaatcgtgacaagtttacctttttgatgttttcttaaatgccattgtaaagatgagactgacaaactgatggaagtcagagtagttaagccttcctccccaggcagtccctggggtcgctcccaggagcagcctggcttggggtctgcactggaattaaatattattctattcaaataataacagtttgaatggaatttatccctctctatttcactggaaacatccaagaacgaggtcttatgttcctttcactttcgtttccaccatgctgctgatgttcataattattattttttgagatggagtctcactctttcgaccaggctagagtgcaggtggtgccatctcagctcactgcaacctctgcctccagggctgaagcgattcccctgcctcagcctcccaagtagctggattacaggcccccaccaccacgcccagcgaatttttgtatttttagtagagactgggtttcaccatgttggctaggctggtctcgaactcctgacctcaagtgatctgcccacctcggcctgccaaagttctgagattacaggcgtgagccacagcttccagcctcacataagttattttaaacccatgccatcactgagatatataggtcaagagcaaattccattttatggaagagagacttaggtctcagattagtaaccaaaatgatgtaacttgtgagtagctgactagtgacaaatacaatactcttctctttttttgtgtcttgacagactcactatttccacacttacaggatagtattacgttggctgctttggaacttgggcctagaatgactaccttttgaacttgtagtcaatcagaagctctttgggaaatagtttttccatctgaatgtatttcattcacaaactgctgtgaatgcctgtctttcctattttgaacatggattaaaaatctgtcatggttagagattatgttgggttgtgactttgcagctaactactgtgtgacctggggcttagtttctctatgaaaatgtgggcagtgcatattttgacctataaaaagacagtttctcatggttcaactgaatttaaaaggctacccgtttcataaggttattgcattgtaagacttgtgcttagcacttggcaagtgttcaacaaattattttctaaactaataacgttgatatcttcttatgactttgaagaaattttaagaataagaatatggaatacgtatttagcgtttcttcagtttgttaaatatattttgagttaaattgtgttactagaatagtcttttaaaggtgagtgctggaagacatcagcacttaattacatgtgttctgagagaacattgccatttttacagttgtaccttacatattacaccccagaatacagcagtacatctgtgtatgcaccaacatttaggcaaagccaagtgacacaaagtggatggaagtgagcataggtgacgggtaggtagagggcaaggggaggaagaacatatctagctaaaaatatgtggtagaagaaagaagggagtgatggggaaagcaaggaatctgttggataagggataaggtgagtgtttagagctttaggttaagtagtagcttcttaccaagaataggaaaaggaaatgaaattaaaccattttattctttgacatagtcatctaggctaagaaagtagaagggccttataaatatatacaattattatttgtcaattcaaagtaaaactaaataatgtgaattagaagggaagacgttttattggtaccctaccctgattgacaatagcatatgtatttgaggtaaacttgttatagagggaggaaaatatgtaccattttatgtacttaggcttatatacatctttgcatctattaatattgtctcagtcaagtgtcttctcaggtatttgtcaattaaagaaatcatttcagtacatcataagcttgtttctgaattgtaaaggcacacatttgagtgccggttgatagaaatgtgcaaaaatattttgtcaaatacatttagaaaatgttagagacattttctagtgattaaaccagtgtctgttttctgttattgttgtttttgagatggagacttgcgctgttacccaagctggaggtcagtggtgccatcttggctcactgcaaccttgcctcccaggttcaagtgattctcctgcttcggcctcccaagtagctgggattacaggcgcccaccaacacgcccagctaattttttgaatttttagtagagatggggtttcggcatgttggccaggttggtcttgaactcttgacttcaggtgatccacctgcctcagcctcccaaagtgctgggattacaggtgtgagccaccgcatctggcctataccagtgtatgttttctttaggaaaaaataaggcagaaaccagaaaactaacacttcacataaatgtaggtgcagaatattggtacgatattggataacttaaattgctgaactgtatgaaacttaatttttctaaggcaaaaattgatatcattggaaggatcttggagtcagtggcaggcaaacaaaatttaaacttggctgcattttcttttttcgtttcaaatgaatacttaactaggtgcaatggctttatttgtggtcttcagctgtggtgtgtgtgtgtgtgtgtgtgtgtttagtagttactgaatagtacagggacctactgcatttttataagttgcaattgaaatagtagctatgctataatcctttggaattatttgttcagacagttttttgtttctgttgagtgggaggtggatgggcagtttgaatttctcacaggtttttttttaacagcttgaggtataatttacataccataaaattcgcatggtgaaatgcacgtaacataaaatttaccatcttaaccatttaaatgcacagttcagtggtatcagatacattaataatgttgtgcaaccatcaccaccgtccatctccataatactttttatcttgtaaaactgcttgttaaacagtaactccccattcatctcctcctgcccttccacctccctctggtaaccaccattccactttccgtctctttgattttgactactttaggtgcctcgtataagtggaatgttaaagtatttgccttttaaaaaatatataatttcaaattttatttcagattttggatataagtaatgtgcaggtttcttacatgggtacattggatgacactgaggtttggggtactgttgatcccatcatgcaggtaagtgagcatagtacctaatggtttttcagcccttaccctccttctaccgtctattagtccccaatgtcttttgttgccatctttatgtctgtgagtatccagtgtttagctcccacttataagtgagaatatgccatatttggctttctgttgctgcgttaattcacttaggataatggcttccagctgcatccatgttgctgcaaaggacataatttcgtccttttttatggctgtttagtattccatggtgtatatgtacatattttctttatccaatccattactgatagacacttaggttgattccatatctttgctattgtgaatagagctacaaagaacttatgagtgcatgtttttctttttgtaaaacggtttattttcttttggctatatacccagtaatgggattgctggatctagtggtagctgttttaagctctttgagaactctccagactgctttccacagtgggtgaactaattgacattcccacaacagtgtataagcattctcttttctcacaacctcccccagcatctgtgtttttttgactttttagtaatagccattctcactgatgtgaggtgatatctcattgtggttttgatttgcatttctctgatgattagtgatgttgagcattttttcatgttttttggccacttgtatatcttttgagaagtggctgttgatgtcttttgcccacttttttttaaaatttgtttatttgttttgttttttcgagacggagtctcactctgttacctaggctggagtgcagtggcgccatcttggctcactgcaacctccgcctcctgggttcaagcgattctccttcctcagcctctcgagtagctgggactacaggcgcccgccaccacacccggctaatttttgcatctttagtagagatggggtttcaccatattggccaggctggtctcgaactcctgaccttgtgatctgcctgccttggcctcccaaagcgctgggattacaggtgtgagctaccgtgcccagccttttgcccactttttaatgggattatttattttttacttgttgaattaatttctttatagattctggatattagacctttgttggatgcatagtttgtgaatattttgtcctattctgtaggttgtctttattctattcatagtttcttttgctgttttgagatctttaattaggtttcagtttttgttgtaattgtgtttgagtacttagtcctaattctcttccgaaggtgaatgtccagaatggtgtttcctgggttttcttctaggattcttatagtttgaggcattctgtgtaaatctgtaatctatctagagttaatttttgtatatgatgaaaggtaggggtccacttttattcttctgcatatagctagccaactatcccagcaccatttattgaatgggaagtccttttgccattgcttatttttgttgactttgtcaaagatcaaaagtgtgtggctttatttctgggctgttatgttccattggtccatgtgtgtgtttttgtaggagaagcttgctgatttggttattgtagccttatagtctgaagtagggtaatgtgatacgtttggtttttgttctttttgcttaggattcttttggctatttgagcccctttttggttccatatgaatttttggatagttttttctaattgtgtgaaaaaatgccattggtagtttgataggagtagtgttgaatatgtagattgctttgggcaatatggccatttcagtgatattgattctcccaatccatgagcacggaatgtttttctatttgtttgtgtcatctgtgatttctttcagcagtgttttgtagttcttcctgtagagatcttttacctccttggttggatgtattcctgggtattttatttttttggtggcaattgaaaatgggattgtattcttgatttggctttcaggttgaaccttatagtgtatagacgtgctactgatttttctatgttgatcttgtatcctgaaactactcaagtcatttggcagagtctttagggttttctgggtatagaatcatatcgtcagtgaagagagacagtttgacttcttttcttattcggatgccttttatttctcttgactgattgctttggctaggaaataagtactgtgttgaataggagtggtgagagcgggcatcctgttcccttgttccggtcctcaagggaaatgcttccatcttttgcctgttcagtatgatgttggctgtgagtttgtcatagatggctcttattttgaggtatgttcttcagtgcctagtttgttgagggtttttatcatgaagggatgttggattttatcaaaggctttttcgcatctattgagataatcacatggtttttgtgtttaattctgtttgtgtggagaatcacatttattgatttgcgtatgttgaaccctatatatatgttttttgactggcttatttcattcagaatgtcctcacatttcatccatgttgtagcatatgccagaatttccttccattttaaggctgaatagtattccattgtatgtatataccacattgtgctgatccattgtctgttggactcttgggttgcttccatgttttaattattgtgaataatatgccgtgaacatgggtgttcaaatatctcttcaaaaccctgcatttaattcttatgaaaatatagccggaagtggaattgttggatcatatggtaatttcatttttaattttttgaggaactgctataccagtttccacagtggctatcccagtttacatgcccgcccacagtgcgcaggagtttcagtttctccacatcctctttagcgtttgttattttctgtttttttttcagcagtagccatcctaatggatatgggttggttcctgttttctatttggaactttaaaaaaaattaaagcaggtaatcggttctttcttttggtaatcatttctgagttagagtaggttaagcccaggtggggcacggtagctcatgcctgtcccaacactttgggaggctgaggatcacttgaggacaggagtttgaaaccagcctgggcaacatagcaagacccctgactacaaaaaaaaaaaaaaaaaaagaacagctgcccatgatgtttttcctttgaccttggctgctaattttccaccttgtggatgatccaattaaacttaagttcagggatttcagcttcatgttttcagtgtaataattagttttatggctatatctgttaaatttgaaattttttttcacaacttctggtttcatttcattgtttagtttttttttcagccagctattaagaaaaaagcaatctatattcacactaatatgagactaatgaccctttaaccctcagaataatatacattttaaaataataagccaattctcttaattggtagaatttcatctgaacaaaatgagttgttaatttcgagaatgtggcgaaaatatttgaagtcaggcttattaatataagcaagctgtttctgctttagtgcttatttccgggattgggtctcttgaggcttcctgcttttctcctgaacctgtaggttctctaaatactactgataacttgctgaatatcttaaatcattgaattagaaagctttgtctcaagtttaataatttgcctgaggtcacacagctggttaatggttaacatacttctctgataaaggtcactagaggttcttatgaagatacttttaggtggcgtaacaaatgtgtttatgcatattcaagacactcttgtatccacaggttgcactgctgtgatccatcctcatctcctaaagatgcatcctgacttatctccacacttgcacactgaagaatgcaacgtcttgattaacttgcttaaggaatgtcacaaaaatgtaagagttcagaaaaacgactgtacagccaaaatgaaacttagttataacccactgatgtaaaatgttatctccgttgatagaaggaaacgataatgtcttagtaaggagtctgagtttagtcaagattagcagttgatatgtgcgatttttttcttttttttacacaaactacctccttttatgattagtaaaaatcagacatggtagtttgttagggaacgtctgaactggtatgtaacagttggaatccatgttcttacaataaaatgctttctctttcctaattatagggcactagaacagttatattcagcgctgacacttctgattataatggaattattctaaaagtatctgctctttgatggctaccattctgtgtttaatggtaatagaaacgtgttatataattagacattaactagatttatgattggcttaatctgatgtgtttagttgttagtggaatggaagtaaaattacatggttaaaaccaaaatagaaaaggagcccatccatatttggaatacattaaatcaagctgacatttttatagctgttgaatatttagcttttccttatatgtttgatatatgacaccgttgttacaagaagcatttgttttttctttagctttgcatagtttttctcatgatgtctacaaactgtagatatatcaaattataataatataaagtatcacttaaatgagtaaaatttatagaccaaaagtaaggtggtaagtagtgcttataaaatgtgaagtcagatatttttactggttcaaagaatgttgttgatgacaatattttttgggctatttcactatacatatagatcaaatgagccagactacatcaataaaacataacgttttgatttttaaagtaaaaactatataaaatattcactgtttaaagaacaagaactaattatttgtgttaaagtagaatatttcaatttgtatatggtcagttatagtcagagacagaaaaggggagagggtctggcaacagagaggcacagcggagagaaagagactctgtggaataacatttcagtcttgttattgaggattttgccagtatagccctttagatttatgttgtgctttttgtaatactagacataaataaggatattatcgcatcatatttatttccatggttaatcaaattaaggggcagagtttttcaacccttgcttttaagtaatctttgttttatgtttatatttgtatattgctttttggtccatgactgtttttaaattgaaatctatttaaacgttgttgttttttttttctttcaaatggatttcttataataaaggtggcttcttgaatcactggaactaaagatggattttaaaaaattaactttattgaggtgtaatttacatgtaaggaaatgcatctattttaagtatacagtttgatgagttttgtcatatatagatacccatgcaaccaccatcacagtcaagatctaaaacatttctatcagtttcctgtgcccctttgcagtgagtccccaacccttaacttacgtcttgcccaggtaaccactgcactactttttgttgatatagatgaattttgcagttctagaatttgttagaaatttacactacatcgtatattctttttgtttttgagatggagtctcactctgtcacccaacctagagtgtagtggcgcgatcttggctcactgcaacctccgcctcccaggttcaagtgtttctcctgtctcagtttgcctagtagctgggattacaggcgtgcgccaccaggcctggctaattttttttatctttagtagagacggagtttcaccatgttgggcaggctggtctcgaactcctgacctcaggtgatcctcccgcctcggcctcccaaagtgctgggattacaggcatgagccactgcacctggcctacattgtatattcctatattttgcaccatgatatgtttttgagggtcataacatgctgttgcacatgtcattagttcatttatttttatttctgagtagtagttcattgtatggatatgccacagtttatttacctattaatggacatttaggcaaataaacagtttgcagctgtgctattttggataaagctgctatgaacattcatgcacaagtcatttgtttttgagacagagtctcgctctgtcacccaggctggagtgcaggggcccaatcttggctcactgcaacctctgcctcccaggttcaagcaattctcctgcctcagcctcttgaggagctgggattacaggtgtgtgtcaccacacctggctcatttttgtatatttagtagagacggggtttcattatgttggtcaggctggtctcgaactcctgatctcaggtgatccacctgccatggccccccaaagtgctgggattacaggcatgagccaccgcacccagccatcatgtgcaagtctttgtgtaaacatcattttatttctcttgggtaaatacctaggaatggaatgactaggtcatgtgttaagtgtatatgtaccttcataaaaggccaccaaactgttttccattttatactactctacattcctaccactgtccatcaccactgcctaatattataaactttttaagttcagccattgtgtggatatgtagtagtatctccttttggttttaaattgtatttccctgatgactaatgattttgacatgcttttcatgtgcttctttggccattcatataaaattttttgcctgtattttaaaattggattgttttatgactgagttataagcattctttttatcatttgggatacaaatcctttgataagtgtattgtgaatattttctctgtggcttttttttttttacttcctttaggatgtgtttcaaagagtagcttgtacatttgatgaagtcttttttttttctttcatggtttgtgctttttgtgtcttaaggatctttgtgtattctgtggtcacaaagatactcctgtattttcttttagttctatcgtattagctttacattggtctatgattcgtttcaagttaatttcatttttttcttttgatatttgtgtattcttatctgagatttcaagttaatttttgtgtatagtatgaggtgtgagttgaagttgattttctttgcctgtgggtagccagttgtctcaacaccatatgttgaagagactgttctatccctgctgatttaccatggtccctttgtcaaaaatcaatttaccatatgtgagtgggtctatttctgggctctctagtctgtttcactgatttatatgtctcttcttaacaccagtaccatgctgtcttaattactgttgccttgtagtaagtctcagtcatatagtataaatcctccaattttgttcttttttcaaagttgttttggctattctaagtactttcatttccatattaattttagaatcagcttgtcattttctacaaaaaacttgtttactggttttttgttttttgaggctgaacattgttgatgacttggattttatcttttgtatcagcaggcagttcgtgtttttacatatttttagggcatagctggcatagtctttactctagagttagcttagcccaattactaaattaggattctttactgattgacttgcatattcaatgagatctctactttggcttataaggactccattgactcccagccctgtgtgagctctgcgtttttcagcttgtagctgctgtaattgttcttcgtagtgactatggcattgtgaaagtcacccaatacatgtgtagtgaatactcagtcagtgactcaaggcagctccatgtagatttctggagttcttttgctgcttatctctacctcacaaattccggctgccccagcctgcccgaattcctctgacgtttgcctcctctgctcggtgaaactaccattctcctcttgagttctgttctctgctacatggtttggaaattgtctgtgggtagaaagctaggtgaatgtagggttcactttgttttgtttttttctttcagttatcacagtcctgtagtctgttgtcccaatatctgaaaatagttgttttatatattcagtttgttctttcatggctagaagcagaagtctggaaaatagatttttaagtaaatagcatggggacaattacatagctgtttggaaaaagttagaataccatacatatgaatcaactaatggggcagacatctaaatgtcaaaaatgaaacgatacaaacactaagaaacctggataaattcttatataacctaggtgtggggaaagtgtgcctaagtaaggaccctgaattccagagacaataaaatcaaagattgataaaggatcgtttgaggcctggagttccagaccagcttgggcaacatagcaagatcctgtctctacaaaaaataaaaataaaagtggccgggcatggcacatgcctgtagtcctagctacttggaaggttgaggtagtaggatcacttacccagttgtttgaggctgcagtacaacacatcagcctgtgtgacaaagtgagaccctgtctttacacaaaaaaaaaaaaaaaaaggagggggaataagaggccaaaaatcagagagaaaaatgagcaaaagcatgagagacaatttaaaaaaaaaagaaaagatggcctttaaacatgagaagatgttcaacctcaataattagagaaatacaaattaaatatactgaacataccattacttatctgcaggggggccaaattaaacagtgtgacagcgcattctgttggcaacactgtataccctcatacatttctgatgggactgcaaattgttataatctttatagagaggaatttgctgccttgtagcaaaactgccgtatatttgctttttaatccatcagtcccacttataggaatttatcttaaaagtataactctaacagtatgaaaaaatgtatgcatagagttatttactgcagtgttgtttgcacttggaaaatgttgggaacacactttcccaacgtaaagtagttgaacgacctatggtgcatccacacaatggagcactatacagctgttttgtaatttttatttttaaatagactttgtttttttagaacagttttagatttacagagaaattgtgaatgcagtacagggagttcccatatacctcacatctagtgtcccttattattaacatcttacattgataaggtgtttgttacagttaataaaccaatattgatacatgatcgttatttaaagtccatgcttactcagattgcttcaggttagtgtttacctaatgtcttttctctgttacaggattccgtccaggatacacattacacttagttcttgtcactctttaggctcctgttatctgtgacattttctttgtttttgatgacccgaaaaggtttgaggcataatggccaggtatttggtagaatgctcctctgtttgaatttgtcttgttttcctcataattggattgggatcatgtgttttcggatgaagaccacagaggtaaagtacattttcatcaaggctgcatactacaacataatttatcactgttaatgttgacgttgatcacctggctgagatacgtgttaggtttctgtaccttttttttttttggagacagggtccactatgtcttccaggctggagtgcagtagtgtcattttggcttactgcagcttcaacctcctgggcctgggtgatcctctcatctcaccctcccgagtagctgggactacaggccacgtcaccatgctcgaataattttttgtatttgtatatttgtagagaacgggttttcgccatgttgctcaggctggtcttgaactcctgggctcaagcaatctgtctgccttagcctaccaaagtgctggtattacagatgtgagctattgcacgtggctaggtttctctgctttgaagttactctttttctcccttttcataactctttggaaggaagtcactgtgtgcagcctacacgtaaggactgggaagttaccctgttcctccaaggtggtggagtatctacataatcttgtggaattctgttctggagagttgcctgttctcccccatttatttacttatgtcagtatggactcatgtatatttactttataccttgggttataatccaatactactttgttttgttgctcaaattgttccagctttggccactgagagtctttcagttggcagtgcagctgttaaaaaaaaaaaaaaaagccaggcttggtggctcagtcctgtaatcccagcactttgggagtctgaggcgggaggattgcttgagcccaggagttcaagacctacatgggcaacatagtgagacacctgtttctagaaaaaattaaaaaaaattatgtcactagatgacacatgcctgtagtcccagctcctcaggaggctgaggttgaggtgggaggatcacttgagcctgggaggtcaaggctgcagtaagtcatgattgtgccactgcattccagcctgggtgacagagtaagaccctgcctctgaaaagaagaaaaaaaaatttctttgaaccaacatgtaatgacttccaggatatatttcgtgaagaagtcaaaggacaaaacagtatttatagtatcctagcgtttgtataaaaaaggaggagaagatagcaaaacatatttgtatctcttcatttgtgcaaaaagaaacaagataaccagaagctaatgagattgattacgttctgagaggttggtaggagcaaagcagagagagtggaggagtgacacttttacaaaatcttttggccggtggcggtggctcatgcctgtaatcccagcactttgggaggccatggcgggcagatcacttgagtccaggagtttgagaccagcctggccaacatcacaaaacttcatctctaccaaaaataaaaaattagctgtgcgtggtggcggacccctgtaatcccagctactcaggaggctgaggcaggagaatcacttgaacctgggagacagaggttgcagtgagctgagactgtgtcactggacgctagcctgggtgacagagtgagactgtgtctcaaaaaacaacagaaaaaaattatatgttttgtataattcatgctgtttgaactttgttaatgtttcatatactcaaaaaaaggggagggaatgaaaaaaaggatgagcagagttgggaagaaaactcaaaaatggaatacaagcaaaaccaaacaaacttacttgaaatgagtcatctaattacactaaagaaaaaaatgaactaacccaagtaatttgaacgtaggctaaagacaaagtagagctgttgttagtagtatggattttgcagcagtgtggattggcagttctgacactggcttctatgtattctgtgtattccaagactgagcaaataagtaaacatattgtagacgaaaagagacaggtttcttactgtcataaatatagaagtggaaagactaggatgtatcctgtgatgttggattggaattagaggtatcagtgtgaactcatggttttcaatatatataagatgtagaatagataatgtgtgtctatgtttgtttcatgtatatattcaatatatgttttcctgtagcaatgagcatacgtaacgcccagattttgttttttaaataccgctcttccgtaaacagaaacagggatccttggagaaatgactgattgtagggctagggctgggaaagaacaagaagaacctgcaacatcttgtaccagaaagtatgacatttatcaaagaatgatagggactgttaaaaggacaggggctagcttgaagggattcccactggccaaaaatggggcagagcatcaaagtaatgaaaataatataatcaattgaataaggatccatgagtccaaactcatataaatatataaatggatgagaagggaaagtttcccttacagtagaatgccaactaaaatataagaggagtgctagaattagaaaatcactttttgttaactgttgtagtagtaattgatttagtcagtaatcattaatagatcctcatactagtgggtgaaaagtttgaggaaataattggatagttaaatggtctcaaagtgtgtccccataataattagagaggaaaaacgaatacggtgtagaaacttggcaggtagcttcttacctaggtaataaaagttaacatcaataatgggacaaattgccatgtgcctcttgatgtgatacactgaagacacaacatcacttctagggtattcctgccaaaaagtcacgacctgaatcgagttgtgaagaaacaccagacaaacccacgtgggggagcattttgcaaaataactggcctgtactctttaaaatgttaaggtaatgaaagaaaaaagagacaagctgtttcaaataaagattaaagataagaaaaatattgtttagagttggaaaaaaaaaagactaaaaagacgtgacaactaaatgcaatggcaatcctggatcgggaaaaaaaacccacccaactttttttgccttttgcatgaatgatattattaggcaaattggtgaaatttgaataaggtctataaattagatactagtgttaatgttaatttcctaattttggtaatcgtatggagacttaaatttaagtccttgttttttttaggaaacgtgcatcatatctgcaacttactcggttcagaagaaaagctcgggtgtatatgtaagagctagaaggataaagcaaatttggtgaaatgttactatttggaaattctttgtactgttcttggaacttttcttcaagtttgaaattgacaaatgtttttaaagacatctgctgtcatcaagaaatactttacctaactgatctttctgaagacttgcactttttaagtgttaaattgagcccaggagtttgagtgtatagtgagctatgatgtcactccggcacttcagcctgggcaacggagtgagaccatgtctctcaacagcaacaccaccaccacttagtgacttaaaacaaccataattctgcaggtctatatctgggggggaaaagttaattaaaagtttatcgggaggatgtctcactctgtcacccaggctcgagtgcggtggcacaatcaaagttcacagcagccttgaactcctgggctcaagtgatccttctgcctcatcctcctgagcagatgggagtacaggtgtgtgccatcatgcctggctaattcaattttttttttttttcctcctagagacaggctctcctgtgttgcccaggctcatctcaaactcctggcttcaagctgtcctcctaccttggcctcccaaagtgctgggattacaggcatgagccactgtgcctggcctgatcccagttatttaattaataaatcgagtgaattatattacctaagatgtcttctagccctgagtttgtgtaattctgttttagtcttttttgttgattagtcttcctgaatacccctgtctgtgctggaatgctgcagtgctctccaacctgcttgaagtgcatgagtgttttatctccaaatagcctaccttgctgtgcttttatcattctttccgtgcttttatagttctgctgtgatctttgcaggcaagtgttatttccacagctttcaggtgtctgtgggtggcttctgatctactggcctattttgcctaaatttgtcagcaagacttagatattctttgcatctgaaggtaaaatacagaatttagaacagcttatttcgtcaaagctacttggaaatccttgtgtattttttctgatttataaaagtaatatgtaaataatacatatcattttagatagtgttaaaaaagtaggaaagtataaagcaaacaaaaattaccttttgttcaaccatccagagataaactcactaagtactgggtttttccaccatttaaaaatttttgtattttccctttttctcttcttcttattagcattttgaaatgcccactttttttccatcgtgagaaaataaatacataagattccttcccataatcccagccttctggtatcttgtgttagcgtccctttcagagctattgaaagaatactgctttcttctttcaggttggcttctaccctcactagggtcccaaaactttcaagatcactaatgactgcactactggcaaatttggtggatgttttcagtagttacctcacttttctcccagcagcaattgattccctctcaaaacactcttccacaggcttctaccataactttctcttccctggttttccttaagtttttttggccactcttcaggataccctaggctacaccttcctgcaaaaaatcattcgctttcctggtttcagtaactcccaaatctgtatctctggctcagattttctctgagttccaggtttatctcagctagatagtggacttaactgttccaccaataaactcaacatgtccagatacaaatttatcttatctctttttaaaacttccactgtcattcttggctgaaagccagtgtcatctttaattcctccatctgcctcacctcttcctgtgagtccttaccagggctgtgtgttctctgccgaatctctcttgaaccattgttctcctttgccagtgccactgccatagtccatggcaacacttttattggggccacctgtaaaggacttctatctggtctcctggcggttttgttttcttttttgtttaaatcaattttccaccctggatttagagtgatctttcaaaaataagtttaatcattgttacctttttttttttcttttgagacggagtttcactctgtcgcccaggctggagtgcagtggtacaatctcagctcactgtagctgttaggaatctgcattttatttatttatttagttagttttgaggcagagtttctctctgtcgcccaggctggagtgtagtggcatgatcttggctcactacaacttccgtctctccggttcaagcgattctcctgcctcagcctcacgagtagctgggattacaggtaccaggccattatgcctggctaatttttgtatttttagtagagatggggtttcaccatgttagcccaggctggcctcaaactcctgacctcaggtgatccgcccgcctgggcctcccaaagtgctggaattacaggcatgagccaccgcacctggctcattgtcacctttttaatagatccttttgcctatacaatgcgttataaatgtcttgccttgtgtttcaagtccttaatgaaactcatccttgagtagctgttagtcttcaccactctcccacagctccttccccttcattcctgtggtttttttttttttttttgcaggtatatgggagaatgatatttctgtcttccaagccttgatttttcctttgctgagcttagtgcattcctcctggctccacttactgtttgctaaaccaggtcttatcatccttcaggttttcttcagcttagttggtcgtttccttttccctttcctggcctagattctcctggtgcagtcactctgtttgagtagcatcatacataacagcttttctccttcgtggcagttctcacactttttggtctcaggactcttttgcactcttttaacattatttaggattctagggagctattgtttatgtgggtgatatctacaatatttattggattagaaatgaaggctgagaaatgaagaaaaaattattttaaaattacaatgataaattataattttacatgttaagatgacatgttagcatagttatttttcacgaaaatcttatttttcaaaccagaaaaaagcgaaaagaattgcattgcttttcattttttaaatgtctgaattaataaaatatacctgaattctcatgtctgcctctacattcaatctgttgtgatgttagacttcatgtagccccgggaaaactccgctatacccttgtgggaggatgaaaatgaacaaaacaaatgtttttgtattattgagaagatagttttgaccttgtaccttccctgaaaaggtctcaggaacccctcggtgtctctggactgcactttgagaaccactgctttatggcagtgacttcttatttgcctctttccctctgactatgtactgtgagagtaggacccagatccaccttgctcacttctgtgtccctggtacctgggacattgttctttatgtaaaaggttcgcagatatctgttgattcacttattcaatcagttactcggttggtttggttctcaagaaattgacaccaggcactagagactcagtccatgtaagtataagaaaattgtagcctgtgggcatttcttctaccaatttctctggggcacttgggtctaatatttttcatgtaacatcacaagagtataattctcattttaccttagttaatattgaggtaaaaggaagcatataaattagtttttgtcatggatttttgaattaagatgtacatatgtggaatgatatgaataaatgtcaactatgtaatattgcctcacatttgaaaagtctacttgacttgaaggcatgaaaatgcattgtcatgtttatttgttgtcaaggaagtagtagtatagtaaaatacacaggaaatatttattctttgggaatgatagaggaaagaaaaaagtaaaataaaaattaagtacaaaaagtttttttaattaaaaaatttattctggaaaggtcattaggtaacaaataggagactttagtctatgttaaatgctttctggaaaaactgaccacttattcagtgtggaattgaaacgtacgtttaaaatggtggtgaagcaggaaaaaaagaaatagcatgaggcatagcttattaattatgtgttgtctggtttccatgaaagccttaattagaacgaaaaggaaaagatgtgcttattattacaactaccaagttcagcatttatgacctgtcattataaaacagatcaccatgctgtctgacccacccttgaaaatcgtgaagtgcaaacacactaattatgttcctactgaaattcaggttcttaacttcaggcttcagcttaacctgctttagagcacgcatactttttgccacgataatactcataggactagaaacaactaggagatgttattttattttttaaatcagactgaacttcaggcagatttccttatattgtaaattagtggcttatttatatgacctttatagggcatctaatgatagtgggtttttttttctttttttttttgagatggagtttcgctcttgttgcccaggctggagtgcaatggtgcgatctcagctcaccgcaacctccacctcccaggttcaagcagttctcctgcctcagcctccagagtagttgggattacaggcatatgccaccatgcctggctaattttgtatttttagtagagatgggatttctccatgtcggtcaggctggtctcaagctcctgacctgaggtgatccgcccaccttggcctcccaaagtgctgagattataggcgtgagccactgcgcgcatctgtgttacttatttgatgtattttggtgacattttgaatgggggcaaatgagaaaagggctctggcactaagcatttattagataactcttttacaggacagtgtttggtagtgaagttactctgcccatggcagtgtggccatgctgcagcttgacaccactccctgtaatagagaatggattgtgctgtgattttaacatttcccttaagaaaagggtgttaggttatgataaaacttttatactgtctttgtgaggttttggtgagttagtaagtaggcttccctatcattaagaaaaagtctttaaatctttgtttctacttgcagaacatttattccttctttgtaagaagaaccaggataatttgttcatttgtatagttgatccttgaacagcttggaagttcggggcactgacccccatgcagttgaaagtccacatataactttttgactccccaaaaacttgtctgagagtttcctgttgtctgaaagccttactgatagcataaataggtgattaacacatgttttgtatgttatatgtattatatattgtattcatgcaataaagtaggctagagaaaaaataaggaagagaaaatacatttatggtatggtattgtatttattgatattgtaagtttacatcatctgtttacaagatgatgtatgtcagtccgaaatggtaggtaaccacagctgcagacctcaatctacagtacatttcaagtagttcaactttttcctgtaatgtcattacttttctctgcttcttgggagcacttccagcattactagtggcacttcgtatgggtcccatggtgttattcaagttttatggttattacagtaaacatgacttgcttactgtgtatgttattggtatcacagggtgttataagtggataattgtagtgtctgagcccagtgtaatagcaataggaggtgacttcagaattattacggcagtacagtatataccgcagttaattttatgtagttgtgatttgatatatctttatgtttgcttacaattctctcaaatttgaatgatgctatttatgttctgtgtgtgtgttagttttgataaattttatctttttaaaatttgtatatgttttatggtagtaaatgacaaaatagactagtattcactttttttttttttttttttttttttcctgagacggagtttcactccgtcgcccaggctggagtagtgcaggggcgcgatctcgactcactacatcctccgcctcctgggtttaagcagttctcctgcctcagcctcccaagtagctgagattacaggcgcccaccaccacgcctggctaattttttgtgtacttttagtagagatgaggtttcaccattttggccaggccgatcttgacgcctgacctcgtgatccacccacccgtcttggcctcccaaagtgctggaatttacagttgtgagctaccgtgcccggccagtatttacatgttttacacatttatgccgtatctttctcttaaatttttttgatatttctaggctatggtagttcatctgtgaggttttttttaattgttccaaatgttcaaaaatgttttcaatatatttattgaaagaaaatccaggtataagtggactcatgcagttcaaatccatgttgttcaagggccaactgtgttttatacatgtgatttaactattacttgtttattaacaaagtgacactgtaaactcatgtctgtggcagtatttaaattttatgtgccccaaaccttggcatattatgggatgaaatattttactccttttcttccttttagcacaacattctgaaattttttggttattgtaatgatgttgatcgggagttgagaaaatgcctgaagaatgaggtaagaaaagtgtcaaaggatggatatggttgaacaatagaacagaacatttttgaatattgtgtattactgccattattgaatttttcccacattttagtgtaacagaaaattgactttacatgtatgaacttcctctgtttaggggaagaaatgaaagcttttctggggacagttttagaacatggctttttggccatgaacacaaatgaggaaaacaacttccttatgatgattactgtaggtcatctggatgaatttaatggtttaggaagttgtatctctggccggcagaaagacttatatcagtcacctattagctgattggtaggtaactaaaactctcagggcctcaatttctatatataaattgaggaggctagaattaggctgttttcagctttaacattttgaatttctttgtagttatggtttgtgtaagccacagggatctaatttgacttgttttggaacactgtcatctcctgaacttgattttagggcacaacttggacttgggcaaatagccacagtacacagttcattgtctttttccaggcactgccaaataagcagagtgcattttaaacctttgaaaagaaatttgattcaatttctgtttcatacatcagattttttgtgtccagaacttttaaaaatatatgatggctaaaattttgcctttcagatatcatttttgttatttttgaacttttttttttttttgcctcatattgaaagatttaaatataatatttgaagttgtccaacatctttcttttgattttgttttctgcttaggctgtttttcccttcctggattccctttaaattgtgacattcacctttactgtttgaagaactttttggagtactcagtgaagagtaatagtttgtttctttttttcttttttcttttgagacaggttcttgctctgtcacctaagctggagtgcagtagggtgatcgtaactcacggaagcctcaaactcaagtgatcctcccacctcagcctcctgagtagctaggacgacaggtgcgtaccaccatgcctggttaaggttttacacatttttttgtagagatcagagtctcactgttttggccaggctggtctcaaactgctaacctcaagcagtcctcccaccttggcctcccaaagtgctgggactacagacatgagtcaccattcccagccttattagtgtttttaaattatttactaaaaatgtttgtcctttatatgaaaaagccagtttacatgaaaaatacacctagggtgatgtttctttaatagtaaacttgtgagctggcatctgtaatcccagctattcgggaggctgaggcaggaggatcctttgaggtgaaagctttgaggccaacttgggcaacatagtgagaccctgtctcaaagaaatctcttaaaatttagccaagtgtggtggcacagacctgtggtcccagctacttgggaggctgaggcgggaggatcgcttgagcccaggagttcatggctgcagtgagctatctaggtcgccacagtgcttcagtctgggtgacagagtgagaccctatctctaaaaaataatattggccgggtgtggtggcccacgcctataatcccagcattctgagaggccaagacaggcggatcacctgaggtcaggagtttgagaccagcctagccaacatggtgaaacccagctctactgaaagtacaaaaaaattagccaggcatggtggcgggcgcctgtagttccagctactcgggaggctgaggcaggagaataacttgagcctgggagacggaggttgcggtgagcccagatcacattactgcattctagcctgggtgacagagtgagagactctgtctctaaataaattaaaaaaaaataaaataaaaaataaataaaataaatagcttatggaaaaatatagctcatattattttattcagtatggctatttgttttttacatactttcagctgtataacataggtttttttcatgtttttaaatttttttcctgtatagttcagaaattttgccactgctttgtcaattagatcttcatatgaaattgtcttctcagctggcctgagatctgttagtgactttttggtagaccgttggagatatttttcttattttgtctgagtttgttttcctatacatctcatgttttctctttgaattcttttctaagtcctctgtgtagttatgttactttattctctaatttgtagatgtttattctctaatttgtagatgtttttctgtctgcttgcccatcactaatctctgagtctgcactcatgtatttcttctctactcttaatgcttgcttcagatgctttcctgctactgtttgcttcatatgtcatctgattacttcattccatgaagcttttttatttttttattttttttgccagagtctcactctgtcacccaggctggagtgcagtggcgcaatctcagcccactgcaagctcctcctcccgggttcacgccattctcctgcctcagcctcctgagtaactgggactacaggtgcccaccaccacgcccagctaattttttgtatttttagtagagacggggcttcaccgtgttagctaggatggtcttgatcttctgagcttgttatccgcccgccttggcctcctaaagtgctggggttacaggcgtgagccactgcgcccagcctccatgaagcttttaagtagaaaaagggtatggccatttcttgttgggactccgctgtgtcactccttttattctttttttttttcttttttttagagagatggagtcttgttgtgttgcccagggtggtctcagactcctgggctcaaggagttctcccatcttggcctcccaaagttttggattacaggtgtgagccactgcacctggccttttgttcttcttcttgaaaagaaacactaatagtacttttgtggcattctcttttgtccctcttaattgttttgtttggtttggggttaattggcctttcattctgtctgtattgtttgattgagttttgtgagtaacttcatattcatccttttctccccttttattcagggaccatctggacttcctttggagatgtcttagcatattttaatgtagactatattttaatttgctttgtaacttattttattggcctgctacaaagtattatcttctgaagagtttcccttaagacccttctcaacctgattgctgggggcaatccagtagacgtgattaaaggtagatatgaaagctttttctcagagcaggtatccttccttgttctagaatacgttttattgattttttccccaacaattttatgagtaaatttaatgtatgatagataaaatgaatgactttgaagggacctggtgcttcatgtgtaatttaaagtagctttttttttgagacgaagtctcactcttgtcacccaggctggagtgctgtggtgcgatctcggctcactgcaacctcctccttctggattcaagtgattctcctgcctcagcctcctgaatagctggaattacaggtgcatgccaccatgccctgctaatttttgtattttcagtagagacggggtttcaccatgttggccaggctggtccctaactcctgacctcaggtgatctgctcgcctcagcctcccaaagtgctgggattataagcatgagtcaccgcacccggcctgaagtagccttttgacaaggaagtaataaaaagtttgaaaactaccattccagaagatatgttagaatccttcagtcaaaacttttgacctagaaaacttcttaaagattatctagcccacctccttatatttgaagttactggtccagaagagtgaagtaactcaaagtcatgaatcccctcattactctctcttgggtggcggggtttgtccctgatgagctcggtatcactaatctttaatttctgtggcctcgctctccagatctgtggctcctaaaagattctgatgtttaactgttcacatgttttcagttttttctgtttgaatttacttttacccttttccccttctgcccaggggaaaacacactcatccacctttaaagtgtgttggattggtgtatgtattataagcatgtacatatatacatataaaaacacttttaaggtcctctgctttaaatgtaggttaactatttaagaaaatctaagtgccaggctttgtgtctcctgttgtaacctgctggccagatcagaatactaggctgaaaacctcttgaggtgaaaactgtgtttatatgtagctgattaagaaacataggatttgaggagtatcaggtttgttaactgttcgtgatgaagaaaccttgggaagttgagctatgtatttccatatgagtcaataggataatatggttgctaagagctagttactcttgataatgtctaaagaaatacaatgtgagctggtctaagatgtaggcccactgtagtctatgtctgtcattgtgactggagcactgtattcaattttggttgtgatttttttttttggtaaggggcattaatgttaaagtgctttatgaaataaaagtcattttataggttagatattaaaagatggaggctgtgttctgtgcagcagttgtggaaactagcaatgttcagcgcaaaaggtagtaagtgggttatctgtaattaaatgtttgaaaattatagcagacaagaagaaataaaaggtggtagttgacaaggcagcacttttggtttaaaatgaaaaactttggaacgagtagaattgtccaacagttagacaggctacctctcaaggagtttacagggaagcacttttggtttaaaatgaaaaacttgggaatgagtagaattgtcccaacagttagacaggctacctctcaaggaagtgagcctctccactagaggtactcagcagaagttagaggactagttagactgcaagcccctggagaacatggacagaatttgcccatcttcagtacttatttaattcaaattttgggaggaaattgattgagcaaacatttgtgcatctattagcatgtagatgctgtactgtattgaatgaaattgtgctagatatgagatactctctaaggtaactatttccaatctcagatttggttaaataaaagataagaattttgtcagtaagaacatgtttaaaaaatttaaaccctgttaacctcaaaggacatttatattttgcaaatatttctaaatagtaaactgctataaatagtgacataatctgctgtttcttttctcccccccttcttttatttttcagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttaccagcaaacctgacttcaccatgtttattccctttgcctacaaccagttaatatctgagtaacttatctccttcaataaaataatttaaat

SEQ ID NO: 38371 - DNA, 10385 bp, Homo sapiens
ccctcccgctccccgcccccgcccccgcccccgcctccgccgcggcccccacctctgcctccttctactcgggcgccccggcggccgccacctctccccagcccaggagaggctgcggagccgcagccgcccagaccgcgcagcgcgggaggcaggttccgcacggtaagatggcggcggcgggcccgggcggccgggccgagcgtctcccggggccgggccgggcgggcaggcgggatgtggccggggtgcgcgccgcccccgctctgggggccttggaagcgccggcgctggcaggtgcggaattggggcgcgcagtgagtccaggcccggacggccgccccgcgccggtgcccagggggcagtcagggctcagcctccaggcgcgcggcctcaggcgctggtgttctggggcggtcccggccagcctgaggggcggcggtagctgtctctgtggaggagcgacgtccgtaacgaagtctttttaataaaatctgctgctttaaagcagaaaccgagcgggtgaggatgtaaagtgtggcatggaaagtaggagtcttcagcacacgggtgttttcttctgctgaatctttttatgctggagtttgagactaccgagttcttcctgctaacaggactggccagttctacaaagttgttgcttttcatgggcgcacgtaactgcccggagtggaagcgctgtgagtgccgatcaccgaatgggccgagagaaaaggtgccttttcctagggagctcttaacgttggtcctagggccgggcgcggtggcggaggtcgaagtgggcggatcacttgagcccgcgagttcgagaccagccgtggcaacagcgagactcccttctctgctaaaaataaaaaaattagccaggcagagtggtgcgctcctgttgtcccagttactctggaggctgaggtgggaggatcgcttgagcccaggaggtcgaggctgcggtgagccatgatcgcgccactgccctccagcctgggcgacagagcgaggctctgtctcaaaaaaaaaagaaaaagaaaatgagtccttaagttaccattaattgtcgtgaataaaaagttggtctcagtgagttttgcagttgacaacgaaagatgggtgttcgtgtgtgacagcgactcctggtttctcctccactttacctgccgctccacatcaagttttcttctgctggtgccactttctctgctttaccttcaaggttggcatcctccaagtaatggcgattctcattccctatctacgctcttcctatggtctttgctgaattcttggctttaaatatccctgtgccccagcaccgccccccccgccccttatttcactaattcatgttttcagctctgagctcaggatctgtaattcagacacctgcttgatttctccagacgcatgtctaatagtcacgtcaaacttgccctgcttctcaaacctgttcttcttccagtccttcctccttatttgtggccccatcttgcagggcctctcatgcttgaaacctgtgaccatcttctattcttccctctcttttgtccggtaatctgtctagcagcagccattgactctggccaaagcatcttgatctcaccttgctctccatctcttctgccgatgttctctctcgcttgggtgtctccctaagggactggctgctcagatctcaccaccctgcattcatcccattttcagccaagagaccaaagttttttaatttattgaaacactttagcagtacttcgtataaagtagtatgtgtaacgtatgtatcagtggcaaaagagaaagacagagtggacggtggcgtgcccctgcctgtctcaggtatccacccattctcccaaagccggaacagctgcctctggggcttcagccatttgcccctcccacaggtaaccccctcctgagtgtcagctttcatgcccttatttaaaaaaaaacaaacaaaataggtttgccacgtacatatttgttgctaaagcacatgtcatgtattttgtcttgttgttcctgataaaactcacggcagatttggcctctcctgcaactctctttttcttttcttttttttctttttttttttttttgagacggagtctcgctctgtcgcccaggctggagtgcagtggcaccatctcggctcactagaagctccacctcccgggttcacgccattctcctacctcagcctcccgagtagctgggattacaggcatctgccaccatgcccggcaaattttttttttttttttgagacggagtcttgttctgtcgcccaggctggagtgcagtggcatgatctcggctcactgcaatctccgcctcccgggttcacgccattctcctgcctcagcctctggagtagctgggactacaggcgcccgccaccgagcacggctaattttttgtatttttagtagagacggggtttcaccgtgttagccaggatggtctggatctcctgaccttgtgatccgcccgcctcggcctcccaaagtgctgggattacaggcgtgagccaccgcgcccggccgcaactctcttttttcattcagcattgttttatgagagtcatccaggtgactttgtgtcatgttcatttattttaactgctttatgaaattctcttgtgtgaatacatgaccacagtcccttctcagcaatgctaaaaatctaaacatctctgaaaccacagtttttggttttgtttttaacctatttggtggccaaaacctcaccaggtaaagtttaatagcctctaccacttagtatagatacctaacacatttcagtgaagaaataacgtctgatgatggggagtgcccccaaaccccagtgaggctgttacatggtaaattgtgccaaataatcgttgtacattgaagaattctgaattccaaaacccatctgcccaagggttttaaacatgcagttctgtgcgccacagtcccttggtccacgctgctgttgaatgaacgctcaggtgggtggcttccacattcctgccgctttgaacggtgcttctgtgaacagcgttgtctgtgtttggtgcatcctggtgagtttttctagaatataaatgtattaaaagtagaattgctgggttgtgaggagcacacatgttcagctttgtaaggagtaccagattgtttttgtagcacagtccgttctcctgataccagagtagaaaaagttgaagtgaacttattctttgctaagcattggcattctcagtctggtgggtgtcccacggcagcgttgtctttccgtacatgctcagtgtgggattctccggctcacagctcttccagcgctgccctctgcccttggaggagcatctaaacccctccctcagctgttatttttttcctgtagaaataaatcagaatgagttatgcagaaaaacccgatgaaatcacgaaagatgagtggatggaaaagctcaataacttgcatgtccagagagcagacatgaaccgcctcatcatgaactacctggtcacaggtaatggcttacagtgaggatgctgttgcatgaatgtgattctccctttttgaacacataaggagtgctgtagcactgaggtttgatgacgtagttatttgtgttcagacattatgaaaacacaatgctaacctggtaagtttggaagttatcatgtgaaagccttttctgaagatgagatttttccaggtctctgagacctaacacaaacccatttttcagcctttgacagttttacagttactcaaaataattgagactgttgtgaagtaagtatattgaaagcctaaatagttgatctcttctggccagtctgcaaaaatatgctggcctgtttctggaaagtatgcccaactcagaggatgggaatggggaagagcagaagcgtgcagagggaaataacagtcaggctgttcttgatgtcaactggaggaagggcagtgctgtatatggcaagaaaatagatgtttttaaaagacatgacatgaaaaatctccctcctgttagtccccagttccttctcccaaattaatctctgtgaaacttttttgggccaagcatggtggctcatgcttatagtcccagcactttgagagacagaggaagattgttcgcgcctaggaattccagaccagcctgggcaacatagtgagaccttgtctctacaaaaaaaaaatgttaattagctggatgtggtggcttgtgcctgtagtcccagctacttgggaggctgaggtgggaggatcacttaagcccggaaggcggaggttgcagtgagccaagattgtgccactgcactccagcctgggagagtgagtgggaccccatctcaaaaaaaatatttttggaaggtgaagaggaaatttaggcctataattatgtcaggggcaggggaaggggcacacatgctggctttgaaaaattgtagacactcttaagaggtgggagtcaacaggccactgcaggtatagctgaccatggagggcccctgtgctgtggaggctgagccagtgtgacttgcctaacctggcaccagagctgcggctgctggcgtctggacctattatctgtcctctcaaaggagcccacaccaacacactgggccagcagccattctgacctctttggctaatgggttagagtttttggatgggataacaaggaatgaagtatactcttctcattttctatatgtattttgagagcataacttgtaaattataaagatattaataccgagttcctgagaaagtgtggttcacatcagaggttattaattgaggcaattggagtttctggagatacaaagtctttgccttaattccttgctaactttcctagcagtgaagatggtttttctattcagagggctttaaggaagcagcggagaagtttcgaatggaatctggaatcgaacctagtgtggatctggaaacacttgatgaacgaatcaagatccgggagatgatactgaaaggtcagattcaggaggccatcgccttgatcaacagcctccacccagagctcttggacacaaaccggtatctttacttccatttgcaggtatgtttcaggagagagtagtctggtttgtgaatacttgataagttaaagttatttgcaatgattgagaaataactaggctaatttgctttaataatgttatttcaatgcatgtgagggggagaggtttgagtttgctcttttatgtagttcagaagcggttttttgttttaaaaatgcaaatttgataactcagagatgcaagaaaagtcttccctctgtgatgtacttttgattgggacctggtaccacctgccctaagtccctggcctgggtgtgtgggggtcaagcttgtctgtctctgcctccagcaacagcatttgatcgagctgatccgccagcgggagacagaggcggcgctggagtttgcacagactcagctggcggagcagggcgaggagagccgagagtgcctcacagagatggagcgtaccctggcactgctggcctttgacagtcccgaggagtcgcccttcggagacctcctccacaccatgcagaggcagaaggtggggcctgccagagggaagctttcttccattccccatgtgctctgagggggcttcgtgacaacgccaagtgtgtggctttgctgtgtggactgagagacaggtggcttctgtgcctgggatgctaagtggttccttcatggcttttttttttttttttggaggtgaagtcttgttctgtcgcccaggctggagtgcagtgacgagatctctgctcactgcaacccccgcctcctgtgttcaagcgattctcctgcctctgcctcccaagtagctgggactacaggagtgtgccaccacgcccagctaagttttgtatttttagtggagatggggtttcaccatattggccaggctggtcttgaacccctgacctcaggtgatccagtctcccaaagtactgggattacaggtgtgagccatcatgctcagcctctctctggcttttaatcttttatcttgtcaaactagggacaacggacttggtgatcgttacacagtattcacaccctttgctggtgtcttatatttatctgaaccttctttctgtttatgtcccaagtatttctcatttaaaatcctgtcttctgaaacttttctctcctcgctgctatgtttttgtctggcagaacatgacagctcctcgccttcccagacccaggtccctcttcccccgggtcctctcccgggggctctgtcctccctacgctgtcttggaaggatggcctgtcctagagtccacttgagatgttttcttgaggcttgtgaggagggtgctggtatgtcctgctacgctggtcttacctctctcccagtcccctcagcactttgttcaaggcttgctcatggcacttaactgccatcgaggttgcatgtgacgtttaacaaccagactgtgagcttccccaggcaaggactatgtatttcatgtcctgagagtgtctcgcagttaagagcttaatgtttgtttaaactgcctctttttaatagactctgctggtgctctgcgtgtatggtggtttttatcagatgtatttatattctaggtgtggagtgaagttaaccaagctgtgctagattatgaaaatcgcgagtcaacacccaaactggcaaaattactgaaactactactttgggctcagaacgagctggaccagaagaaagtaaaatatcccaaaatgacagacctcagcaagggtgtgattgaggagcccaagtagcgcctgcgcttgcgtggtggatccaacaccagccctgcgtcgtgggacttgcctcagatcagcctgcgactgcaagattcttactgcagtagagaactctttttctcccttgtacttttttttgacctggcatctttttatagggaaaaatggcctttgtaggcagtggaaaacttgcaaggaaagctgccgtctctttggcagtctgatgcagagcctgcactctggcactcgctgaagaatctggaaggttgcggtttgctcttccagtgttcgggggcctctggctgctgaaggattcggtctaccacggagggctgtgctgttaggctgcatcccactcaaaatacaggaaaagcacgaatcatgattctgctttctgttagcttaggcagacattgggccttcacctacaagtttttccttacccctgtggtttttgtgtttttttttttttctttttccataggaaagaatatataaatttgtaaatcctaattcaaagatggctcatgtgtgagggcattgagtttgatttgttttccctttggtctgggttgtgtggcttttgggggatgcgtgtgagggggctatgtgttttttaattttttaaatatatattttggtgctgtgtgtggtaagagacttgttcctagtggatcaatgaaccatctcttctgggcagttttgttgaaaataaaggtttctctttgatttcaagaatgaccaaaatggcctctaaaagatgttaatcatctcaaatgaccttttgtctttggggcgttcttccccctgtgatagcggcagtggctttttctggtacctgcagctggaaaggccacttggccctgtgctgagtgagcggccttcattagagcgaggcagcccttggccggtggggacgcagagccccagcaggtggtgcacgactgttggcggaaggaacgcgtgttcatcctcagtgatctgccctccagcatctcggcagcatctcatcctccatcgtcagctggctctgccgatgtcctgcttctgttcactcacagaactgtcccctgctccgtggtgggcaggagggaagtggtgcagggctgcgtgcattgcctgcgagtcgggacagttgatgggcacatggccttgtagctctgggcacagatgtgtttggattcattgcagcggaccaccgggcactgttgaccccactgagcagtgctaagtgttggtttagtggatgttcgtggaattgctgacccatccaagggcgtcctttggagccagtggagcctgccggcgcatctgaggggcagaatgctgctagcacttgaatctgggatctcgccttattctcaagtagcaaggcatctcgacaagcatggtctaggtctggtggccagcttgccagtacctgagccggtcgggtcatctgcctctgagggaccgtcctcaccgagctcctgcatcccttgagtgttgatcaggaggcgtccacagcattgttctcgcctctgaatgatgcttctttctgtgttggagcctggcgaagttgtgttttcaagccctctacttctctttccagtgggtaggagcttttggcagtgtttactttacctagatggcttatataatccagtaagagatgcaaagataaaattgctgcggttgttacagaagcatggcggcctccagactgacccattggttgccctttagattttgtaaggatgcggtgctggggaggtggtgcttccctaccccctagaaatgctgccttccaactaccactctcccagatgtgacccttgcgattatttcctctgaggtttgaggatgaagataagttggagggaaagagagtaactaataggggatgaaatatagcagaagctagaagaaagcggtgaggtgagagagatgcatctgcacgttttcttcaacagcaccaggtgattcagcatattcctaattacctttcactattcgtgtatataagatcgtttacttgcataatatatcatcaatttgacatattcttaaaactagagggtgtgagaagcacagcaataggaagtctctccacaaactaggggaacacaaatggggtcattcacgtgcctggactgtcactatgtggctgtcacgtgaagtgctggtgttgatttccatttcagccagtgggtagctgataagccagtgccagcatccagcatgagcagatgtcggggagactgggaagtctccagcgttactgctctccttcccttcatgataagccagtgccagcatccagcgtgagcagacgtcggggagactgggaagtctccgatgttactgcctgccttcctttcgtgtgaggggctgcacttgcttttcttgtgatctgttagtggacgaggtcttccaaggaagtgctttgcacactttctttgctcctttttacagtctttgtctttgcagcaagcaaatgaaattaagccactttgggataatgaacattcagtataattctactttgtctcattttggatctcactgttgtctttataaaaatggcacattttacaaagtagtttattcttattatactttctgctggagagtgccttgaaataaaatgtgagagtattctggtactctgtgttccagatgcatgaaattgggtgaggaataacccctagtctggaatctttgtgaagcatagggttattgcaaggcaaatgggaactaacacatcttgccatttgaatcagggtctccagtttctagaaaaggcagacactggttgggaccaaagtctccatggcacatgactgaagactggtggtcgtgtgtgtgcggagtccacggaagcctcggggaggtggagctgctccttccattccgtcaggacgtgatctgaaaacatgtagagaagatgagttgaggacagcttttctaaggcaatgtgatgtctttgctttcttatttctctttctctgcgttgttagttttgaagagtggaggagctaggggctccagaaagaatcttacacatgtgttgaagacattgatgtcatagggagcggggagctgcattcccttctgggctgttactgctaaatctcagtatgaacagaccaggcggaaagcttggtggccaagcagtctgtgtgcttccccgctgatggagaacgttgcgttgttcacaatagggcctcatgggtgtagccgcatggcagacccatggctggcgcagctgcctgttgccgtctgtcttcagtaactgctgctctgttaactgttctattctgatactacgcgtgttgttttttacaacaggtatgtttttgtttcagaaatatgtattgcttttctcatattttttgcaaattgtattgtcaacatgggtcatttaaagtcctgtatgaaccataacctgctgtggtacctttgtacatgtttgattctgtattctttattccagtgtggcatatgtgcccctctgtatcttttgagaagtgcggaataggttgcttctaccacctgttcttaatgtaacagtaaaagttttcacatttttctcag

SEQ ID NO: 38372 - DNA, 64196 bp, Homo sapiens
gagcccggagcaggccgggctcaagaaagaggaaagttgaggacgccccacctcggagaggcggcgcccctgagtaggccaggagcctctcttgcaacttctgccaccgcgggccaccgcggccgcctgatcccgcagaggaaggtcgcggccgtggagcgatgacccgcggcggtccgggcgggcgcccggggctgccacagccgccaccgcttctgctgctgctgctgctgctgccgctgttgttagtcaccgcggagccgccgaaacctgcaggtgagcagagcgcgccctgggcggggggcgcccggggaggctcctaggagcctgttagcgcccgtgccccgcgtccggccgagttgacgtccagcgggcgtctggttcctgggtgaactcagagaaacgcgcctccggccggcggtctcgctccagccctgcggctgcgcagcgagggcacttgagaagggcatggcgagtgcgtctgccaactttacaagttttggcccgaattcttggccaacaaatcggttcgctcctgcgccgattcttggcccacagagcctgggctggtcttaaaaactccagccaatgggcatctaaatatatttatccagattgtagggaggtatggttccggcttgccatttgttttgtgttttaaaaatttacattgactttggcttaaaatcacgattgcacgattgtcagtttgatacgtgcctggcagtgggcttaagggccttttggttttgttgttgttgttgagacagagtcgctctctgtgggcgacgctggagtgcaatggtgtgatctcggctcactgcaacttccgcctcccgggttcaagcgattctcctccctcagcttcccaagtagctgggattacaggcgtcagccaccatgcccagctaatttgtgcattattagtagagacgaggtttcaccatgttggacaggctggtctcgaacgcctgactcgggcgatccgcctgcctcggcctcccaaagtgctgggattacaggcatgagccaccgcgcccggcagttttttttttttttttttaatatataatcctaaataggattatattccccattctgcagatgagaaaagtgagattgatcagaagtaattcgcataaagataacacagcaaataagacagagttaggggatgccagagggcattttcttaactacttccctcttggaaaaacaggttttatctctacaggtattcatgcaaatctacatcctttgccaaaattaaattaaattaaattaaaaagccttggatttatgatttccgttcctaaggaggtgaagattatgaactgtaactaagggacttgaaagaattctaaagtaataataagagaattaattttgtcttatttcataatccccttttctgtgctgaccttgtacaagagtagggtggggcttgggggaggatgccccttcctaaatatgtgtactgattcttattacactaccttccatcatcaagagccttcgtttttgagacttgcttagttatcactcttcaatcttaaatctttccagtctgtgggatcagatgtacccacaggctcctgactcgtgattttctgtgttctttgcctaaactatggaggtggccttggtgtctacttctagtctagggagacagctcattcagaggtacctgggggaggctggggagggtcccaaaagtggaggtagcttttgtgtttggaatgctggctaaaatctttattccttttctgtttttttggacgagtgagattaagtgtttttgtaggtggagggggcagcctgaggagtgagacaggcgttgtttttctgaagatggagcactatttattcaagaaggtaccaccttgtaagaaactgcatcttaaacagttcctccaacaggaagctgactccatgcttggaggttctggagccaaggcagaaagtaaggacatttctgagatgaagtgatcctgacagcaccatgcccagcaatctggaaaggattcttacttacctaggtgttaaggacatctggtgatgccacactatttcagcagatgagatctctgtttcctttgtcctacccacattaatctgttttcccttgaggctttttgggtctttgtctttacccttctactagcctgcgaacaaccaaagagtaaagaactgggacttgctacctctcacttgtcatgtgttctctgaagtacccagctcagtaccctgaacttagtaggaattcagtaaacactaaagggattgcatgtccatccccttggaatggattttatatccactcatatgcatctatctatccaaaaacaacttcttcaatttttaattttacttttttttttttttactattatttcctattatttttattttccccccaggctgggtacagtggcgtgatctcggctcactgcaacctccacctctttggttcaagcaattctcctgactcagcctcccgagtagctgggattacaggcacacaccaccacgcccagctaatttttatattttttgtagagatgggatttcaacaggttggacagactagtctcgaactcctggcctcaggtgatctgcccgcctcagcctcccaaagtgcagggattacaggtgtgagctaccatgcccggacacttttagttaattcttgcatattcttcaatttgtaaaggttactctatagttttattattccagaagttgacaaataattgcacagtcattctagccaaatctttcaagctatgatttcagacatatggtgttgcgtttatctttccagaccaaaagccccataattgattttagaaggtccttatataattttttctaagtggtatgtatagagaagtcaggtggtcactagagaaataaatcatacctttatctggttctgaaaaagtttaacatcttggaagtcattcagtctccataaggtgatttggcagacctatgattggagtcagtttcagttgatcctttaactctgcagacattcttttagggttggctgctgagagactcataatatggtatgtatattggtaaaactggttcagaatctggccctcggccttgcagggctagactccagaaattcagtctttctactgctccatatctgatcacagctaagaaagctgattcaccctgatatacacccaagtctattcatcagacttagcataatttttagttagaaatataactgtcaggcagactggatatttgtgaggtctgctctaggcactttctcactgtaatcaaaccacatgggggtagataacatcacagattgtcaggctggaggcctgatttgtctgtctcctggtaggcatcatacacttgagtcagccgagagagtgcccctccactgcatggtgcttgcctagcattgctggtccctgattttgggacactgccttttccacattgccatggcttaccagtgtccacttgagaataacagttaatacctttatctggttgtcaaaaagtttaatatcctggaacattcagtctccataagctgatttggcagacctatgactggggtcaatttcagttgctcctttaactctgcagacattcttatttattcatttatttggagatagggccttgctctgtcacccaggctggagtacaatggtacgatcatagctcattgcagcctcagagtagatgggactacaggtgcacaccaccacacttggctaattaaaaaaaaaaattatttgtagagatagagtctcactatgttacccagattgatctcaaactcttgctcgcaagtgatcctcccacaggttcatttcccaaagccctggggttcaggcgaccgccactgcacctggtctctgaggacattcttatttccaaattcattcgacataaggcctcacagttgctcagtatgttcattctttacacggaagtccttcattcttggaagtatagtattagagaggtaacacagaattccagcaagaggaaatcctttggaaccctaatgcctgtgtttgaagcctgactccaacacttgccatgtgacctttagtcagttattttctctatatgtactttggtttcctcaactggaagatgggtattataagtgtctctatctcatggggctgttgtgagaaacactgtgcctgacatgcagtaagtgctgtataattgagtggccactgaagttgtttttctctaaaaagttatcatgtcttgataaggcaggcaggattgaagatgataatccatgtgctttgaagtaattttttttttgttgtttttttgagacagagtcttgctctgttgcccaagctggagtgcaaaggcgcgatcttggctccgtgcaacctccgcctcccaggttcaagtgattctcatgcctcagcctcccgagtaactgggatacaggcatgcaccaccatgcctggttgatttttgtattttttgtagagatgaggttcaccattttgcccaggttggtctcaaactcctggcctcaagtgcatcgcctgccctggcctcccgaagtgctgagattacaggtgtgagccatcgtgcccagtcccaacttgaacattttcttgtgctctccctttatcaacttgtttgcataatgtacacaagataaattccagaacaaagtctgaaggaagtgcccacttatcttcattattaaactttgtttcctggtccttctgaaaacataaatttggtagcaaagataaaaatctttagaagaatatttaaaaggatcctccttcagtgtttacattgaagtaaaacaatttttttaaaaaaaattcatggtggcttatttttataatatatatgctaagaaacatatgaactttgtcttgagtgttgacatgcagaaaagaaatttttgttttcatacttctttagacatgaattttacattgtcacttgttatcctttgcttttgttagatttcacattataaggcattaactatggagacagcaaaataaaagaggtagtggtacccttcatggaataaaaccaaagggatttattttcttcagcattttaagtaatttttatgcatttaggttttgcctttcaaaaaaatggaatggagtctagtttatacaacttatatgttacaatctttcgaacatccagcttgaaaatgtgactagaaaatgtgttaataatgttattacggagcttctttttactactgcaaaacaggaattaatgtggtaaaaaatgaaatagaggtagtgaaattatggggaaattttagcttaagacttgaaacactgtctacacagataacataatcatgttcagttacagtcttttttttttttttttttttgagagggagtctcactctgtcactcaggctggaccgcagtgctgcaatctcaactcactgtgacctccacctcctgggttccagcgatcctcctacctcagcctcccaggtagctgggattacaagcatgtgccaccgcacctggctaatttttgtatttttaagtagagacgggagtttcaccatattgggcaggtgggtctcaaactcctgacctcaggtgatcagactgccttggcctccaaagtgctgggattacaggcatgagctaccacacctggccatgatacagtcttcctagagaaaactgtggaagtctcttgattgagagagatgaaaacagaatgagcacttcaacgaaagagacaggctggctctgaaatttgtccatctgccttgcatatgcagtaataatttcagcataagggagtgtcaagttattcacaccggtgttattctctttcaggtcatttgcaaacctaggacaccaaagttctaattcataattagaaatcgagaatgactgtactatcaagtttatataacttgataaagtctgtcaccaggtgtgaccttcccagccagtgtgaaagtttgggatccaggccaggtgcagtggctcacgcctgtaatcccaagactttgggaggtcaaggcaggcagatcaccttaggttgagagttcgagaccagcctgaccaacatggacaaaccccgtctctgctaaaaatacaaaattagccaggtgtggcgtggcgcacgcttgtgatcccagctactcaggaggctgaggcaggagaattgcttgaacccgggatgcggaggttgcggtgagccgagaccgtgccattgcattccagccttggcaacaagagcgaaactctgtctcaaaacaaaagaaagttggggatccaggtggccacgtaatccataaagcattgtgctaggcccaagggagtggatacaatgaaatgtgagactccacctctcatctgcaaggagcttgtaatcaaatttttaggaccaagcagacacaaatgcataattaatgagtaatctagatgaggactgacctaacagcatggaaccagaatggggcaaagttgactttcagctgatagggcttttggcaagaactctgatttcagctgccagtgacaaatcggtatgtttcaacgggatgaaggaaagggatcattccagatctaagcaaatctccggcatttttctgcatttgtggattgttgttttgaagctagtttttaaagctgtatccctttctacttatctagtgtgtcctgcacttcctgaccctgaggcccacctcacatcctctcacttgccttttatttccacttcctgcaggtgatctgaggtgcctcatctcaacctcactgtagaaatctcttaatttccacctcagggcgtctctgaaatcacagccacttagtcctggagcacatgcagacatggagtgagggagttaacccttcctagggcaacgtttgacctttgtagtatgggagcaggtagctgggtcctccatccctgggatgaagatttccgaggctagtcccagtgggatcaacccctgtgtccacagtggaaaccagctcagaatgcacccttcaatcggtgttcctccctttcactctcccagcccaccactcctgttctctggaagtacttgccaaaataatcctccttccagcaggcatcttagtctctgatatctggagagagccaaggcttaaacacctacttgcaattttgtttactggagattgtttaatttacaaatcagttatttcgttagtgactccgatgaagagtcaaaacaaatccaaaaaccaggtatcaatttactgagagacctttcaaagaaggcaagtgcaatgccaaggtacacagaggtatactgagagactagccgagcagacataaaagagaaaagcaattcaaggaccaaaaccagtgaatttttagctaaacccaatatgaatagattgttttcattttaatttttttctattttctccaacatcttttgcttgatctctttctcatttctttctctttttttcccctctgacttctgaatatattaagtaaacattgcattgcttggggttgaaaactacctgctctttcataaatgaggtgctagaaaaattattatagaatccaaatatgggagagaatagtttaagctacttatgagtattttatacattttttttcctaagacagggtaggaattttttcaactgaaaacaatgaactcatagaaaatattaattgggctgggcgcagtggctcatgcctgtaatcccagcactttgggaggccaaggcaggcaaatcacctgaggtcaagagttcgagaccagcctgatcaacatggagaaaccctgtctgtactaaaaatacaaaattagccaggcgtggcggcgcatgcctgtaatcccagcaacttgggaggctgaggcaggagaatcgcttgaacccgggaggcggaggctgtggtgagccaagatcgcaccattgcactccagcctgggcaataagagcgaaaactctgtctcaaaaaaaaaaaaaattaaataaataaaatattaatcagagtatacaagtaaatattaataaaataaatttaattttggtgtttgggcttttacagagagaaatataaaaatgatggcacattttccatctttatttatagaaaaaaatactttttataaataagattcccattcattcaacagatatttaatcaagtgcattgattttgaggatattgctgttaaaatgtttgaattctgacttttccttttcacaactctaaagaaaataccaacaaatagctcttgctcttggggctgggtagacttaatccaagattccgagccatttagtaagtttctcacccaggcttgaaaacataattacttgagttatttcatactaacttctgtgaatgagtgctctgatgagcttccttttctgggaggctcaggtaggaggattgcttgaacccaggaattccactctgtagtgagctgtgattgtgccactgcactccagcctgagcaacagagcgagaccccagctcaaaaataaataataaataaataaataaatggctttcttttcatttagagaacacacacaaactagattcatcaaagaaacattattttgtcaggtttatagagtgttaagcagaaacagtccgcgctttcacagagcttgtataaaactaggtttgcattagaattatgtactatttttctaccttttcactattacatttttcataccagccacctcccatcatgaagatgtttttaaaaaatggaaaagtataatggcttaaactattacaggatttaagaaaatcagaaaatagcatgaatactgggaaaaccaggaagagttgaaacttagagaaaacattgaggaatggaggacctcggttggagtggagtgaaaactctgattttggctttattctcaaagcacatgctaagctgttggcaggacatttttctcaccaaaatctcttggggattgagtaaaggttttttcattcatggaggtacacgagtgtcaaaaaagcacatatttgcagaagtttctttttgtggtcaggaaattaggtaggaccagcaacagtgaaaacatagctcttggtttagtactcaggttgccttgagcaagccccaaattacagcaaaaaggagttgattggaaagggaaggggaaggcaggcctggggtgcttacgatgagaaatgccaaggttttggagaagaagaaaaagctaaaatcatgctttgtgggtagaaagaaaagagaagagacacaccttccttttttcttttatggttcctgtttatgactctgctttttattccagcagccacacttcctcatttccctacaacgctccctggagtcgagggtggaagggaatgtgtgagaaaagctggggatatatggtcaaaaatggatttggaaaacacatttattgcctttgggtggagaagggaagtttctgtgggtgctgcctacaattgtcaaattgtggccaaatggctccattaacaatcagacaattatttgtcacccgcagtttattggcaaattatttgacacctccctatttcttaatgccattacttccgattaacgattgtgaaggcctgccatgatggtcattgtactcagaagtcaattgacttaggcctactcagatcattccttaagcgtttaatcaggattagtttctaagcctgactaagccccagcctatcaccgagccccgggagcacggtgccatgatgctctagtattaagactctacttttagtgcatatttgatagacagtcttttttttttttttttttggctacgtagtatttcattgtgtatatgtaccacaatttctttatccagtttaccactgatgggcatttaggttgattctgtgtctttgctattgtgaataatgctgcaatgaacatacgtatgcaagtgtctttatgatagaacaatttatattcctttgggtatatgcccagtaatgggattactgggttgaatggtatttctgtttttaacttttattttaagttcagggatacatgtgcgggtttactgtataggtaaatgtgtgtcacaggagtcattgtatgaattatttcatcacccaggtattaagcttagtacccattagttatttttcctgattctctccttcttccctccaccctgaagtaggtcccagtgtctgttgttcccttctatgtgtccattagaaacataatggactaaaggatgtgtctcatcgtttagctcctacttataagtgagagcatgcagtatttggttttctgttcctacgttagtttgctcaggataatggcctccagctccatccatgttcctgcaaagcacattattttatccttttttatggctgcatagtatttcatgctgtatatgtaccacaatttctttatccagtctaccactgatgggcctttaggttaattccatgtctttgctattgtgagtagtgctgcaatgaacatatgtgtgcatgtgtctttatgacagaacaatttatattcctttgagtatatgcccagtaatgggattactgggttgaatggtatttctgtttttaggtctttgaggaatcaccacaatggttgaactgatttacactgtcaccgacagtgtataagcattcctttttctctgaaacttcaccagcacctgttatttttttgacattttaaataatagccattttgactcatgtggagtggtatttcattgtggttttgatttgcattttgctaattatcagtgatgttgagctttttttcacatgcttgttggccacatgtatgtattattttgaaaagcgtgacagacagtcttttttttttttttttttttgagagggaattccgctcttgtttgttgcccaggctgaagtgcaaatagcacgatctcggctcactgcaacctccgcctcccaggttcaagcgattctcctgccctagcctcccaagtagttggaattacaggcttacgtcaccatgcccagctaattttgtatttttagtagagacggagttgctccatgttggtcagcctggtctcaaactcctgacctcaggtgatcctcctgcctcggcctcccaaaatgctggaattacagcggtgaaccactgcacctggctgatagacaatcttaacatcaaaaagtaaaatgttggccaggcacggtggctcatgcctgtaatccaagcactttgggaggccgaggcaggcggatcacctgaggttgggagttcgagaccagcctgaccaacctggagaaacaatgtctctactaaaaatacaaaattagccggatgtgatggtgcatgcctgtagtctcagctactcgggaggctgaggcaggagaatcgtttgaaactgggaggtggagtttgcggtgagctgagatcttgccattgcactccaccctggatgacagagggaaactccatctcaaaaaaaaaaggtaaaatgttggtccagtttggaacgtttgccaacaaataaccctgtgtaaatatttaatctgaaaactttctagcctcttaatcactaaaaactcaatatgtctaaaactaaactcctgatccctcccagacatattgtccatgtgcttcctttcttggtaaatgatacaacatccatccactgagtctcagcctaaaacctgatagtcattctggcgtcctcccacctctctgatgactgacctgaatgtatagattcttcaaccagagcacatgtgtaatggcttctcagacagagaaaagaacacgtcatattttaccatttcctttctccatgtcttatttccttgtttctttctctttcttcctaagtcttccttcctttcacaaatatttattgagtacccattatgggccaggcactgcaagtgctgaggacacagtctctggcctcagggagcttctagtctaggagcaggggcaagcatgtaagttacagtacagtgtgacaaggcataaagatggtgtgcttacaagcattgagtttgtagaggaagtcattccctgcaacagaggtgctgcttcctgggtcctaaatagcaattttgagattgctaggtggctaaccagagggaaaacatcaggcagaaaaaatagcatctgcaaagtcaaaggtgttgacctagttactggcaggttggagagctgtatgtgatggtctctggatcatcgaatgtgcgtgtgggtgatgaggaagctggataggtagatggaaaccaggtcacgaaggccaagtgggaagcaaaactttttgttttgttttgtttttttgtttttgagacagagtttcgcacttttttgcccaggctggagtgcaatggcacaatctaggttcacagcaacctctgcctcccgggttcaagcaattctcctgcctcagcctcccgtgtagctgggattacaggcgcacaccaccatgcctggctcattttgtacttttagtagagacgaggtttctccatgttggccaggctggtcgcgaacccctgacctcaggtgatccgtcctccttggtctcccaaagtgctgggattacaggtgtgagccactgctcccagcagcagaacttttaagaaatagaaactattgaacattcttagccggcaagctaacaaaatcagttcacattttagaagtgctactctggtagagaacgaagaatggattaaaggtcagagaaaccttgaaaaagtcctcttctatacttaaacggctagttgtgttacctaaagtagcataaaaatatagggataaagaggtagagattggtgggagagatatttagaaggctttgattaaacataagttatgagacagagaaaggaagccaggatggattcaaatttcaggctgggagatcactgagagagaaaacaccacgatggaggatatttcgaatctctagtgcgatggaatcatccagattgtgttattaagtgtgctgtggggtattgaagataaagaggaacctgtggggagaatgaggaaaaaggcaggcacaggaggagactggggagggtgtagtgtcccaaaggccgtggaaggaaaaagttttaagagtaagtggtcatgagtccaatgcattcagaagttcatatgacattaggactcaaggattttgttagtgacccaggcagaagacgcattggtatcctggaggtggagagcagactgcagccggctggagcaagggacaggaggaggaagtgcagggtgtgagtgcattcctctttccagaaggcgaggcctggaactgtgccagtcatgttcacagctctgtcaccagcactcaaaacagtccctgattcagtgtggacactttaaactttgtaatgatttcatgaagggagtgagagattctagcaatagctctgttgggtcacaggatccagatggcttctgtagttggtttatttttagctatgagacaatggagcatgttaactatgccaaagggggagaagctactgccgagagagggagctttagggcacagaagcgagaggatacaagatagaacagagttcctaaaggtggtagagtgagatccagagcatgggtcaaagaatggaggtgaaccagaatggagagatgggcgtgatgagtgcagggattgtgtagggacggacccacaaaattatcaacaccatacggagtcacaggtgatagcttctagtttttctgcaaagaatctaatgtcatatgacattagatgaattaagcaggagacaagggataaggagcctgagaaaggtgatgttttgttccacctgttaaggggaatggaagaagttgctgactagggacaagagccctattcttgtctgaattaagaagtaggcgttggaagtgagggcaatctggctgcgacatctgtcaccccattgaccaccagggttgatttggctgatctggctggctaggcgggtgtccccttcctccctcactgctccatgtgcgtccctcctgaagctgagcgctcagtcaaagaggacgatcatccctgatagaggaggatcggtcttcagtcaagggtatacaactagctgagccatcctgcgagaacctccaaacaagctctcaataagtaggcgtaaggtccagctccagccctgcccagattcccaccctctaaggatgaaacactcaggctcacctctatgatgctgtagctacacccccacctttgaccttgctctttgtgttttgggcttatcccccttgattgggattccagtttttccccacttggaattaagggcaaactgtaacggcagatttcccaattctaatagaatggaaatctttaaaagcaaacgtcttgaaattgttggatacataggaaaaaaatgcatcacaactcatttgaatggcgtttttgtcattattcccttttcttctaggagtctactatgcaactgcatactggatgcctgctgaaaagacagtacaagtcaaaaatgtaatggacaagaatggggacgcctatggcttttacaataactctgtgaaaaccacaggctggggcatcctggagatcagagctggctatggctctcaaaccctgagcaatgagatcatcatgtttgtggctggctttttggagggttacctcactgccccgtaagtatcccagtcatggtagagccactgccaggcaacccctgtccttcccatgttccacagtgactctcatcttcctggcattgcacattagaactgaagagtagctggagttcacatgtgtgatagagacattatcagaattgcatttttgcgggggtgaggcatgggacacagtctcgctttgttgccaggctggagtgcagtggcgatcatagctcaccacagccttgatctcctgggctcaagcaatccttccacctcagcctcctgagtagttgggaccacaagcatgagccactgtgcccagctcagaattgcatttgctcccataatcagtacctgcctaaaaggaacaaaacctccaagtgtggcactctttaattctcatggcacttacttcttaaaaatcttcccatcccatgaaaccattttgttttattttatatatttttgcaaagacagggtctccccatgttgcccaggctggtcctaaactcctgacctcaagccatcctcccatctttgcctcccaacgtgttggaattacaggtgtgagccaccatacccagccatgaaatgattttaaagacagcaaagtcatttcatcctactagtcacttgttgtctggtagaaagcaaatgagaggtggggtcactccttgagaacaacagagcagggaagagtaattaaaaataaacggttggtgcatttatttccagccatcttgaaacaatagctccatgtgggcagagatttttaaattgaaagtataatgagtctaaaataaatgtttcttctagttctaccattacttgattctagtgtccttgccttgccttataaaagtaacaaggacgtaattaataataatgcaatcaggatacatgccttttagagaagaggtctttaaggaaaataaagttgcaatttatttaatcgactctcatccctcctttgatataaaaagtatcttgatgactttgcttgcctcttttattctctgtgacctagattgttgagtgcagtttaaccaaactttacttgggctgttactgccttagtcatagtaagtgaaatgtcagtcttaatctattttgagtactggagattgtatcagatgttgaatgactagttattgagctctgattgctcttttttaatacaaactacaaatttttgtttttatttttatacccaatttttttaccctaccatacaaatctccttaacggtgtactattcatagatttataaaacttcataaactgaattagattttttaaacatgtttaaaaccatattatacaggtaaaaatctgaacttctccaaatctttatccacttctgttcgcactgaattctgattgtgttatttaaattgagtcgtgagtttgaagaaacaatttgaaccaaagttgtgtgaatataaataggttagattaactcatgagtgacatatacagtgggttattaatggaaactgtgatttgcagaaagcagctctaatctctgagaatgttctaagaatgcacgtttcccttggatatttctgttggtgttattgttagagctcacagagatttagtgggctttgacaaaggtggcacctctgatattcttatgtctcagaaaaaaataagctttaacatctcatagcagccacttttgaaggtggctttatcattttgccttcattttttagataaagcattgacctattcttgagtaactttatccactagccaaaaaaaatctatagaaaaagccattctaataataactttttaaaaatacttctgtattagagtaaaaattgtttgtttgttttgagttagagtctctctgttgcccaggctggagtgcagtggcgcaatctcggctcactgcaacctctgcctctcggattcaagcaattcttgagcttcagcctccctagtagctgggactacaggtacgcgccaccatacccagctaatttttgtatttttagtagggatggggtttcaccacattggccaggctggtctcgaactcctgacctcgtgatcctcccaccttgtcctcccaaagtgctgggattacaggcatgaaccaccacgccaggcctgtattaaagcagaaattttatttatttatttatttattttaagacagggtcttgctctgttaccaggctggagtgcagtggcacaatcatggctcactgcagccttgacctcctgagctcaagagatcttcccaccttagcctccacagtagttgagcctacaggtgtgagccaccacattcaaataatttttttttttttttgagacggagtttcactcttgctgcccaggctagagtgcgatggcgtgatctcggttcactgcaacctccgcctcccgggttcaggagatttttctgcctcagcctcccaagtagatgggattacaggcatgagccaccacgcctggctaattttgtatttttagtagagacggggtttccccatgttggtcaggctggtctcgaactcctgacctcagatgatccacctgccttggcctcccaagtgctggggttacaggcgtgagccaccgcacccagcctaattttttatttttagtagagatgaggtctcactatgtttcccaggctggtaattttgtttcttaaaaaaagacactcgctatactattcaggaactgttttcttgtttaatttgcctttttgccatgtcctttcaaaaaaaagttgacacgtataagtcagcctttgaaaattttaaaaacaaacaaacaaacaaacaaaaagacttcttgcaaattgtgatgcaggctttgagcatctgagtctgccttcccttcagaccagtagcagcagcccaagggcaaatgatcaggagtggggcagagatagctctagaatctctaaaactatgtccttaaggaaaagctggttcactcttgctagcaactctactgcggagaacaacctcaaaagagcttgttagccataagtacagagtacaagagagaaaagcactccagtggccagaatagtcaaagaaggctttgtggaagaagtgagttgtaggcttggtgcttgatagaagagaactactgcgtttggctgggaagagggataaagtcattctgagcagaatgtaatggaacagagtactgaaaaaaggcactgagtctgaaatgagtaagttgcatttacaaggagtgaggagtggctgggcacggtgtctcacgcctgtaaacccaacactttgggaggccgaggtgggaggatcacctgaggtcgggagttcgagaacagcctggccaacatggcgaaaacccgtctctactaaaaatacaaaaattagactggcatggtggtatgcatctgtaatcccagctacttgggaggctgaggaaggagaatcactccaaccaggaggcggaggttgcagtgaattgagattgcgccattgcactccagcctgggcaacaagagtgaaactccatctcaaaaaaaaaccaaaaacaaggaccgaggagtggaagctccagttgaacaatcgaaggacggtgggtttcaaaaggcaaatgggggccatgtgtggaaggccttggatggaagtgctcccaacagtccttctctacttggagcacagagtgcccgaggtttcttaaatataaaagatgacctctctgtcatctctgtctagtgtgtgactgtggtcattttcccaccttctcaaagaggggcttcccatatatgtggtaccaagagcctgagaggacctctgctttgcagtctttgatgcagctcaaaggccatctcaaatgctgtcttcttgatgaacctttttaagatttcattcccactggattagagctccatctctctcctctaccacctgttagtgccttgacggccaccgtattttgttaatttttatagaccccagatgtctggcatagtgctttgctcccagccgttacttaattacatgctaatcaggtttaatggaattctattgttccagttctattagaaacaaattctaagtatgaggtatatttccatgtaatggagtgtgatggtagcagccttgaccaaactgaagattcttcctctgatttttcactctataggacagttccctaagagttacagattcagcctttgatgtctcatgaatgatataaagactgttaaataatcatggatcgatttttaataaaatgagacatgaaacctatctggaaagcatggtgataagggtatggggacctggtctgctctagtttttaataaagcagctgatctcttatgttgttcacgcggctgctgaaactccctcctctggtattacacagtttgaatgagtcaactcagcacaacaaacacttgttttgctactttgtgcgtggcactgaggataggaagaaacgtagggagttggttcctgactacattcttcaaaggcaactccttttacttacattaatatgttgagacaacattgctaaaacagtgatgaaaagaggttctactaaggtcacggcacaattagagaaagtagtcagtggtgggacctcctttgtgcttggtgttacctcttttgctccatttggtgttagaaactgaatatgcttctaggtccagactgtgggcaaagcaaactcagacacagcctcaccctcaaaaatttcttcttcttcttctttttttttttttttttttttttttggagatggagtctccctgtgttacccaggctggaatgcagtggcacaatctcggcttactgcaacctctgcctcccaggttcaagcgattctctaggctcagcctcctgagtagctgggattacaggcatgcaccaccactcccagctaatttttgtatttttagtagagacagggtttcaccatgctggccaggctggtctcgaactcctgacctcaggcgatccgtctgcctcagcctcccaaaatgctgggattacaggcgtgagccaccgtgcctggcccaccctcaaaaatttctaatgatgtatcaaattgtaattatttgtaacttaaaattgaccataaaataccaatgacgatgataatcatcacttatataccatttacaatgtgtcagactgttcaaagcatttgacatatgttgagttatttaatccacagtaccatgaggtatgtatcattataatcttcatattatttatatgaaaacttgggaagttaggtaactagctgaaagtcacgacgcttgtgagtaggagccaggattggaaaggaggctatctagccccagagtttgcatgcacatgccccgctaccacagacaaatggattcatcactgtgggaaatactaaaggagcccaatatggtctctgactcagggaatccaaacaggagagcgtaggaggtagtacatgacaggtgctaaatgatgtgttattgccatcatgcaaaaagattctgggaaagatgggtgtgcacatgtctttttgattctcaacatgtagaagaggtgttgaagaggtaaatgtgagcaaaatctcagccaaattagcaggaaacttactgactttacacactgcaggagctgaaacaaaacctaactcatccatgaggttgacgctagtgttgcctctgatgagaattcagaagcatggaaaagttgggaatcctgcttttagtaagatatagcttagaagtagtggagtcaagctttaaactcagagctcaaagcctggattctttaatgttacactacattgctctgccacacagaagtgtagggtcccaggacgagggatgagggaagggcctcaacctgaagaaactgcaagaagattgtattccttggagcccctgtgtgtggcaggactggctgaggcccccacttctcatctcaaggtggaggtttctctccccttgtactgaatgtcagaatcaaaaaagctagtctacacacacacacacacacacacacacacacacacacacacacaaagccaggtgcagtggctcacacctgtaatcccagcactttgggaggccaaggcaggcggatcacctgaggtcgggagttcaaaaccagcctgaccaacatggtgaaaccctatgtctactaaaaatacaaaattagccaggtgtggtggcacacgcctgtaatcctagctacttgggaggctaaggcggtagaattgcttgaacctcggtggcaaaagttgcagtgagctgagatcacaccactgcactccagcctgggtgacagagctagactccatctgaaaaaaaagaaaaaagaaaaaaaagaaaccagaagaaaaattttaataattctggcccagttaccttcctgtatttctatctgtcttgtatatggttatatagtagacatcctcagcaatgacactcaagtcaggattaatgttcctctgtttaaggattttcccatctaggcaatattgacattttgggttggattgttctttgctgtggtaagctgttctgtaccttgtgggatctttagcagcatctgtggcctctacccactagctagcagttgcaccttctccctcactcagtgtgacaaccaaaaatgtctctagaaatgctccttacagggagaaatcatgccagttgagaactactgccttatcttgaaatagactgaaaaatgtgggggatctggaactctgggtggagctaggcagggtgcagtgatggaagactttggataaaaagtatgaattttttgtttctttacctgagtgagcattgtaagtgaagagcccacaagttattggtttccaataaataaaactattttcatataactgttttttgtttttcatttttttttttttttgagacagaatcttgctctgttgctcaggctggagtgcggtgtcatgatctctgctcactacaacctcagcctcctgggttcaagcaattcttgtgcctcaaccacccaagtgctggggttacaggcatgtgccaccatgcctggctttttgtatttttagtagagacagggttttgccatgttgccaaggctggtcttgaactcctgatctcaagcaatccaccaacctcggcttcccaaactgctggaattacgggtgtgagccaccgtgctggccttcatgtaactcattttaagagcatgaggccaggacagaggatccctttcttgtcacccacacacttgtctagctttattgctgttcttgctcttgtattaagaggtggtagaaagtaaccgaatggatcaaagcagaggtatgtgacagcataaactatatgtaaataatagttaaatgtgatgattcaatttaatatatatacacaggtaatttgaaaaaaaaatctcatgaggtaaagtttattaaattccaggaccataaaataaaaaatttcaaaggatcataatgtcgtgtacttcaccagcaataaaactattctcagtttattagtttcagttctggaaacaactagataaagaatatctgaagtttcaaagtgtaggagccaaattcccattcttggaatccagaatggcctccaattctgaactccctacatcagtgaaaagcatcagataaaaaccagaacgaggactgtaggtaaatattcagtccagagggtgcagggacttcctctttgctctaaacttagagcaaattatagggaaaatatgtagaaagaaaacctcatagtaacacacctgggctccagaacaagattaaatgtctcttctaccagaaattgaacagaaaacaaagtgataaaatatggatctgctggcccttggcctgaagccagcagaggcagccacctgctgatgggtgagggcctcaaggctctgagtgagctgagtcaaggctgggagccagatgcttttaactgcttgtagaaaggaggccacaaaatagtgttggtgatgtaagtcctagcctacagatttataagaaacggtaagcttgggggtgtggggtggggaggcagtggcaaccaaaagccaaagcattcacagctggtttagttatttacaaatatcactgcaatattccataggatggaagtcccaaaaaggcactgtaagacctggttcctaggactcagatggaggcatttggacagagaaagagggagggagagagggagagagacagagaggggggaaagaaaaatgcctacacaccaaagttccaaaatccacaaagaaattgaaagacagtcaacaaaatcaacaatatgaatatactccagattaatttttagaatggtttaacaaagactttaaatttgcatagggtgctttaagttataaatgaaagaaaacttggagaatttattaaacaaggaataagaagtaagaagatgattttttaaagaacttgttaaaatataaaagaaaattatagaagttaatttttaaaaatctcaatacatagacaaaccctagactagatacaatcagagaaaaaattctgaatcagatattagtattgagggatttataccataaacagcccaaagagataaaggggtaaaaattatgaaaaaactgttattagacatagcaattagattgagaaactctgatatagacctattaggagtttcagaaaaagagactagaggcaactgcagataagcaataattgacaaggtaattgctgagaatttatcaaaatggaaaaaacgggcccagtgcagtggctcactcctataatcccagtactttgggaggctgaggtgggtggatcacctgaggtcaggagttcaagatcagcctggccaatatggcaaaaccccatctctactaaaaatacaaaaattagccaggcatggtggcaaacgccagtagtcccagctactcgggaggctgaggcaggagaattccttgaacttgggaggcggcggttgcagtgaaccaagatcgcaccgcagccctccagcctgggtgacagagcaagactccgtttcaaaaaaacacaagtccttagttggaagacacagccttttaaattgctataatgcagcagatgagactgcagacaattgaagataaagggaacaatcttaaaagctattagaaaggaaagacattaactacaaaggaatttcagcaggaagcatattgctgatcatcagcaatagtgtcagaagataccaagatattatcttaaaagtattgaggagaaatatcttactagaatgttataaccatttaaattatccaagagtaggggcaaaataagaatatgttcagatacataaattaaaagtttaccacccaaagacgtctattaaactgttagaggatatactttagcaagtataatagtagggaaggtgtggtatataaggaacaatcgttaatacaagaaacaaaaaattaatacaatttaattgtaaaggttaaaaagaaaataatttttattttttttcctgagatggagtcttgctctgttgcccaggctggaatgcaatggcatgatcttggctcactgcaacctccacctcccaggtttaagcgattctcctgcctcagcctcccaagtagctgggattacaggtgcacgcctccagggccagctaatttttttgtgtgtgtatttttagtagagacggggtttcaccatgttggccaggctgttctcaaactcctgacctcgtgatctgcccacctcagcctcccaaaatgctgggattacaagtgtgaaccatcgtgctcggcctaagaaaataatttttaaatcaaaatttttaattaaaaaggtaaaactaaatctttgaacaataacatgatggaggatgtcaatgggtagttaaaatttgctaaaatatgctttatgtttggaggaagagagaaatataaaactcatttagactttataagaaaatattagttatatctttttaatattaagaataaaaatacattctataggttttaaatcagcaaaactgaaaagaaaataacaaaagtattatctaaacaaagaaaacatgaaagaggggacaaataaagggatagtaaatggaaaacagaaaagattatagagataaatccaagaatgttaaaatcccagtaatataagtggattattttaatcaattaaaaatattaactgtacaccatatgagacatttttaatttttttaagttttaaaataaagaatcgctgcaagctctgcctcccaggttcatgccattctcctgcctcagcctcccgagtagctgggactacaggcgcccgccaccacgcctggctaattttttccatttttagtacagacggggtttcaccgtgttagccaggatggtctcgatctcctgaccttgtgatccgcctgcctcagcctcccaaagtgctgggattacaggcatgagccaccgtgcccagccagtatgatcttttttatagtgtgttgcgaacatgataaataattctatacattatttatggttaaatgtatatgtagtaattgcataaaaacatgcatgggaataatcagattcaagactgaagttattacctcttgggagaagggaaaacaattagcatcaggaagtgcacacagaggcttcgactcaaattttttgtttgatttttaaaatatatgtggcaaatatggcaaaatataataacttaataaagttgagcggtgaatacttggggtgttttcaatattctatccttttctatatgttgtaaatatttcccaatttgaaactgtgcatttattaaggaaaaaaaagatagtaggcagagtttgtaataagggacatcctagttagccaaatgattgaataatttactgtgatggagaaatccaagaagaaaaatataaatgtaataattttcatgtatcatttcagacacatgaatgaccactacacaaacctctacccacagctgatcacgaaaccttccatcatggataaagtgcaggattttatggagtacgtataatagcttttctcttttcattgttttaaatgttggaggcactgaatctgtaatttcaagcagcaattttttgccaatttctttttaatctctttagcaggactctagagttattcttgtagtagggtatagcactttttgctaatggcatgaaaagtggttgcagacaacatgctctctaatttcagctctttcaaaggttgagttgaatatcgcatactcaattgctaacacggttagaggaacatcaccagtgtaaagtaccagtgttaagtccctgggtctgttcctcatggaggcccttctccttttttcagggatcccctctcctcgctctttaagatgtttccttttcatgagcctgcttactaatcctagctgaggtcttcaataatatctaaagttataactcttaacaccctctgagaatatttccattttaataaagttttctaagactaaagttttaaatgtgtttacatttgtgggatgacaggagattaatttggggacagaaaggctcttgggttggccctccaaactgcactctaagcaacctcttcatgaaatgcttaaagtcctatagagcttcagttaaaaaccactgggctagatcccatgaagcaatgacattattctaagattgagctagtgatagcctggacaagtcagaaatagttttcagtacgcaaagttatatcaaatcatcccataaaagttcagagaactggaagaagagtgaaaggaccattaaaaaatgacatttttgctaccatgctaggacagaggcattgaagcggttactaataacaactgaaacggaatgaatcataagctatgcaaatgatctgagagaaatacaaacagatataaaccaccttgtccttagatttttgtcccgttgtttaactttactacttctacaactaaaagtaaggtgaatcaacctacctttattgactttgtgaaacattgtggttttacacaaaatgcatttggatagtctctccttgacatgtttaggtcttgtatcacagttaggtcactatcacacttatgcttttgttctagatacagcacagaagaagctgtgaaagaagaatcataaccctagggagaaattaaaaatcagttagaatttgccctgaagtcctttgagtgactggagtgttacaagatctagaatttaaatcacattagcataagtgtctgagtatataatctctcaatgcctgctttgatttagctttgaatgagcaactattgagactgtggtgcaaatctaatttctcttccaggaagcaagataagtggacccggaaaaatatcaaagaatacaagactgattcattttggagacatacaggctatgtgatggcacaaatagatggcctctatgtaggagcaaagaagagggctatattagaagggacaaaggtaggactttaaacaagcttctcagaatttatagagtatggtaagaatattgaatgttatctttaaaataacattccaatttagaagcaggtcaaagtagaactacagtataaattccttacggaaaagaactgtcatagctctcatattgcagcacctaacttacaaaattacaagcccaaaacacaaataagccaacttgtttctgtgtattttcaatcttccataatactgggctcaggattaggttaaaaagcatagtatgaatgtactgggtttttagctaatctgataaaactagtgttttagactgcatgctcattaagacaagatgtttaagtatacaagttctatgtttcccacactccacaacattcacataaacacatatccacacaaacacatatacattctaattctgggggaaagctttactgaatcactaaggcttccaatgtaccatttgatgtacttccaaaattatggatattttatttcccgtgataatatatgtctaaatgaaaaatgtatattatataactgtcttttggtctattttgccagtatatatgtatataatctgtatattatataacatgttacatttattatgttttgtctattttgccagtatatatatatatatatatataaataatatttatattatataactctctttttgcctattttgaccagtgtgtgtgtgtatatatatatatatatatatatatatatatatatatatatgtgcatagcttttctttgaactttttgtctattttgtccagtatttgtatatatatgtatatgtatacatatatacacacatatatacatgtacatgtctgtgtatatatgtgtgtatatatatgtgtatatacacatatatattgataaatgtcaaaacaataatacccagtgaaaggaatgagttacagaaaaatgcatacagtaagactctaacttttttttttttagtcagagtcttgctttttcacccaggctggagtgcagtggcatgatcttggctcactgcaacctctgcctcctgggttcaggtgattctcctgcctcatcctcccgagtagctgggactacaaacttgagccaccacacccaactaatttttgtatttttagtagagatgaggttttaccatgttggccaggctagtctcgaactcctgacctcaaaagatccatccgcctcaacctcccaaagtgctgggattacaggtatgagccattgcacccagcccacacaatatgactgtatttgtgcaaattcaaaaaaggtagattttaaaaaatatatcttaaaaatatatatagatgataaatatattatatatagatgataaataatagagaggcaggtaatgagctatacaaaatttagcatagtggtgaccgctggcgggaaaggagagagatgagattggagacttccaaggcactgctaatgttccatttcgtaaactgtgagttgactacatcagtgtttatttatttttccttaaatggtatgtatacatctttattctttcagatgtataatatcatctgtcctcactcttctaagcagtgttccaatgtatggatgtattatacagtataacaaaagaaatgcaaatatcaattacaatgggatactgttttgcacctatgagattggaaataaactaaatgtttaatatgttgttgaggatggaagagttttatttatttatttatttatttagagacagagcctcgcgatatcacccaggctggagggcagtggttgatctcagctgcaacctccgcctcctggactcaagcaattctcgtgcctcagcctcttgagtagctgggattacaagcatgcgccaccatgcccggctaatttttgtatttttaatagagatggggtttcaccgtgttagccaggctggtctcgaactcctgacctcaggtgattcactggactcggcctcccaaaatgccgggattacaggcataagccactgtgcccggccagaagagtataatttaaacaattcgtatgaggacaatttggcaatatctattaaaatctaaatcacttctaggaatttatcctacacatagactcaaacacaagcaaaatgaagcgtccaagattaattattgtggcattgtttacaatatcaaaagactagaaaccacttgaaaattcatcaaaaaagagtagttaaaaatattataatacatccgtacgttggaatgctgcttaggagagtgaagacaggctgggtgcagtggctgacacctgcaatcccagcactttgggaggccaaggtgggtggatcacctgaggtcaggagttctagaccagcctagccaacatggtgaaaccccatctctacaaaaaactacaaaaattagctggacatggggcgggcacctgtaatcccagctatttgggaagccaaggcaggagatttgcttgaactcaggatgcggaggttgcagtgagctgagatcgcgccattgcactccagcctgggcaactagagtgaaactctgtctcaaaaataaataaataaataaataataattaaaaaaagaagagtgaggacaatttttacatccaatataaaaatatccccaaaacattaaatgaaagatactaagacaaaaaaaatcaaggtgaacaacagcacatatgacacactaccatgtatgtttttaaaaattttatttacaagacatttttaaaactctggatccaagatcacagtgccagtagggaaaaataaaaaaatcaaaaaactctggcagtatatgcaaaaaaactagtaaaaatgattaactagaaatggtagtacctgagaaaatggagaacaggtaaaggaggagactttctgatataaactttgttataattttttttaaatcttgactaataaatgaataatttattcaaacaaacaaaacagagatgatatttatataaataaaaattggattgaatttttgctttggttttagttttttggttaaaatgtcatttgtgtttgtcttcccaccacctctaccccaaaaccaatttgctgatgcctaacccggacctgctccagcagattgaatcttcctggagccgtgctctccagtttgcacaaagttcatgttcaagtacaatctgataattgcttcaaagtcaatgctggctggtcagttagtcttatagtaaacacacaatcaaaaccaaaagcatcttagttgaatgtttttgctgtatagcagtggttcttgtctaagagtggttttctctccagaggacacttggcaaagtcttggagatatttttggttgccacaactgtgaagttgctgctggtacctagtgggtagaggccagggatgacgctaaacatctcacaacgcacaacaactgaaaagaaagtatcggccagctcaaaatgtcaatagtgccaaggttgagaagcactgctgtagagtgcaaacagaaagctctgttttactctccaaggagccactcccaaattctggggctatcaaaacatgccaaaacagctcttttaaactataaagccataacaattattttataagctacaataaaaatctagcgtacctgttaaattagagactcttcgaaaataaataactttttttttttttttttttttgagatgcggtctcgctctgttgcccaggctggagtgctgtggtgcgatcttggctcactgcaacctccgcctcctgggttcaagcgattctcctgcctcagcctcctgagtagctgggactacaggcgcccgccaccacgcccaactaatttttgtattttcagtagagacagggttttgctgtgttggccaggctggtctcaaacccctcacctcgggagatccacccgcgttggcctcccaaagtgctgggattacaggcgtgagccaccatgcacagcctgcaagggaataatttaatgggtccctaacaagaggaaaacaggaaatgatgtctgtcacaaaacgatgttaagtgcagtctttgtcctttcctagccaatgaccctgttccagattcagttcctgaatagtgttggagatctattggatctgattccctcactctctcccacaaaaaacggcagcctaaaggtttttaagagatgggacatgggacattgctccgctcttatcaaggtaagacatagcagctccttttgccttgttctggttcatacagactttttctatatagcgcccaagtatagcaacatctcatcacccctggctataactgtatatcagctcatgagttcttcaatggtagaagttaagaactggaagtaactttgatggagagaattgtaagtacacgatgttacatctgttcttccaccattcctcccatgctgtatgcacctgccactcccaccttctagaatcttccattttgttttgttttgtttttgagccggagtctcactttgttgcccaggctggagtgcagtggtgtgagcttgcctcactgcaacctctgcctcccaggttcaagcgattctcctgcctcagcttcccgagtagctgggactacatgggtgtgccaccatgcctggttaatttttcttgtatttttggtttagacagggtttcaccattttggccaggcttgtctcaaactcctgacctcaagtgatccgcctgccttggcctcccaaagtgctaggatttcgagcgtaagccaccatgcccagctggagtcttccattttgaatgttagaaggaagagtctgtttggggccacattaaaggttaatcttgactccttggccatattttccaataatcagtatagcaataaacacttacctgaaatggcacaatccctgtatgcctcttacacttaagacaattgcagtcagttagctatgtacatctgtgtaatccactatgattctggctgtaggttcttcctggatttgagaacatcctttttgctcactcaagctggtacacgtatgcagccatgctcaggatatataaacactgggacttcaacgtcatagataaagataccagcagtagtcgcctctctttcagcagttacccaggtaaatgaatttaaaggaacatctgagcactttgagtactattcctggataaaaccttagtgattcagtgttaactgcaatgggagaagaaatgtttaatggttagtatatattaacaaacaatctgattttcagagggcttttgaagaaatatagctcaaatacttttatttaatagaatgacataaacaaggttactagaattgccaaatagaagacactttgtaaatgtaaatggctacatctaaatttatttcaacaaatgccaactgagtatgtatcaagtacaagactctttgctaggctctgcggcagaagcaatgaagacatggctgatcctgcactcaggtaccaccttgagggcgtgtagtgtttcttttatttactgcactatccacagcacttaacctcagtgtgtggcattgagtacttaataaattgccaaatgaatggatgaatgaatgtgtaagtttataaaccttacactatactcaagaggacaatataaagtgtaatatgaataagagtaataatattactggatactgtatgtgctacaaaagaagtgtaaccagtgttgtccattccaaggaggtgagactcacatctgattgttggggaaagagaggacaacctttgagatagaccatgaacatggctatctcaaagtggctagaatttgaaaggatggctagaatttgaaaaagtagagatggacgggaggacagtcccagtagaggagaggctgcaaattcctgggcctaaatgcaataggcaggtgaggtaaatgaataaagcaggactggtttaagaaaacagtggaggccaggtgctcacgcctataatcccaacactttgggaggccaaggtgggcggatcacgaggtcaggagattgagaccatcctggctaacacagtgaaccctgtctctactaaaaatacaaaaaattagccaggcgtggtggcgggcgcctgtagtcgcagctactctggaggctgaggcgagagaatggcgtgaacccgggaggcggagcttgcagtgagcggagatcactccactgcactccagcctgggcgacagagcgagactccgtctcaaaaaaaaaaaaaaaaaagaaaagaaaagagaaagtggaaacaatggtagcaaacatatgacccacagaaaggaggcaaggatgagctctcactgtctgttctccatccaagaatttccagaccctccaacttaagataaaactatgtatttaaaacaacaaaactcactctgtgaatccaacaaagcatgtgtgttagcatgtgttagccccaacctcctcaggaaacattatgagcaaagtcaaggggaaaacaccaaacatctaagggttcaactggatacactgtaaccagtttgacctttaattacgcatccgtaacttatggggtggttataccaaccacctgtcatatctatctacctttgtcggagtattttgctcttcctatcagaaattcctttttatttttaaagtcagggtctcaccctatcgccccaggctggagtgtagcggtacaatgttagcccactgcagctttgaccttcagggctcaaatgatcctcttgcctcagcctcccaagtagttgacactacaggcacacatcaccatgcctgactaattttttaaaaaatgttttatggagatgggatcttgctacattccccaggctggtcttaagctcctgggttcaagtggtcctccagcctcagcctcccaaagtgctgggattaaggtgtgagcaatcatgtccggcccctatcaggaattctgaccaagggcataacccagtatttctctgtccttgtgacctgatcctttctttgaaaccaatttgatttcatctttgtcttagtttgcttagttgttttagcattgagggggactggggactcctctctctgagttagactgtgctttgattctttcacattctattacactgacatttaaggacagcaagagacagagcagtccagtattcttcctcttcctcatctttgtgataaaatgcaatattcagatgttatgtgcactgctttgaaatctctgtggaatacaatgctctccagtagtgttaacagtcctggatcccagaggtagtgatggagaaggtcatggaagattttcttatgaaacgtataatcctgttaacatttgcatatgtatccttccagatgagatacacaagtagatttcatagataatatgtagagctttttggagcaattgaatctccaagagagcaacagacagttttatatataccccaaaacatttttacaggagccaatggaacagtgggattcatattttctctaactgggcagctttgttctcagcaccaaacaggaaaacatgtgcagtctcatttatgttacaacttattttattaagggaccagccacattggattcatccagtagacatgacatagaactatgctttacgatgaagctcatgccatcttagctgctgagtccagaacaaagctggatggcttccttgtttttctttgatggagttgtttaacaggcttggtcttttttagtcttttctaaaatacaaagtggagattgaggaaattatttcacctaaagaggctaacatgcaatacccagggaaggtcaaaagtataccaaagtataccaggtgctgataacctcagtaccacccttaggtctgggcacaggaaccccaccctcccagcttggaattaccttcatgaaaattacctaaatccccctccagcatcctgagactggccaggctggcagtatcttgacctgtgtctctgtgcatctagtttagaaagctcctttccagaaaatttcaaaatccccttctagtgcccaagactgaccaaggtggcagagccatccaggtcagcttctctgagtccagaaagcaacgcatgtggactccctatctgggggctcttctcctccattcctgcccacgcatgggttcaacaagatgccctaaggagctctgggactcaagcctatggcctggtcctggtaagcagattcctctagttggccctcacagtatatattttttgcaagatggtgcataactgagctgtcagaacggtggtcacacgatgacctggggtgactctcatgtcagagcatatgttcagggctctatgctactgaaaaccacctcttaccctcgggtttcagcatgcagcaggggaggacggtaaagcgaacttcgacctatgagctccacatctggcccctgtcgtggcctcctcacccctgcagctctgtaccatgtgtcggtcagtccttggggcgggctaggcctggcccctctgaggccttttgagaaccttgctccacaacacaaacgggcctttgcagcaaatcttttgctgcagttggtgatgtgacttcctactgtcttgggtcagtcttaagccagatggatttttctggtgtgattgggacagctcttccagctcgacttataggcttctcacctatcctacccactggtgcccgtgggtgaggagtgaaggtgggggagggttcagcatgaaaagagatttgactcatgaagacttgacttaaattgtgaagccttaaattatgaaaactttacttaaattttcctggggcttttagcctgttcttttatctttttatgtacctactttcaaatacatgcacttaacatttaaacaggctaagcaggctcatgcctgtaatcccagcaatttaggaggccagggtgggcggattatcttgagctcaggagtttgagacctgggcaacatggcaagagcccgtctctgcaaaaatacaaaaaaatcagccgagtgttggtagctcatgcctgtaatcccagctatttgggaggctgaggctgaagaacagcttgagccctggaagcagaggttgcagggagccgagatagcaccactgcacttcagcttgggggacagagtgaggcctcgtctcaagaacaacaacaaagagattacattctagggaggcagcaattagcctgaagagtccaacagaaaacatgtcgatctatgtttacactgtaaaattcccagtgtagctttagtaaccataaaacaaattatcattcacaatttttttaacactctgggtaaggcttgcatttgtggtcatcattaacaaagcataataaggatttttgagtcattagaagccaggattcacaggtagagtggtagatgtcgcaaagtcattaagaaaatggtgttagggaactgcagaggcaaggagatctgtgttgtttcaaaacaaacaggttccaaaaagtcatggttttgtaataacagtattgctacctttttctcataacaaaaaataggaaattagccaagaacaatgcatttaataataaagaatacaaagagatggtacctggatactgtaacaaatcttcacgtgcactgattggacaatagacaaaacagattgcctttctctgcccatcatcctaaatcttcaatgataaatcatcatatctcacatgtactgatgaatttttaaatatatgtttttaatcaaattgtttatataggcaggggccctgttaaaaaagacaaacaaacaacaacaaaacaacaacaacaacaaaaaacacttgcctgaggcactggatacccaaaggaaagtggctttgaatggccttgttctaggagtttctgtccctaacaagaagggttttgaatacatggtctgtttgcctagtaacagctaaggctgagtaaggaatggagaagccttgcactagccctccccacacatttacttattttggcaatgcaaattaataatcaaggaggtaagacaaagagataaatcactagaaaatgacggcactgaaatggcagccaatacaattgtgtgaagacctcagcacaaagatctgatagttttaaccaatccagagaaaatttacttgtcaacaacattgagtcttccaatctactaatataatctatttgtttatttcagtctttaatttgagtcatatcatgtagttttcagtatttaggtcttacatacctttaagtaagttaaatcctaagtaatgtttgatgctactgtaatcaaaatgttttttattcttttttcagttgtttgttgctcatatgtatttattggttacccattgccacataacaaattgctccaaacattagtggctaaaaacaataatgatttagttactcatggtttctgtggatcaggaatttagatagggcacagtggggataatttgtctctactgtgactggggcctcagctggaagactcaatgactgaggggctaaaatctctgatagcttaactgagactggaacatgcacttccaaaacgacttactaacatagctgacagggtggtgctggcaactggttcctcttcacttgggcctctcctcagaactgcttgaatgtccttcatggcaagacccctggctccagacgaagccatccaaaagaacaaggcagaaatagtaatgcctattgtgacctcacctcagacgtcacacacgctcacttccaccaggttctattaattagaagcaaggtgttatgaccagcccacattcaaggaaaggcgattagaatccaccttttaaagagaagggtgccaaagaatttgtggaaatttgaaaactaccacaatgtattacgatttttttgtacattattatcctgagatctttctaatagcttttttgtagattccttgggattttctatatatacaatcatgacatctctaaataaagacagtttgacttcttccatcccttgtatgtctttgattgtttttttgtatgattgtgctggagaagacctccagaataatggagaccataagtggtgagcatgcaaatccttgcccaattcctgacctagggtgaaaagtattgtctttcaccattaagtatgatgttaactgcagattttttgtagatgccctttataatgttaaggaaggtccctgctcttcctactttctttaatatttttatcaataaatgagtgttgcatttttctgaattctttctcagcaattgttgaaaagatcatatgaattttttcctttattaatatgataagttacattgattgattttcagatgttaaaccacttgaaattcctgggttaatcctcagtcatgatgtgttattctctgtatttatttttagttcagtttactaacgtgttaatgatttttttcatttacattcatgagacatatttgtttgtagtctgcttttcttatgatggtttttgttttaggataagcttatcctcatatcctaaatgtggaattatttctttctcctaagtgttttaagagcatgtatatgattagtgttattttattctatttatttatttatttatttatttttaaagacagggtctcactctgtcccccaggctggagtacagtggtgtgaacatagctcactgcagcctcaaacacctaggctcaagtgatcctcctgccttggtttcccaaaatgctgagattacaggtgtgagccactgtgcccagcccattttcttctttaagtgtttaatagaattcacgcgtgaagctagatatgaaggtttttatttgttgaaaagttattaattgtaaatttaatttctttcactgctacagaactatttcagttttctaactcttcttgagttagttttaaaaatgtatctttcaaggaatttatcccttctttctaagttattgtttttattgatatgaagctatttataatgtttttcttaacctcttaatgtctgtaggatctgtaaagtccccattatcattcatgatattgtccatttttcttctttattaagataaaatttccatttttatatttattttctttcttctacttactttgcatttaatttgtaattttttctagcttcttaatgtagaagactagataactgattttgatctttctatcataagcaaataaaatgataaattttccaataagcactacttttggtgcatctgacaaattttggtatattttgtgttcatttttattccatttagaatattttctaatttatcacgatttatttaatccatagcttatttggaagtgtattgtttaatttccaaaaatttacagatttttcagatctttgtcactgttttccaatttaattgcattttctaatttattctgagatcagagagcatattctgtatgatttcaaatttttttaactttattgagacctgtgttatggctcagcatgagtctatctcaatgaatgtttcatatgcagtagaaaataatgtaaattctagtacttctgagtgtagtgttctgtaaatgtcagtcagtgcaagttaattgatagtgtaattcaagtcatctatactcttaactgattttctatttgttaatcatttactacaaaagaaatatttatacctccactataattattaatttgtctgtttctcattttcttatcttttttctctaatcccatggcagattatatttctcatttcatttctggtagttttgctttatgcattttgatactctatcatttagcacatacattcataagtatggtatattcctactatattgacccttttatcattatgaaacgtcttttttttttgtctctagtacaactccttgccttaatgtctacattgtcttatattaatataaccactccagctttcttatgcttactgttttcatcttgtacttttcctgtctgtttactttcttttttttttgtcatttcataccagcaattttatttacacagaaataacatacaggtatctgttataaatgtcagagatcatctctacatttcagatcttgattcagtttaagggccaataaaggaaggttcttttctttccattaagtttcttgcctttgttttttgttgtacaaagtgtgtagtactagcaactgcattaccatagcatgtctttaattttcaatttgaaatcttatgtgctggaggaaagtgcatcgtaagtttttgtttttgttttttttcaccttacaaattcaaaagactagaataacggtagtcatctggaaaaagtaaatcatggatagatataattttgaagctgatgcttaatgatggcagtgatttttaagtgtggtaacaaacgttttgggagcatgtatcctctgtcaagatggtactagtaacagattcaaagtagcacaatatcatatcagactgatgtgggtttttttatgtttgagatcagttggtgaccctgttgttctttagtaaattggtgccataagctaaagttagcatattcatattttccctgccaaaagtccttcacaaataactggtcataaactgaaaaaaaattaatatctgcaatataaatgtgttgtctattagagatggggctagatgtcttaaggatttctaagtatatcttaaaatttatacggtagtagttcataccaagaatcatctggggaattttaacaaaatatatatatgttctaaacctcatcacttccccataaatgcagcttaagtctgtaagtctgaaggcgtatgtgtatgttgggtgtttttcttttttcttttattttgagatggagtttcgctcttgttgccaaggctggagtgcaatggtgcaatcttagctcactgcaacttccacctcccgggttcaagtgattctcctgcctcatcctcccgagtagctgggattacaggcatgcgccaccacgcccggccaattttgtatttttagtagagatggggtttcttcatgttggtcaagctggtctccaactcgtgacctcaggtgatctgcctgcctcggcctcccaaagtgctgggattacagacgtgacccaccatgcccggccttggatgtttttctttcagctcctccagtactttcatattattctaatatattttgttggtatgaagctatgaagcaaaagtcgctattaccaatgcatacatacagtatactggttttaagttccacctcagagtgaatcttagagcctagtgtaagtgctccactttagagatgtaccttaattactactgtatttgcaaattaagggaaatttaggtcatcatttgattttctaaaacctaaaaggaactggccatcattaccaagtctttctagataatcaagggtagatggctgtttttaatgtagcaattaatgtaggcattcctgctttcgggtttaagtatgaatcaaagcatattttaatttgttagcacaaacggaatgtctgtttactttcaaactatttgtggttttgtgtttgttgtatgtcttttgtagacagataattagtacattttgctttcttttcaatcaagtttgacagtctcttacttttgatggaagtgtttgggtcatttacatttactgtaaatatttatatatttagatttaagtctgccatttcactatttagttcatttcatctctattttgtttctctgttcctcctttcctgtctttttttgtgttaaacattttaacaaaggttttataacaaaatattctatattttaataagttggctttctagctatatttatttgcatttttaaaattgttgtccctggggcttgtgatatgcatctttaactcatcacaatttgcataaagttaataagcaattatgtctgctaaaaaatatataggaacttaaaatggtaattatcccatttagtgccttccatcctttgtgctattgttgtcatatatatgctccatctatatatgttataaatacaccaatatggtgttatgattttttacttaaaaacttactgtcttttaaaaaattaaaacaagtgtgtgtgtgcgtgtgtgtgtgtgtgtgtgtgtgtgtgtgtgttgagaagtaagctgttaagtatattattttcctctctaatttttttctgcatttagatttttggtgacttcagctttgtcgtgggctagctctggtcttctttgtgattattgtattttaagtttgttgtgctggtaggaactgcaaattaatgtttttcattaaatgtaagggtttttcaccagttatagcttcacatattttttccatcctcttttctctctcttctccctctgggactccagtcatttatccatcagatgctaaacatttttgcacaagtctttggggctttgtaaattttatttagttttctttttctctctgttcttcagattggatgattcccattaatcttctatcttcaggttttctttgttttattttttgtttattttattttatttatttatttattttgagatgaagtttcactattgttgcccaggatggagttcagtgatgcgatctcagttcactgcaacctccacctcccaggttcaagcgattctcctgcctcagcctcccaagtagctgggattataggcatgcaccactacactgggctaatcttgtatttttagtagagatgaagtttcaccatgttggccaggctggtttccaactcctgacctcaggtgatccacccgccttggcctcccaaagtgctgggattacaggcgtgagccaccatgcccagccacaatcttcaggttttctaattccttcttctgccatctcaaatttactgttgaagtatacagtgagtttttcatttcatttactgtacttttcagatctagaatttcaattttgttctttctttaatttctaattttatgttgagattccctctctggtaactcttaaaaccatattttcctgttttgtctttgtccgctaaacccaatatcaagacctacttggaaacagtttccagtgacttaagtgtggggtcgtaccttcctttttcttttgaggtgacaaatatagcaaataccatgacttgatcattacacaatgtatatacatatttagtatattcttcaccgcaaacatttatcagttccttatggcaagaacgttcaaaatcctcttttatagttattttgaaatatgtaacacaatattgttaactgtagtgcctggtaatttttggttgaaatgtggacttgaaaaatagcacaccatagtgtctctgaaatgtgtatttttgagaattatgttttattttatttttaaatgacatataattgtacatatttataggggacagtgtgatgttttgatgcatgtatacattgtgtagtgaacaaatcatggtatttagaatattcatcacttcaaacatttatcactttctaatggtaaggacattcaaaaatctctcttctagttatttaaaatatataatatagtattgttaactatagtaagcctactgtgcaatagaataccgcaactttctccttctatctaactgtaattttgtacctgttgattaagccctttccaccttgcctaccctccccagctgctggtaagcattgttcttctctatacttgtatgagatcggcttttatagattccacatctgagtgagattgtggagtatttgtctttctgtgcctggcttatttcatttaacataatgccctcagggctcatccacattgctacacatgacataatttgatcctttttatggctgaatagtattccattatatgtatatgtatcatattttctttatccattcatctgttgatagccatttaggttgattccatatcttgactattgtgaatagtgctgcaataagcatgagagtgtggatatctctttaacatacttatttcatttcctttggataaatacccagcaaggggtctagtttcattcctctccatgtagatacccagttttccaagcaccatttatcaaagagaattttttccaatgtgtgttcttagtgtctttgtcaaaaatcaattagctgtaagtgtgtgaatttatttctgtattttttattctgtcttattagtatatatgtctatttttatgccagtactatgctgttttggttattataactttgtagtatattttgaagccaggtagtgtgatgtttccagctttgttctttttgctcaagattgctttgactatttggggtcttttgaggttccatacacatttaaagatttttttctctttctatgaagaatgtcattggtattttgatagagattgcactgaatctgtcaattgctttgattagtatggacatttttttaaaaattcctcaaatccgtaaacatggaatatctttccatttgtatcctcttcatttcttatgtcaatattttataggtttcatcatagagatctttcacccgcttagttaagtgtttgtttttgtagctgtagtaaatggaattgccttcttatttttttctgattgtctgctattgtcatatagaaatgctatagatttttgtatattgattttatatcctgcaactgtactcaatttacttattagttctaacagtattttggtgaagttttcagggttttccctgtataagattatgtcatttggaagcagggacagtttgatttctgccttttcaatttggatgctctttttgtctttctcttgcctgattgctttggctagaacctccagtattatgttaaataaaagtggtgcatttgtgtcttgttccagatcttagaggaaaagctttcaacttttccccattcagtatgatgctagctgtgaatttgtcatatatgggctttattgtgttgagttacatttcttgtatatctgttttgttgagagtgtttatcatgaggggatgttgaattttattaaatatcttttctagatcaatagattcaacatcccttcatgggtttgtccttgattctgttaatatgatgtattatgtttattgatttgcatatattgaaccatccttgcatccctggaatgaatcccatttattatggtgagtgatttttcttaatgtgctgttgaattcagtttttaaatatttttttgaggagttttgtatctaggtttattagggatattggccaatagatttatttatttgttgtgtccttatcaggttttggaatcggggtgatgctggtctcatagaaagatgttggaagtattccctcctcttcatgtcttttgaatagttttcaaaggatttgtattagtttttctttaatgtttggtagaactcatcagtgaggccattgggtcttcggcttttcttttctggaagactttttattactaattcaatctcattacttgttattggtctgttcaaattttctatttcttcatgattcaattttcgttaagttttatgtgcccaggaatttatccatttcttctaagttttcatatttgttggcatagagttctctatatctctctcaaaacttaagaagtttctgctattattttgtgaagctttctgtgcccttctccatctcttctccctctcaagtttctatagtgtgaaaatgtgttcacttaatggtgtctcataggtcttgtaggctttcttcactcttcaagcaaagagctgtcttcagttcagaaattctttattctgcttggtgtagtctgctgttggaactttccattatattttttatttcattcattaaagtcttcagctccaagagtttttttttaatgatatctctgttgaattctttattcatatcatgatttgcttttctgattttattgaattgcctatctatattatcttgaatctcattgattttccttaagatcatatttttaaattttttatgcaattagtaaattgccatttctttaaggtcagttatgggagagttattgtgtttttttggtggtatcatgttttcttgctttttcatatttcttgtgtccctgcactgatgtctgggcatctgatagaatggatgcctcttccagttgtatagagttgttatcataggaaaagatttttgcctgcagatgtgtcctaaggtgtcggttgtggaggatgcattggctgtggttccaggtggatgcagtagtgtagtcaccatgcagttttttcagctgtagtcaatgttagcaatttctatggatgcctcagtggcatcctagcctggaggagtttgtatggcagctctgtcaaatcatatgcatggcttttctgcttgtggcaagggtgccagtttgtttcatgcgccacgggtgcacaaggcctactccaataggattagacacagtctgtcctctgggggcaggagtgccaggctgttacacacaccgcaagtgcatagggactgctccttcagggtaaggtgtggccttcctgctgggtaggatcatctgttccttgggcgtcaggacaccacatgggctcaggcaccaaggttatggctgtttcactgggcctatgctctgagtaattgaggttgaggtgctgtgccacagggatggggaagatggagtgcatcgtaggcagcttattcctggtggataggaaacagtagctgctcaactggtgagtggtgtgctactgtttacaagcacagtgtacttgcagcagagcctcaggatggggagaaacaaacagtggttactggccctccagagcacagtgtactatagtagtggcaccggtctcaagatagtgctgtacatcagcagcttagatcacagaggagaaggaggcacaatgtgggctcattctttggagtaatacagccatgtgaatgccaggcagctccctagaatgggttcatgacttgtgaaaactgcagaattctcaagcagcaaagactgtaggtgtttgcatctttaatggagattgctgggagttctcctgctcacgttttctccgtagggagactgcctcctggtttcataccgaccttgactgggaagacgaagtggcaaaggcagaatgtttcattctcttttttatgcagccatcccaagtctccatgctccactgggtctctgcccctcccttattgtactccttcggaacactttagtgttctcctttggatactctagtcaaaatgtagttgtttattcatcattttggttcctttttttttgtagggaaatgaatgttaggcacctctagtcagacatcttgctgaagtcacttgttttactttttttgttgttgtttttaacaggcaattaccttgcttgcactcaaacttcaacatatgtcacctgcacagtgtgcagcaaccaatgtccttcctcaacactgctgcttcaacctggtcttctggaggttgctcctgcatctgtgtaatttagcagtcagtgaaagatgttggcagctcaaattcatattatagagctaactctctttgtgatttccttgatcctaaggtttcccctatattcccatttgcttttccagctcttacctttgtcctctgagagcctgaggaatttgagctgcatatgagttgggaaccctggcagtgtaagttgcagcaaactcacctatctcagttctagaacatttctgtcttacaagggaaaacccttctcatttctttctgtttttaccctgggctccctggcatttcccacattcatgcacagttagtggtcagtcagggaacaggacacagttcatattcagattttggatctctgctcttcttgtggttctcttgctcccaaaattttcctcttaaattctcagctgttctgcaatactagactttgatctcaccatctcaagccagaatggctctagttttccataactagagttgggtatgggctatatattagtttgctaaggctgccatgacaaagactgggtggcttaaacaacagaaattaattattctcacagttctagaagctgagagtccaagatcaagatattgacaggtttggtttatctctttggcctacagatggccaccctctcactgtgtcctcacatggccttttctctgtgtgggctatacctggcatcacttcctcctttttttttttttttttttaagatgatgtctcactctgtcatccaggctggagtgcagtggtgcgatctcagctcaccacaacctctgcctcccaggttcatgtgattctcctgcctcagcctcccaagtagctgggactacaggtgcatgccaccacacccggctaattttttgtatttttagtggagacagggtttcgccctgttagccaggtggtctcgatctccttacctcatgatccacctgcctcggcctcccaaagtgctgggattacaggcatgagccaccacgcccggctcacttcctcttcttataaggacaccggtcatgttgaattagagtttgcccatatgacctcagttgaccttaattacctttttaatgctctgtatccaaatatagtcatattttcaggtactaggggttaagacttcaacatatgaattttgaggaaacagaattcagtccatatcacgggtttaggaatacacacaggcaaggaagcctcatactccatcttaaccaatgctgtactaatgttctgtttctctctgcctttggtcattcctagtatcttcagatcattgctttaaataattttatacagttttataattattatttgtgggaaaatcactcaattttatcatgctgctattattggaatactcacccttgatacgagcattttttttttggctgggtaatacataataccctagtgcttttcatattaacaaagagtagcacaagagctccttttagaaggttttactaaccttcaggccaagtaagttatctctcctttgagcttcctaggtaccctgtgcataatttcttcaaagcccatattctgtattcatgtctgtgtcccaggatgagcacagagccttgcatattataatcattgaataaatatttatggaaggaaggagaaaagaaggaaggaagaaagaaggattagagggaaaacagtaaggagatagattatgtccactttgatgtggacatggtaggaactgtaggaaagaaagacgggcaataaaacaaggaggaggtgggggctgcctaagagatcacagttcttattgtaacttgctttctattcatcctgccctccctttcataccctagatttgagaacaggagtctaagatgttcaggaattgtaagcaagggacttcagatgcaaaacctatgtgttcagcacaggacttgttacttgaagcaaatcctttgtgataaataacatgaatgggacctgactagttttatgggaattaggcagaatttaagttttaaataaattactataagcttgtttgtgttcaactagttattaaatagaaaggaaaacaaaaaacctgaatatgtgtttagcccctaccatgtacctggctctgtccctgacactgtgcacattttgtttttgtctgttttgggggttttgttttctgagacagaatctcactctgttacccaggatggagtgcagtggtgtgatctcagctcactgcaacctccgcctcccaggttcaagtgattctcgtgcctcagccttccaagtagctgggattacaggtgtgtgtgaccacgcccggctaatttttgtatttttagtagagacgcggtttcaccatgttggccaggctggtctcgaactcctggcctcaagtgatccgcctgcctcagcctcccaaagtgctggaattacaggcgtgagccactgtgccaggccaacattttgtttttattatgtcatttaatgttcataaaaacctaacaagaagggtatttttaaaatcagttgtctaccattaacttctagtattgtattttcttaacaagcatacaaaacatcaaacttctctttagacaaagtgcagttctttgacatcctttacacaaaacagtctgagcctgtggcatgttaatgcagtcgagaggcaaagcatactgacttttacaaattctgccttccataaaaagcctcaaggagggtattttgtctgcatttttaaaataaacagttcagagaagttaaatagtcaaacaggtcaaggtcacacaattcagtggttgaggactgggtgcaaaggcaatatatctaactataaatatccatttctttttttttttagaaatgatgcagtttggatttaaattaaatggctaaaactgaaagagccggctgggtgtggtggctcacacctgtaatcccagcactttaagaggccaaggcaggaggagcgcttgagcccagaagtttgagaccaggctgtgcaacatagcaagacccccgtctctacaaaaaattaaaaaatttagccaggtgtggtggtgcatgcctgtagccccagctactcaggaggcctggtgggaggatcctttgatcctgggggtttgaagctgccttgagccttgatcacgccacggcactccagcctgggcgacagagcatggcctgtctcaaaacacaaacacaaacaaaaaactaaaagagcagtgaactcaaaggatttcctgccatgccaggtgggtggagcttctatgtgggaataaaagatggaacctatttaaaggactttttttttgtttgagatggcgtctcactctgtcgcccatgctggagtggaatggcgtgatctcagctcactgcaacctctgcctcccaggttcaagcgattcttgtgtctcagcctcccaagtagctgggaccacaggcgtatgccaccatgccctgctaatttttgtatttttagtagagacagggtttctccatgctggccaggctaatctcgaactcctgaactcaggtgatccgccctcctctgcctgccaaagtactgggattacaggcataagccaccttgcctggcctcaaaggacttttaattgaggatcccagtaatgatgatccccataaggctgaggcttcaagcttaatgatctataagtgaggctttctgggatgcatttagtgtgtttccccaagcgtgtgtgtgttcctacttctcattatatacaggtatgctatcacctcccccatacatgtatacatacctcttaaacttagatgttccccaatttttcctatggagcttgctaaaaatgcagtgtcatccatagaaattcatatttcattgatctgggctgggacatttgtaacaagcaccctagaccatcctagcatactgaatccatagtccatcctgtttgtgagactatggcagcccttgtggtctaagcagcaaaatctttgcttagccttttttgttgttgttgtttgtttgtttttgtttttgtttgagatggagtgtcgctctgtcaccgaggctagagtgcaatggcgcgatctcggctcactgcagcctccgcctcctgggttcaagcgaatcccctacctcagcctcctgagtaactgggattacaggcgcgcgccaccgtgcccagctaatttttgtatttttagtagagacggggtttcaccatgttggtcaggctggtctcaaactcctgaccttgtgatccacctgcctcagcctcccaaagtgctgggattacaggcgtgagccaccgtgcccggccttgtttttttttgagatggagtctcgctctgttgcccaggctggagtgcagtggccaattcaacctctgcctcctgggttcaggcaattcttgtgcctcagcctcccaagtagctgggactacaccacgcccggctaatttttttttttttgtatttttagtagagatggggtttcaccatgttggtcaggctggtctcaaactcctgacctcaaatgattcaccacccacctcggtctcccaaagtgctgggattacaggcatgagccagcttggcctttttaaatattaagtgcatgtacttgaaagtaggtacacatgaagataaaagaataggctccaggaaaatttaagtcaagtcttcataatctataaaattgcctatttaataaatatatgttgtaaacatttttaatgttctgtaattactgttattaatgtcatgttacctctttgatctaggtactttggtcataaagctgaagtatataaaaacaatctatatttagtacagaccaaaattcatgtcctttgcttttaaaaggtagaaccaagaaaaaaaaagcaatagcagaatacgggcacgtattctaaagaattataaatggattttgcagcacttaatttctgttttttttttaagtacctttctttgattctttgtctcctcattggtaccatcccagaacactgatgtcttctgccagatcagacctgtcttgatcatcttccccacctaaatcaggatgtgtcctcccttctacctttccagaaatcccaccttagttttcatacttttcttgattaactggtcataagatgatttccctcaactccaccctgtctcaacatgcaactccccatgagtcaatcttcataattgtttctaatgtgtttgttccatggtgtgtgttgagtaactgttgttgccatttgcatgactacatagtggttactgtttatttctgcagtttggtgttttttttaagtcttgaaataggatttattaaccggaagtgtttctttttatttcttaattaaattcagtgagaagcttatcatgaaatgttattcttaggctggcattcataaaacactggagtgtttcattttctcctgatctcaatctgccttccaaagctgctaatgacagatgagagcaagattataattttagttagggtgtggtggctcatacctgtaatcccagcactttgggaggccaaggctggaggatcccttgaactctaaagctcgacaccagcctgggcaacacagggagaccctgtctcaaaaaaaaaaaaaatttaaaaagattataattgtatgtagtcaaagaaatgtgtttcttttcaaaggcaatgtgtcagaactttgtcccatctctgggccttttctttattatcttaaactctaaactatagaattagcctcctcaactatagtttttgcaggccagttcactctccttgctctagaactctggatagcctatatatttccatcatcctgtctctttcataaagaatcttgcctttaaatgaaagactactccttaaacattagtacttgtaatattcaatcacctacacatattaaagaacgcctgccctcttgtgtccagggagactgctacagcaagtattgaattagcaaacttgtcattccggaaatacagcattctaccctacagggattatctaccagggagctttctcaaggctgccaagtatggttgtacagtttgaaaaatgatcccagcccaagacacgaatgcaatccattttacactctgtcaagccatatatccttgcccaggtcatgtctttctagagaggtgacccattaaaatttcattcaagagtactgttaaaccttgtaccacttggaatgtgcaactttctctaatttacacaaagctctctatagcttaatggcagccgtgtagaggctcattaagagttagttggggccgggcacggtggctcacgcctgtaatcccagcactttgggaggccgaggcgggcagatcatgaggtcaggagatcgagaccatcctggctaacatggcgaaaccccgtctctactaaaaatgcaaaaaattagcagggcgtggtggcgggcgcctgtagtcccagctacttgggaggctgaggcaggagaatggcgtgaacccaggaggtggaatttgcagtgtgccaagatcacgccactgcactccagcctgggcgacagagcgagactccgtctcaaaaaaaaaaaaaaaaactaagagttagttggacagtcctctcatcgtgtaactttcctactcaagaaatttcaagaaattaaaatcagattgttagagctgaatagctgaatgacattagtcccaggttatcagaagaaggaaataaggaagagagaggcaaaataagaactgtcaaattcattagaggcaagcaggaaactaaaatgcaggtcttctgactcccagtccatgctcttacctccggtttcaggtgacccgtttctttgaccccaccttacttattccatactaggctagaatagatgtgtaatagcatgcatagggctggtggggtgatttgaggcagtatgtggacaaacattttttgcacattagtagaaatgtatttgttttaatgtatttctttgggaaaaaacaaaaacattaagtccatagtttctgagacattatgatatatgacaagggtaagttaagtttgaaaagtgagttaatttgaagaaagatattaagtagtgcatatgttaatagcttgatttagccattgacaatgtatacatatatcagaatatcattttgtatgccaaaatatatacaatgtttccttgtcagatatcaaaatatcctttcttttgtataacataaatatatataatttttacttgtcagttaaaaaataacaaaaatattaactaaatgatagttcagatagtactcagatatggcaaaaatgataaaagtggtaaaaaatcatggtagaaatttgagaccatctcagtccattctgactactatgacaaaacacctcagactaggtaatttataagctatagaaatgttattgctcacagttctggaggctgggaagcccaagatgaagggactggaagactcagtgtctaatgagggtctgtttctcgtagacagtgccttctctctgtgacctcacatagtggaaggggctagctagctccctcgggactgttttgtaagggccttaaaacccttcagcaggatgcaccgaaggaacttaccactctggccccttctaaccctaccactgaggtccttttctgtttaacactgacagttgttccattactgttactgatgacagtatatcctctctttttattacagctgtgcctgatattctatcctttccatactcatcccagtataaaccacaaaataggtcttcagaaaagactgtggcttcactgattttcctgtgttgcctccaacatttataaaaaagcattgaccaagagtgtcaatgccctagtttcaaaaccatctttacttttctaaatgtagatgtttttccatttataaaaattatgtagacttagccgggtgtggtggcccacacctgtaatcccagcactttagaggctaaggtgggtgaatcacttgaggtcaggagtttgagaccagcctggccaacacggtgaaacccggtctctactaaaaatacaaaaattagccaggtgtggtggtgcacacctgtaaccccagctactcaggaggctgaggcacaagaattgcttgaacccaggaggcaaggttgcagtgagctgagatcatgccaccacactgcagcctgggtgacagagtcagactgtgtgtcaaaaaaaaaaaaaaagtagacttatacaaaatttgaaaaatacaggaaagtagaaaagaagaaaaaaaggcatttatattcttactaatgaaccctgctaatcccctccctaattaaaaattctcctgcaaaatcctagcaagtcgggatctacatctgtttatcattctggaagcttgcaatgttctggatttaacatatttttgttatttcaaatcacaaaataaattttcaatggagaatccaggggtggagttcttttggcacctctataaggggcagttgggtgactaccacagaggtgagccaaagctgggggaggctactgcagatcaaggatagtaataactgatacactttgcaaaatgcattgtgtatgtaaagctctttgtcaataatgatggttcactgttccatgtatacatatgctgatgtgtatatttgtctttcctgtagggtttttggagtctctggatgatttttacattcttagcagtggattgatattgctgcagaccacaaacagtgtgtttaataaaaccctgctaaagcaggtaatacccgagactctcctgtcctggcaaagagtccgtgtggccaatatgatggcagatagtggcaagaggtgggcagacatcttttcaaaatacaactctggtaagtgaccctgcagaataactgttaggcacagacatatattttgatttaggcttgttaaccagtaaagtcatacccatgccccgtcttcatgtttcctgatatttcaggcacctataacaatcaatacatggttctggacctgaagaaagtaaagctgaaccacagtcttgacaaaggcactctgtacattgtggagcaaattcctacatatgtagaatattctgaacaaactgatgttctacggaaaggtactttcttcatgtcgtaagtcttaaaacctgatgagtatgtgtgtgttcatatatggtaggggaatgcacattgtgtgaatgtgtggtgggggagggtatggtggggaagacaggatggggatgctatattacaccagaatgaccaggtttagcacaacatgtaaacctacatctcaaactcttataggacaatgtgcagattgggacgcaaatcaggcattcatgactctatgatttctcatagttctaatgttaccttttctcctgtgttcctggttaaagctttaagttcaattcagcaaatatttttggagtgccactgtggcccagggactagaaaagcaaggatacagaatccctgacctggaaggactcaggagtctagtagggaagcaaagcactcaaagcagctgcaggaactcaggatgggaagagctgtcatcaggtctcatgtccctaggccagtggtgaacctaaacagaacgtggctgttagtgggtggagtcagagaaggcacttctggtgggcaagaaggagtccagacatttgaagccaggaggctcactgccttgattcaaatctcagttccttaaaatctcaggcaaattagtgaatctctccaagcctcattttcctcatctataaaactgaatcgtgatataggtccacaaccacgtatttgtaattttaaaattccaaaattgtaaaaccacaaattattattttgtttctcttgttttgctttgatttggtagcctagctcacttggtagcaagaaaatgacctgatctgaactcacttggcagcaaaaactaccagaaagaaacttttagtggtttttaattttaatttttatttttcttcagatggagtgtcgctctgtcacccaggctggagtacggtggtgcgatctcggctccctgcaacctctgcctttcgggttcaagcgattctcctgtctcagcctcctgagtagctgggactacaggcacgtgccaccacacctggctaattttttgtgtgtttttagtagagacggggtttcaccagttggccaggttgaactcctgacctcaggtgatctgtctgcgtcggccttccaaattgtggtgcccagcctgtttttttaaattgtctttatttcctcttagagacaccatgtatacattaggctacagaaatatcaacatctttgattatgaggtgtttcccaaagagactgtaatgtcatataatccatgcactccatggttgttctaaagtctgaaaaaccctaaattctgagactcatctggctcccaagaatttctggatgtgggagtgtggaactctacaatttcacaggatggtcatgaaaattaattaagataaatagatagatttattgagagaaaatgttagctttaaaaatcctactggacagttcagactttatgttttagaaattgggagttcctgacaagggagaatagactgggtgggaagaaaagagactagttaggagactattgcaatagatcaactggcagatgaatagggacagaacggagataaagtgtggaccctagggatcaggacctggtcctcagttttccaggtccccaaattgactttgtaatgatgcctagagtgagccttgtcagtggagaatgggtcacaccaactaaatgcactaagacttatgcataaaacaaaaggtgggagtttcattgccaagcagttcatatgctaccaagcagtggacctaccttcttctttgcttgttaggaaaatccatccaagaagtcaaatcattaggtggttactgtttagcatagagcaattcaaaacagagaacccagctcctaagagcctgaaaataatagcatgcctcaagagagagagatgcttgctaaagtagtcttttcttctttggacagttgctgataacagaatggtagacttggttctctgcagtcccattcctagaccccttgaaactccctaagactaaaaagagttgatgatgatctgtctgtatttttttttctttgccagaggagagaagaacagagagttaaattcagagtacctactgcattctagacactcttctgggccttttacttatgttctcttgtttgatgtttgtaacatactaccccataagtgttattgttgccattttactgtgagtaaagaaaagctcagaaagaaacatgttttgcccaaacaaatacatgatatcatatagccattaaaaaggcgggggcgtcggggtcgggggtgggcacatctcctaacgtatttaagcaactgtggtatggtgatagaagccctggatgttttagttagaaggcctgtattctgtcaagttttgtgagccaaggaagacaattgacctctctgaaactctgtttcttctgtttaaaaaagggatggtaatacttatacatcatcaggtttttgtgagattaaacaagctgctctattttctttatttattttgagacagggtctcgctttgtcacccaggctagattgcagctgcgtgatctcggctcactacaacctttgcctctcgggttcaagcggttctcgggcctcagcctcccgagtagctgggaccacaggtgtgcaccccaatgcctggctatttttttatatttttagtggaggcagggtcttgccatattgcccagcctggtcttgaacttcagagctcaagcaatccacctgcctcagcctcccaaagtgctgggattacaggcacaagccactgcaccaggccaagttgctctgttttaaatcacgaagcttcatgaaatgtgaagtataaagtagacattttcgttattcatttgagctgttttcacaaagagaaatataataatctaatgtttaccaagtattagatactattgtaagcactccatctgaatgcatttcatgctcatgcttatgaagatgcttaatgctgaatagttaatgaagatgaagaaactgaggcacaaaggggataagcaatttgttcaaggtcacatacctaataatggcagaaccaggcttcaaatccaggcaatctaattcctgagcctatataacctagatatgttttagcaacaaatctgtttttcttctttaatttcaatgtcatccatatctcagttcttctgatgctggctctgtctcagaattagcaaggctgaatgtcttatcattttctttttgtctcagtaacctcacccctaaagaggaggtcctgtacaacaatacaaaggagaaaggcagaaaagggccaggagagaatgtggaggtgggagagaaccctgcatggtggagacattccttgactgttctgtaggcagtaacccaggccagtgtcatccaggatgtttctgaaattctgcttttacaagagagagctgtgtcacatatttggtgctcagtgactagtaggctatgtggccttcacacactatgaagctttgaatgaagctgagcctttataaatgtttagagtcaaaggaattaaaagcctaatgtaacctaaaagatcatccccaatccccttacattatggacttctcctctccctccccattgacgtctttcaaaaaaaaagaaacagaaacaaaacaaatgaagttgcctgcctaagacctgattcttaagccctgagcctagaattcaggctttctattcccagtgctatgttcttccactacttcatgattaccatttgacatcttcctttatagggccacactgtgaacaaccatttcttggcatttcagtaactaaatccacttagatgagctccccagaccaccttgcattatactttattttgctctatagagaatatggttgttttttggcttagagattaagaattttgggtgaaaaccagagaattctgatgctcttcttcccctaatgaaataacctagagctgtgctgatttaggaaatttaaaaggctgtttggctgccagggttcacatgcaaagctttattttctgtacattattttgtaattaaatgcctgtgcccattttcaaaataaatgaacatggataacatttcttttgctctctctccttttctgtctccttccctgtcaatccctcccttacttcccttccattccaaatcaggatattggccctcctacaatgttcctttccatgaaaaaatctacaactggagtggctatccactgttagttcagaagctgggcttggactactcttatgatttagctccacgagccaaaattttccggcgtgaccaagggaaagtgactgatacggcatccatgaaatatatcatgcgatacaacagtacgtagcatatttctcaagaatcattcttcaaaactccttttcttccctatggatacagaatccatgtaagtttatcatctctgtactagaaggaattataagaagttatttaagtatttaactaatattgtacattttatactcaataaatagagctttggcctcctttataaaatgaaagagaagagtctatacattttttaattgaaaaaaaaaaaatcatctgtaaaacacagaagaaataactcatagagggtcctttaaaatttttctccaaacacaagtttccttccaaggataacagcagctaataaaacaaaacattgttcataaatacctcattttttttgtatgaacagcatcaaagtcaaatttgtatttattttgttggaaacagctgatggacgtttatctggttctctttcccatccatttttcactgtgtaaggttcttgagggcaggctgggcctggggccaaggacttactccttcctcacaagccaagggagatgtctctatctggaagcagactgggctgaggaggcctgtgggagtacactctctgattatctaggctttaacaggcctcaaaaccttactgtggagaagtgtgtctccaaatagccaataatcactctcttccccatttctgtttcctagattataagaaggatccttacagtagaggtgacccctgtaataccatctgctgccgtgaggacctgaactcacctaacccaagtcctggaggttgttatgacacaaaggtaacatgctattggcttttgaatttaattcccaccagcacacaggcctctccaaaggcaaagttgcacaggtttttatggcaggaagcgatgtcgctaaccataaactcaacccaggaatcagctttttcagagattctggtggtaggtcctattatctaacttcaagtccctgctctgccatttagtagtaaatcacataattccgtcatgtttctgtttcctcatctgtaaaatggatataacagtacttacctcatatgttgttctgaagaataaggctttaatctctgtaaaatgtttacaacagcacttagtgagttatttgtaaatgtatacaaccataatgatgttattgttgtcttatgttttaccagactggcccaaagtccaaagaacatattattcaagcagtgcgattccatgttaaacatgagtcaaatttagctgaaggagcaagtttggacaagatgcctaaagcacagcagtttttcacaatgttagaattgataagtgctgtaatgtatctgaaaatataagtaataagtaggtttgcagtggtgtgctaaagccagcttatagacatgcaggaaccaattgttagttgacgtgttgatggcttcaaaccagtcagtgaaagtatttacattatggaaatcaggaacttttttcctcacaaagaaagattgttgttaaaaatttacctgctcaccactggatttgggacgtctgagggtatgaggcatttggttggtggaatcatgctactacatccttttgcactcttggcttgggtgtgtgtcttttcatttcatcagctgtcctaaattctggaagaaacctgtcagggtaaagtgtgtattctgtctttggctcaaaaaattataggaatgctgaccccagttgcacatgattctctatcagcctaatacctaaacaggaaatgctttaaagtatcctaagttccagctcaaccttctttttagctatgtgatgaaggcaaagctttagccgtaatgactctcaatgttaacattaaaaaaaaaaaaaaaaaaggtagacgtagagaagctggcacagatgaaaccccaatgaatgtttttgtattccttttttaaaatggcatttgcaaacattcagtcaatgtgtgaagtttgtatctatcacagaatacacaaagaaaatcacctctgctgccttgcctgggagaactcaagccaagcttccctctaccaaatctcacttctggagacagaggcctgcaattgttcttatcagaaagtttctgttgaaggatattctttaaaaatgtaatttatctctttagagtcattttgaatatggggaaaagaagaagagattctctttcccctctaagattaagacccactgctagccagttgttaggtgtttttgagaaccacggccctcaatttttgacagtgagctctatctactttcagactcttgttaccaccctgattaataacaactttttctaagaacttcatctattctaggcattactttgagcattgcttgcattaatcctcatgccaactctatgaagtagggttatcagcccattttacaaaggagaacactgattcatagaggggttaagtgatttttaaataagctttggagctagaattctgaatatgagtaatctgacttcatatctcacttttggctacattgttcatttcacacacttctagtcaactgacatttaagccaaatgtatacagaagactgtatcatataaagacaatgtgaaaaatggcaagaaaattttgttttaaagaaggcggcctggcgcggtggctcatgcctgtaatcccagcactttgggaggctgaggcgggcggatcacctgagatcaggagttcgagaccagtttggccaacaaggcaaaaccccatctctactaaaaatataaaaattacctgggtgtggtggcccatccacgtaatcctagctacttgggaggctgaggcaggagaattgcttgaacctgggaggcagaggttgcaatgagctgagattgtgccactgtactccagtctgggcaacaagagcgaaactccgactcaaaaaaaaagctaatattgtgactttggtagtgggagagtggggaaggccatggatttaattttttgctgaacgatgattttctaaaatgtcctcctcctccctctttccaggtggcagatatctacctagcatctcagtacacatcctatgccataagtggtcccacagtacaaggtggcctccctgtttttcgctgggaccgtttcaacaaaactctacatcagggcatgccagaggtctacaactttgattttattaccatgaaaccaattttgaaacttgatataaaatgaaggagggagatgacggactagaagactgtaaataagataccaaaggcactattttagctatgtttttcccatcagaattatgcaataaaatatattaatttgtcactttc

SEQ ID NO: 38373 - DNA, 30664 bp, Homo sapiens
acttccgggagcctggggcccaggactgcagcggcttcggaaggtgggctctgccagcgggaccatgctgctccgagccgcttggaggcgggcggcagtggcggtgacagcggctccagggccgaagcccgcggcgcccactcgggggctgcgcctgcgcggtacgctcgggtcccgctctccgggaggcgcggacctgtcccctccgcgcggcgacgcaactgaatattccggagccttcctgtccaccctgctgcccagaccctctgacccttctctcaaatgacacatccctcaaactttcttaggcgggtccccgaacggttgaccccggcgcaccacccctcgcaccctgcgcgacaggcccccagagccgtggaggcgcgtccttcagaccgctcctggccaagttacagatgctgctccgggctcccgtgcagaccgttaccttcggtcagaagggactgcacctactctggctccacgttccttctaaacgtctttgccctttagagccttccttcctacgataccatttgaatatcaactcaacaccccctccaggaaccctctctccctctcccttacctccttttacagcgtgtcaggtatctggtgttgttttctttccattgagattcgaccctagcatcccttacacttatctcacctccagccagatttttccttctgccctttggatgccatgcgttcatagttgccttcggtcttacttggctactccgttccattttttatcagttggagaccgtgctcctcagtctgcggttcccgcagatacagccgctgccccggaggtggggccagtgctgcgacctctctatatggatgtgcaagctacaactcctctggtaaggatgaagcttttcccaaggctgcttataggaagtaaatgatgggcgtgatcacgcaaagaaatggctgaatccctggagaagtgagagccgtgaaggtgtgctggaaaaagcactgagcgaggagtcgggaggcttaaattcgaggccactggcattggctttactactcactagcaattgaccttggtcagatcacttcagcgcaggctctatagtattagttaaaagcatgggctctggaatgagcagaacggccacttagtaactgtgtgaacttggacaagtattaaacgggttaaaagactaatgcaagttttcaccaatgtgtgaccaggggtgtttgcctaggccctgtcctgtcccagccccttatagatcacattacctggcaggaatggaaacaccagcagaaacagatgtcggaacaaggcagtgtttgtagactacctgaggggaggcagaacaatccgagttgggatgggttgtgagtgggagtgtattaggttgatatttggtgggtagttttgtgggaacaaaagaatgtttgaggcctcctctaggcagtgcctgaggggttgagagtgtcttaaggcagggtggccaggtctgaggggtggagtgggacctgaattgacgatgcgctcaaggaaaatgatctgttctgttgtgttcaggacccccgggtgcttgatgccatgctcccttacctaatcaactactatgggaacccacactcccggacacatgcttatggctgggagagtgaggcagccatggaacgtgctcgtcaggttagtacacaggagtctaggaggttctaaggtcaaagaggggcagtggcctgtgggaggcatttctttcttggtaggtgtgcatggaggtagaaatggttttggattctttctggaagagattcaaagagcagccttggagtttgactgcaggcatttgattggttcccatatttcctggctaaatgacttgggcaagttatctaatttctttgagccttattttcctcatttaaaacagagattgtggtagtttctactctgtagggttactgggtggattaaataagacaatgctgataaagtgtttattaccacaacatctgtaagtaagaagtactataaatagtaagagctcaatagttctttttttttttttttatgagatggagttttcacatttgttgcccagactggagtgcagtggcgcacgatcttggctcactgcaacctctgcctcccgggttcaagtgattctgctgcctcagcctcccaagtaattgggattacaggcacacgccaccatgcctagctaatatttttgtatttttatttatttatttatttactattatttgagacagagttttgctcttgttacccaggctgcagtgcagtggcacgatctcggctcactgcaacctctgcctcccgggttcaagcagttctcctacctcagcctcccaagtagctgggattacaggcatgcgccaccacacccgggtaaatttgtatttttagtagagacggggtttctccatgttggtcaggctggtcttgaattcccgacctcaggtgatccacctgcctcagcctcccaaagtgctgggattacaggcttgagccaccatgcccggcctaatatttttgtattcttagtagaaatggagtttcaccatgttggccaggttggtctcgaactcctgacctcaggtgatctttccacctcggcctcccaaagtgctggggttacaggagtgacccaccacacctggccaatagttcattaaaaaaaaaaagttattattttgcattgggctggaaaagagcctgggatctgggatataactagaatctgattcttgtaggtgcagaccttcatccagggcaatttggtggaatgcagtggagctcttcttgctccagggctgtcccacctgtgtctgcagctctatttctgcctggggaactgatgttatatatctctgtttcttggcttgcagcaagtagcatctctgattggagctgatcctcgtgagatcatttttactagtggtgctactgaatccaacaacatagcaattaaggtaagagaagggaaccagagggtgtatgtgggctttcctgacctaggagatagtgtccctccatcatttggactcgtatatgtatttcgcagccatccatccccaccccattgtgaagagaaggcttgcagtctttctgatttgttgcttcctttaaccctttgcagtctactctttcttaagtctttgctgctgttggtctgagttgagtgaggcagttggatagcaaaggaggtggccctcaggccattaaccacttgttttttttttgtctggcagttacttcagagagtggataatggtgattgaaccttttctccattcttctttttttttttgatacatagtctcactctgtcgccaggctggagtgcagtggcgcaatctcagctcactgcaaactccacctcccaggttcaagtgattctcctgcctcagcctccagagtagctgggagtacaggtgcccgccaccatgcccaactaatttttatatttttagtagagatggggtttcaccatattggccaggatgatctcaatctcttgacctgatgatcctcccatctcgacctcccaaagtgctgggattacaggtgtgagccaccgtacccggcctttctccattctttttatctagtaacaacaagttatatatgtgatttcagggctgtcctcctctcagccttcctttttctttctgatcagatctatttgcaacaagttcctcctgtttctttagatatctccattttgaagtgcttgtctttgtggtgccctctgcaggcattcacatggtcacccattctgggatcagtcattttgtcctgggtacatagaagatctttggtgctaatgcaaggaaaaggtacttttagtagtcacgttggtgtttcatagaacatagtcagatttcactgggcctggttgccaggattatgtgagtaaatgccaaggctctgagaaattgtggcttgctgtactttgaactctggctccacttgctctcatctttgtctttgaactgtgctgccagtgttggtttctttgaccttggcctgaatataggaggcctaggacgggcttcagggtcatcagcactctgcctgatcatgttaacaggaaggcatccttccttgggactgcagagaccagagagtcggggtgaaggttcctccaaaggtggagatggtttctgaaatggagagcattttcaaaacttcgaaaatattttctttggaagtctccacagattccaaaccaacaggtcaaggatcgctaagagtacctgtgatgatgtttcttttaatctccatgattggtagagtaaaataatctataaattgttaaagaaatctacatcatgggtaactgagataaaataaggtgggtgggtggtgaaatgtcatttaaatgaaatttttataaacaactgtaacattttgaactatcatcaccatcccacaaccattttttctttttttttttttagactgagtctcactctgtcatccaggctggagtgcagtggcacgatcttgactcactgcaagctccgcctcctgggttcacgccattctcctgcctcagcctcctgagtagctgggactacaggcgccctccaccacacccggctaattttttgtatttttagtagagacagggtttcactgtgttagccagaatggtctcgatctcctgacctcgtgatccgccctcctcggcctcccaaagtgccccacaaccatttttacttactgatgtaaatactttttaggataaaatagagtataaatcaattataaatgtttctcatttatgttctttgtcctcatgaacagaccatttttacatagttataattttgtcctatatggtttaatattctgcttttattttatttatgtgtttattttttataagacagggtctcagccgggcccagtggcttacacctgtaatcccagcactttgggaggctgagaccggcagatcatctgagatcaggagttcgagaccagcctgaccaacatggtaaaaccccgtctctactaaaaatgcaaaaactacctgggtgtggtggcacacccctgtagtcctagctacttggaaggctgaggcaggagaatcagttgaacccaggaggcagaggttgcagttgcagtgggccgagattgcgccattgcactgtagcaacaagggcgaaactctgtctcaaaaaaaaaaaaaaaaaagacatggtctcattctgtcacctaggctggggtgcagttgcacaatcacagctcactggagccttgaactcctggactcaagcaatcctctcatcttagcctcccaagtagctaggcttacaggcgtgtactagcacgcctgtctaattttgttattttaatttatttatttatttttttttgagatggagcctggctctgtcgcccaggctggagtgcagtggcgtgatctcagctcactgcaagctctgcctcctgggttcacgccattctcctgcctcagcctcctgagtaggtaggactacaggctcccaccaccacgcctggctaatttttctatttttagtagagatggggtttcaccatgttagccaagatggtctcgatctcctgaccttgtgatccgcctgccttggccaaccgaagtgctggttttacaggtgtgaaccaccgcgcccggcctgttattttaatttttgtagagatgcggctctcattatgttgcccaggctggtcttgaactcctgggctcatgtgatcctcctgcctttgcctcccaaagttctgggattactggcttgagccactgcacctggctttttattctgctgttaaaggtaatagtcttttataagctctggggagagatgcacattttctttccaagtttttaatttttgaaaaataattctgtcacatatggtgtgtttttttaaaaccaatggaaagatttaaaatgaagtgtaggccgggtgcagtgggtcaagcctgtgatcttagcacattgggaggccgaggcaggcaggttgtctgagctcaggagttcgagaccatcctgggcaaaatggtgaaacaccatctctactaaaaaatacaaaaaattagctgggtgtggtggctgtagtcccagctactcgggaggctgagacaagagaattgcttgaactcgggaggcagaggttgcagtgggccgagaccacaccactgcactccagcctgggtgacagaatgagaccgtctcaaaaaataaataaacaaaaataaaataaaatgaagtgtaaatcttcctctccttccccaaggaccccagtccctgatcctgttctgcaaagttgatactgttaattctttttttttttcccaagggggagtcttgctgtgtcacccaggctggagtgcagtgccgtaatcttggcttactacaacttctgcctccagggttcaagcgattctcctgcctcatcttcctgagtagctgggattacaggagcctgctaccacacccagctaatttttgtatttttagtagagacggggtttcgccatgttgactaggctggtctcaaacttctgacctcaggtgatccacctgcctcagtctcccaaagtgctgggattacaggtgtgaaccactgctcctggcccatttttttttcttttttctgttttttgagacagagtcttgatctcacctaggctggagtgcagtagccagatctcagctcactgcagccttgacctccttggctcaggtgatcctcctgagtagctgggactacagatgtgtaccaccacgccaggctaatttttttttttttttttttttttttttttttagtatagatgatgttgctcaggctggtcttgaactcctgagctcaagcgatcctcctgccttagtctcccaaagtggtgggattataggcattagccaccaccacatccagcccccttttttttttttaattaattaatttatttatttattttgagatggagtctcaccctgtcgcccaggctagagtgtaggggcatgatctcggctcactgcaacctctgcctcccaggttcaagcgattctcctgcctcatcctcctgagtagccgggattacaggtgcgtgccaccacacctcgctaatttttgtatttttatttttatttatttatttattttttgagacagagttttgctcttgttgcccaggctgaagtgcaatggcgtgacctcggctcactgcagcctccaactcctgggttcaagcgattctcctgcctcagcctccagagtatctgggattacaggcatgtactaccacgcctggctaatttttgtattttttttagtagagacggagtttttccatgttggtcaggctggtcttgaactcccgaccttaggtgaccctcccttctcggcctcccaaagtgttggaattacaggtgtgagccaccgcgcctggccatttttgtatttttagtagagatggggttccaccatgttcgtcaggctggtctcaaactcctgacctcgtgatccacctgcctgagcctcccaaagtggagggattacaggcatgagccactgcacctggcgttctttttttttttttttttttttttttttgagatgcagtctcgctctgttgcccaggctggagtgcaatagcactcttggctcactgcaacctctgcctcctgatttcaagtgattcccctccctcagcctcctgagtagttgggattacaggtgcgtgccaccgggcctggcttattttttaatttttagtagagatggggtttccccatgttggccaggctggtctcaaactcctgaccttagatgatccacctgcctcggcctcccaaagtgctcggattacagtcgtgaggcactgcacctggccgctttttttttttcttcaatgagataaatgttttttttagtttcttgtaatagttgaaattccaggaatttttaaatgtacctttattgtttcttgtgatattaacagtaatacctactcatgacttgtttactgttatatcactggcacctagaaaattacttgggatactggaggtgctaaatattggttaaatgaatgaatcataaattccaataatatagagtagaactctaaacacattttcactgctaatttgctgtatatttctccagatttttaaatacctacattaatctgtatactattattattttaatagattttattttttatagcagttttaggttcacagcaaaattgaaaggaaggtatagaaatttcctatatatgccctgcccccaggtatgcacagccttctgccattattagcatcctccatcaagtggtacatttgttgcaattgatgacctgatattgatacatcattatcacccaaagtccatagcttatattaggattcactggtgttgtacattctatgggtttggacaaatgtgatttattctagtgaattattgaacttgaccgggcttcgggaagccctgaatttgtatttgactgggcagaagtatgggtagcttgagacccctgggacttatgtctggtatctgaactaggggcagtcttgtacgattgagcccttaacccatggggttttcactaagtctggagagttagcctcagaattgaattataggatactcagttggtatgagagaactggtgttggagcatactgttcttgcccacttttcctttacaaatgagattgaagtcattgctgtctctctgagtatgttctccttccatctgtcaccaccaatttctagggggtggcccgattctacaggtcacggaaaaagcacttgatcaccacccagacagaacacaaatgtgtcttggactcctgccgttcactggaagctgagggctttcaggtcacctacctcccagtgcagaagagtgggatcattgacctaaaggtaggagtggctattggcaggaggagcaaaaatggaggagcctggcttcagcttgtaaatttctctcttgggccctagctggagcttgaaggaatagatctaacagttaggatgaagtttagagaaataagcctggcagagaacgagatcatgttccccttgagtgtgtactgtcctccttttctctggaggacttgtttctttttcttttttttgagatggagtctcactcttttgcccaggctagagtgcagtggcttgatctcagctctctgcaacctctggaggacttgttacttcttttttttattttgagacagagtttggctcttataactcaggctggaatgcagtggcgcgatctcggctcactgcaacctccgcctcctgggttctaatgattctcctgcctcaccctcccgagtagctgggattacagacgcatgccaccaggcccagttaattttttttttttttttttttgaggcagagtctcattctgtcacctaggcaggagtgcagtggcactccactgcaacctccacctcccgggttcaagtgattctcctgcctcagcctcctgagtagctgggactacaggcacgtgccaccacacctggctaattttttttttttttttttttaaaacagagtctcgctgtattgccaggctggagtgcagtggcgcgatcttggctcactgcaacctctgcctcccgggttcaagcgactcccctgcctcggcctcccaagtagctgggattacaggcatgcaccaccacgccttgctagtgtttttttgtattttagtagagacggggtttcaccatgttagccaggatggtctctatctcctgacctcgtgatccacccacttcggcctcccaaagtgctgggattacaggcgtgagccaccgtgcccggccacacttggctaattttttatatttttagtagagatggggtttcaccatattggccaggctggtctcgaactcctgacctcgtgatccacctgcctcggcctcccaaagtgctgggattacaggcatgagccgccatgcctggctctaatttttgtatttttagtagagacagagtttcaccatgttggtcaggctggtcttgaccttttgacctcaggtgatccacccatctcggactcccagagtgctgggattacaggcatgagccactgtacctggcctggaggacatgtttcttgcatttgttggtgttttctggtttgtatgggagccactggccacatgtgcaggatgccagggactcacattcaccatggcaaagctctggcctcctccttccctgcactgatgcttctcatcctgctaaagaagtagtgtcattttcttgaatcttatccaccagattttggatatcagcattcctagacaaatcctaacatgctgtttgtagatggacccctcaatccaaactccaaagtgttctcatcattcattatttcctctctttttcatcttatttacattcagtcatcaatcagtaacatttatatctatggccatttccttataatgtctctggaattatacttttccctccctcactcccaccttcccttcttccctccctgcctcccttccttcctttctccctcttttccctccctccctcttttcctccctccctctctctctctctccctctgtctttctttttttggagacagggtcttgctgagttgtccaggctggagtgcagtggtatggtcatagctcactgtggcctcagacttctgggctcatagctcactgcggcctcagactcctgggctcacctcacctggctaaatttttatttttgttttgttttttgagatggaatattgccttgtctcccaggctggaatgcagtggcacgatcttggctcactgaaaccactgcttcctgggttcaaacgattctcccaccttagcctaccgagcagcaaggactacaggcatacaccaccacacccagataatttttttgtatttttagtagagaaagggttttatcatcttggccaggctggtctcaaactcctgacctcaaatgatccacccgtcttggccccccaaagtgctgggattataggcaagagccactgcagctggcctggctaaattttttttttttcttgagatggagtttcactcttgtcacccaggctggagtgcaatggcacgatcttggctcgttgcaacctctgcctcccgggttcaagtgattctcctgcctcagcctctcaagtagccgagattacaggcatgtgccaccaccacgcccagctaatttttttgtattattagtagagtcagggtttcaccatgttggccaggctagtctctaactccttacttatggtgatctgcccaccctggcctcccaaagtgctgagattatagacgtgagccactgtgcctggccagcctgctaaatttttaaacattttttatagaggcaacatctcagtacattctccaggctggtggtgaactcctggactcaagtgatcctcctaccttggcctcccaaagcactgggattacagatgtgagccacctttctcggcctcctctcatttctttgtttggattgtatcctgcatcttagctgcctctggactttaatctctgttgcctgaactagtccttttgtagggtccagccccacagggtcggtgggttttctccccatgtgcagagacgagagagcgtagaaataaagacacaagacagagataaaagaaaagacagctgggcccaggggaccactaccaccaaggcacggagactggtagtggccccgaatgccagcctgcgctgatatttattggatacaagacaaaggggcagggtaaggagtgtgagccatctctaatgataggtaaggtcacgtgggtcacgtgtccattggacagggggcccttccctgcctggcagccaaggcagagagagagagagagagagagaggagagagagagagacagcttacgccattatttctgcttatcagagacttttagtactttcactaatttgctactgctaacgaaaaggcagagccaggtgtacaggatggaacatgaagacagactaggagtgtgaccactgaagcacagcatcacagggagacggttaggcctccagataactgcgggcaggcctgatgtcaggccctccacaagaggtggaggagtagagtcttctctaaactcccccggggaaagggggattccctttcctggtctgctaagtagtgggtgtttttccttgacactgacgctaccgctagaccatggtctgcttggcaaagggcgtcttcccagatgctggcgttaccgctagaccaaggagccctctggtggccctgtccacgcataacagaaggctcgcctcttgtcttctggtcacttctcactatgtcccctcagctcctatctctgtatggcctggtttttcctaggttatgattgtagagcgaggattattataatattagaataaagagtaatcactacaaactaatgattaatgatattcatatataatcatatctaagatctatatctagtataactattcttattttatatattttattatactggaacagctcgtgcccttggtctcttgcctcggcacctgggtggcttgctgcccacacctttagcaacaaccttccagtgtgtcctgcacatcctcatcagactttatttctaaagtacttatttggccttttctcactttactcaaaaatcttgagagatttcccatttcctttgacatgaattataacttcattttgcctgatattcagagttctttacatggtgcctttttaagcacttagaaatttctgatgtaattcacataccataacattcatcttttgaaattatacaattcactggcttttaatgtattcacagtttccaacaatcatcactgtcatattccaggacattttcatcacttcataaaagaaagctatgtatttttcttttgtcatttgcacttttttttttttttttttttgagatggagtttcgctcttattgcccaggctggagtgcaatggcatgctctctgctcaccacaacctccgcctcccgggttcaagcgattttcctgcctcagccttctgagtagctgtaatcccagcactttgggaggcggatcacctgaggtcgggagttggaggccgaggtgaccagttcatctgaggtcagaagttcaagaccagcctggccaacatggtgaaaccccgtctctactaaaaaatacaaaaattagccgggtgtggttgagggcgcctgtaatcccagctacttgggagggtgaggcagcagaattgcttgaacccaggaggcggaggttgcagtgagccgagatcgtgccattgcactctagcctgggtgacaaaagcaagactccatctcaaaaaaaaaataaagaaagaattcattttgaaatccaaggtcatggagttttacccctgtgtttcttttttttttttttttgcgggggggtactgaatttcgctcttgttgcccaggctggagtgcagtggcgcgatctcagctcatcgcaacctccgcctcccgggttcaagcaattctcctgacttagcctcctcagtagctgggattataggcatgcgctaccacacctggctaattttgtatttttagtagagatggggtttcaccatgttggtcaggctggtctcaagtgcctgacctcaggtgatccgcctgtctcggcctctcaaaatgctgggattacaggcgtgagccactgcgcccggctgctatatatatatatataaaatattttatatatataatatataatttttttttatgagacatggtcttgctctgttgcccaggctggagtgcagtgacatgacctcggctcactgcagtctccgccttctaagttcaagcgattcttgtgcctatgcatcctaagcagctagaactagagatgtgtgccaccacacctggctatatatttatttatgaatgagagaggaacttgctctggaaccaccaaggcttacagcagccttgacctcctaggctcaaatgatcctcccacctcagcctccttcctgagtagctggaactataggcgcaggctatgatgcccagctaatttttttcttttttctttttgtagagacagggtctcccttggccaggtgctgtggctcatgcctataatcccagcactttgggggccaaggtgggtggatcacctgaagtcaggagttcgagactagcctggccaacatggtaaaaccccgtctctactaaaaatacaaaaattagccgggtgtggtggtgtctgcccataatctcggctactcaggaggctgaggtaggagaaccacttgaacctgggaggcggaggttgcagtgagtgagaccccgccactgcactccaccttgggaaacagagcaagactccatctgaagaaaaaagagacagggtctccctatgttgcaaggctggtctcaaactccttggctcaagctgtcctctgacctcagcctcccaaagtgctaggattgtaggtatgagccaccatccccagctatatttatttattttttatttattttttattgagatgggagtcttgctctgtcacacaggctggagtgcagtggtgtgaacttggctcattgcaacctctgccacctgggttcaaatgattctcctgcctcagcctcctaagtagcttggattacaggtgtctgccaccatgctccactgatttttgtatttttagtagagacagggtttcaccatgttggctgggctggtccaaactcctgacctcaaatgatccacctatttcagccttccaaagtgctgggattccaggcgtgagccaccatgcccggcccttattttattttattttattttattttattttattttattttattttattttatttatttgagatggagtcttgctctgtctcccaggctggagtgcagtggcgcgatctctgctcactgcaacctccgcctcccaggttcacgccattctcctgcctcagccccttccccaagtagctggaactataggcgcccgccaccacgcctggctaattttttgtatttttagagatggggtttcactgtgttaggcagtatggtctcgctctcctgaccttgtgatccgcccgcctcggcctcccaaagtgctgggattacaggcgtgagtcaccacacacagcctattttatttttgagacagagttttgctctggtcgccccagctggagtgcaatggcacagtgttggctcactgcaacctctgcctcccgaggtcaagcaattctcctacctcagcctcccgagtagctgggattacaggcacctgccgccatgcccaggtatttttgtatttttagtagagcagtgctttcaccatgttggccaggctggtctcgaactcctgacctcaggtgatctgccgaagtgctgggattacaggcgtgagccaccatacccaggtgtgagccaccatacccagcaatttctttctttcttttttttttttttttttttttgagatggagtctcactctgttgcccaggctggagtgcatggagtgcagtggtgcaatctcggctcactgcaacctctgcctcccaggttcaagcgattctcctgcctcagcctccctagtagcttgggactacagggcgcgtgccaccatgcctggctaatgttttgtatttttagtagagacaaggtttcaccatgttagccaggatggtctcgatctcttgactttgtgatacgcccgcctcagcctcccaaagtgcttggattacaggtgtgagccaccgtgcctggcctttttttaaatttttttgagacggagtctcactctgttgcccaggctggagtgcagtggcttgatctcagctcactgcaacctctgccccccgggttcaagcgattctcctgcctcagcctctcaagtagctgggattacaggtgcctgccactgcgcccggctaatttttgtatttttagtagagacggggtttcaccatcttggccaggctggtcttgaacttctgaccttctgatccacccgcctccgcctcccaaagtcctgggattacattcgtgagccaccacacccggctggcagtttctttaattttgtcatttcatactgtcatgtggatggaatcatacagtatgtaaccttctgggattggcttttttatttttgtttttgtttttttgttttgttttgttttgttttttgagatggaatcttgttctgttgcccaggctggagtgcagtggtgtgatctccgctcactgcaagctccgcctcccaggttcacgccattcccctgcctcagtctcccaagtagctgggactaccggtgcctgccaccacacccagctaattttttgtatttttagtagagacagggtttcactgtgttagccaggatggtcttgatctcctgaccttgcgatccgcctgcctcagcctcccaaagtgctgggattacaggcgtgagccaccatacctggcctttctttttttttttttgaggcagagtctcactctgtcacccaggctggattgcagtggtgcaatctcagcttactgcaacctggatttaagcatttctcctgcctcaacctccgaagtggctggggctacaggtgtgtgccaccaggcccagctaatttttgtatttttagtagagacagggtttctccttgttcgccaggctggtctcgaacttccgatctcaggacacccaccaacctcagcctcccaaagtgctgggattacaggcgtgagccattgcgcccggcctttattggcttttttcactaatcataagtctttgggaattcattcactgctgcgtgtgccagtagtttgttccttttgattgataagtagtagtccatgttatggatgtacgaaaatcgtctgttgaaggaatctgggtagtttctaggtttttggtattacgaataaagttattgtgaacatttgtgtaagatgttttgtgaatttaattttcatttctctgggataaatgcccaagtgtacagttactgggttctatggtaatttcatgtttagtttgatgagaaacagaaactgtcaaactgttttccaaagtggctgtgatatttacattcccactaacaatgtatgaaccattcagagtctgtgcatcctcaccaacattttgtgttgtcactgtttttagttaactattcagataggtatgtagtataagactccttttcatgactaagtttgcctatattctgatttaggaggactttgtttgtactatctagtcaccttactcctgcatatccctaggaactagaggctgctatccagccagatactagcctggtgtcagtcatgactgtgaacaatgagattggagtgaagcagcctattgcagaaataggtgagtatcatggcttatccctgatccctgcccaccatggggctctgtatgaggtagtatactgagagctgtaatactctatggagtgtagttaggaaatcaagggaaagcctaagtactttgttcaaggacattggaagtgtcataggcagtatttgaatccaggtctattaccattttttttttcattgagacagagtatcactctgtcacctaggctggagtgcagtggtgtgatctcagctccctgcaacctcctcactctgggttcaaatgatcctaccgcctcagcctcttgagtagctgggactacaggtgtgtaccactatgcctggctaatttttgtatttttagtagagatgaggttttgccatgttggccaggctggtcttgaactcctaacctcaggtgatccgtctgccttggcctcccaaagtgctgggattacaggcgtgagccactgctcccggccaggtctagcaccttttatggtttttaattttattgcagttgctgccaaaaccaaccacaaaacaaaaaagcctgctactctttttccttttagaacatctctattctccccacatagagatcgccctgtaatttctttaggcacattagcacaaagatctgttaatcttgtttttttttttttattttgttttgtttgttttttaatcaaaagggatctagaaagtaatctgacattttgaaaggctggtgttaatgaggtggtgagaattgtatgcataagaatatcacgagtgtttcgatctggtgctttgcccttcatcttttttattctaaagaagggaagctactgagacacagagagggaggaagggggaagggggaggagggaaggaaaagaggaaggagaaggggtagaaggagggaggggaggagtttaatatttacaggtcatttactattggagataattcacagtgcactgtgggactctgacagatgactttccaacattgtgctgtgggtcttcccctctgtttcctcagggcggatttgcagttccagaaaggtatatttccatactgatgcagcccaggctgttggaaaaatcccacttgatgtcaatgacatgaaaattgatctcatgagcattagtggtcacaaaatctacggtcccaaaggtaccagccccttctagagttccttctctctgtaccttccagcaagacctttgatagatgtttgtcacagtcatttgggactactgttgctctcagaggaagttgtacattcagagtcccttgtagaatgcaaatgtcatttagcaatagccagaaacacttgcttgtttgtagaccttagcagttactatacatcaggccattctttcttgctctctttaacaaatccttagcaagcatgtagatcttaatttggttgaggaaaaatgggttttgtcaaatcaaatttatctagataggcccagctatcttgttttccccactatgatgtgcagagcaactatttgagtccctcattcccagtgtcttgctatagctcaggggaagattgcatgggatttgacatctctttgtgttctttttttttttcttgagacggagtctcgctcagtcgcccaggctggagtgcagtggcgccatctcggttcactgcaagctccacctccctggttcacgccattcttctgcctcagcctgccgagtagctgggactacaggcgcctgccactacgcccggctaatttttttgtatttttagtagagacggggtttcaccatgttagccaggatggtcttgatctcctgacctcgtgatccgcccgtctcggcctcccaaagtgctgggattatagatgtgagccaccaagcccagctatctttgtgtttattcttagaagacttcatagtctgttatcctgttagtctctcaaggatacatgtttgttccctatggtcctattggaatgtgttcaagcttgagttatgcctctttcccttaacccttgggaatagactgttgtcctctgttttgtgaaggtaaccataaaatataaatataaaatataactcctctttctcaagtgagggccttttttgggttgatgtctgtgctggtaccctttttatgtctgcagggtgtgttatctgggtgtataccttgtggaagtaggtgtaatagcttctggaattatggaagatggcgtcttctaagggttcccagaggttgtagagtgttttttgtgagttattatttcaaaaagcccagtaagcgttctgtcttttaataaaatgttgcttttattggcttttattgtagataagtctttttgataaaaaccaatgaactcaggctggataccccattcttcatcatgtgcctatttcacattatatgcctgtattaaaacatctcatgggctgggcacggtggcttacacctgtaatcccagcactttgggaagccaaggcgggcggatcacgaggtcaggagttcaagaccagcctgatcaacatggtgaacccccgtctctactaaaaataaaaaaattagccgggtgtggtggcatgtgcctttaatcccagctactcaggagactgaggcaggagaatcgtttgaacccaggagccagaggttgcagtgagccgagatcacaccactgcctgggcgacaggcgagactccctctcaaaaacaaaaaaaatctcatgaactccataatatatatacctcctgtgtactcacaaaaattttaaaaacaaaaaaccaatgaactcattgatcagaagctctgatcaacacttacatgtgtacaggtgtccctcattatccaacctcctgctttccaagtccagaatctaaatagatttagataatgtggcattcttcactgttcagacatggtatttgagcacttgctgtttgaatttgggaactgtttagactcagatagtataagattcttgaatttttttaaatggagaaatgaaataattcttaataaatacagtttaatacattattttattcatttgttttatagggacaaggtctcactctgttgctcaggctggagtgcagtggtgctatcctaccttgccacagcttcaatctcctgggctcaagcaaccctcctaccccagcctcaccagtaactagcactacaggtgtgcaccaacacgcctaatttttttttttgagacaaagtcttactctgacgcccaggctggagtgcagtggtgtgatctcggctcgctgcaacctctgcctcccaggttgaagggattctcctctctcatcctcctgagtagctgggattataggcccactgtgcccggccatgcctggctaattttttttttttttttttttgagacaaagtctcgctcttgtcccccaggctggagtgcaatggtgagatctcggctcactgcaacctccgcctcccgggttcaagcgattctcctgcctcagcctcccaagtagctgggattacaggtgcctgccaccacgcctggctaatttttgtattttattttattttttgagacggagtctcgctctgtcacccagcctggagtacagtggcgtgatcttggctcactgcaagctccgcctccagggttcacgacattctcctgcctcagcgtcccaagcagctgggactacaggcgcttgccaccacgcccggctaatttttttttttttgtatttttgtagagacggggtttcactgtgttagccaggatggttttgatctcctgacctcatgatctgcccgcctcggcctcccaaggtgctgggaatacaggtgtgagccaccacacccggcctaatttttgtatttttagtagagacagggtttcactatgttggccaggctggtctcgaactcctgacctcaggtgatccacccacccttggcctcccaaagtgccggaattacaggcgtaatcccgtgcccggcccaatgcctggctaatttttaaaacagtttttgtagagatagaggtttcactatgttactcaggcttgaattcctgacctcaagcaaccctcccgcctcagtctcccaaagtgctgggattacaggcatgacccactgcacccagcttattatttaaaatctggtgtccttcataatcgatttggaaaccactgccttaatttttatagtacctccattctcagcataaacagtttttctgtgtgggagaactgtcaagtgccaattctattcagaagccctgattacttggtgaataactttgcatgctcatgctcatattttggcacaaaatttctgtaattcggcttgtttagtcacaggttatacgcatttttaagttttttgtttttttgagtcaaggtctcagtctgttgcccagcctggagtggagtgagtggcacgatcatagctcactgcagcctcgacctcctaggctcaagtgatcctcctgccttagcctccagagtagctgggactataagtgcatgccaccatgcccagctaagttttaatttttttttttgtagacacggggtctcactgtgtttctcaggctggtcccaaacttctggtctcaagtgattctccttccttggcctcccagaatgctgggattgtagtcatgagccaccgtgctccaccaaattgtttttaaatttaaattttattttgaaaaagtaatattcatgtgattcaaaattcaaaagctacaaaaaagtgcacagacagccaggtgcagtggcacacgcctgtaattgcagcactttgggaggccgaggcgggcagatcatgaggccaggaatttgagaccagcctgtccaacatggtgaaaccccgtctgtactaaaaatacaaaaattagccatgcgtggtggcgggtgcctgtaatcccagctaatcaggaggctgaggcaggtgaatcactttaaccgggaaggtggaggttgcggtgagctgagaccgtgccattgcactccagtctgggcaacagagcaagactcttgtctcaaaaaaaaagggaaaaaaaaggcacagacaaaagtctgcctctcacctctgacctccagctatgcagttcccttctggggaggtaatttctttcttggtttttttttttttttttttttttttttctgattttctctggttattgggaggcaatttcttgggtttttctacaattatcctatgtgtttacaaacaaatatatacttctcctccagctttcttttttatccagatgatagcatactgtactcactgtttcaatctttcatttttcacctaatggtacatctttttttttttagacagagtcttgctctgtcactaggctggagtgcagtggcacaatcttggctcactgcaacctgtggctcccaagttcaggcgattctcctgcctcagcctcctgagtagctgggattacaggtgcgtgccaccacgcccagctaatttttgtatttttaataattacggggtttcaccatgttggtcaggctggtctcgaactcctgatttcatgatctgtccgcctcggctgcccaaagcactgggattacaggtgtgagccaccgtgtccagcccataatacattttttttttttagacggagttttgctcttgttgcccaggctggagtgcaatggtgccatctcagctcactgcaacctctgcttcccgagttcaagcaattcttctgcctcagcctccctagtagctgggattacaggcatgtgccaccatgcctggctaattttgtatttttagtggagaaggggtttctccatgttggtcaggctggtctcaaactcccgaactcaggtgatccacccacctcagcctcccaaagtgctggtattacaggcgtgagccactgcgcccggccaatacatctttgttttttcaagctaaagtacagacttttttttggatttcaccagttttgtaacaatgtatcttggagattttatggtgtcagttcagaacaagcttcttcttttttttttttttttttttgggagacagagtcttgctccatcactcaggctggagtgcagtggcttgatctcagctcactgcaacctctaccacctgggttcatctcatgtctcagcctcctgagtagctgggattacatgtgcctgctaccacgcttggctaatctttgtatttttagtagagagagggtttcaccatgttgaccaggctggtttctaacttctgatctcaggtgatccgcccgccttgacctcccacagttgggattataggcgtgaaccaccacacccggccccctcattcttttatacacctgcttggtatttcattgtatggacatgccataatctatttgaccattaccctgatgatggacatctaagttgttcccagtatttttgctattatgaataatactgtaatgtatgatggcatttcatatagcatagggagctactttaaaccattttgatcattactccttctggcatttatcttccagatgttaaatattttactaaatactatgcttttactgctgtttcttcttttccttaacgttttttatttagaaaaatttcatgcttacagaaaagttgaagtaatattttgatccctttggaaagaaatattttgttttatctacttttctctctttctgttttttgtaacaaattttgtttcccaggggttggtgccatctacatccgtcgccggccccgtgtgcgtgtggaggccctgcagagtggaggggggcaggagcggggtatgcggtctgggacagtgcccacacccttagtggtggggctgggggctgcgtgtgaggtggcacagcaagagatggaggtatggggagagcagttccctcccacaacttcttcccctgtgctgggtctcctatttagaggcttctcagcatgactgaggcagatctctgcagggagagagggcttaagaaaactcttccttgtcctggtgctgctggcaccttgttctgagggagacattatgggcttcaaaacccatggccttttagtagttatcagctcatttatttctggataagtaaatgaaccctgtgtccagttatcaagcgccttttgcataccaggcactatgctcagtactggagatacagtggtccccatgagtacataggatgataggtggggctgatacatagtcacttccagttataggagaagggcttctcaaactgtctttctgagctggttaatggttactgcctaatccttccttgcctgctccttagtatgaccacaagcgaatctcaaagttgtcagagcggctgatacagaatataatgaagagccttccagatgtggtgatgaatggggaccctaagcaccattatcccggtatggacttgctctttctatcctcattctggtagaggctgagactctgagacctctctcacagtatttctttcctccaggctgtatcaacctctcctttgcatatgtggaaggggaaagtctgctgatggcactgaaggacgttgccttatcctcagggaggtgagctggacggcatagacagggcctgcggcagggccacttagaagagtcatacaggctattaaacttcccagtgtggagatgataggcacaagacctcttgattaagggtaaaggtcattttgtaagtgcctctctttttttggttggctgggtagctgggtacagactgaagtttaccaccctaggaagacttcctggggtagaattttgtgccttttatcgtcccaggggatgtatgtgtctgttgtgggttacactagcagttctgttacaggcctctagaattgaagatgctccaaaggccactaagtgtttggctgcccttcaggctggtgcagatggtgcattacgtcctggggaagtgagcacatggtcctctgctgcgtcttcttgtcaaacccatgtggtatcatgctctgtcacactttgccagcgtccttgcttaaggaagtcatccaccatgggggccagaggagctaggttcacacatcctaggatgtgcaggggagcatcaggtcctttagttctgccagattagaaggtctcttgttttctccagggtatgactccagggccctgggggatgggaacaagactgagggtttgtgactaaaagtagacgttgatgatgaactgaacaaggttcgtgtctctctcctcagtgcctgcacctctgcatccctggagccctcttatgtgcttagagcaattggcactgatgaggatttagcgcactcttctatcaggtcagtgagttgagctgcaacatttatgaaaggcatcctcttatatttttcatctcctgttacagtttttttctttttccaccctgaagtttttctcagtcgagttctccttatctcttctcataaccttgtgaaagtttctagagcagtggttctcagacttcattgagtatcacctgggaagtttgtgaaatatgatatctgagtcccacattcagatattctgattcactaggtccggaggaggagtagaaaacatctcaggtgattttaatgttggtggtccgtagatcatgttcttttttttttttctgagacagagtcttactctgtcgcccaggctggagtgcagtggcatgatctcagctcactgaagcctctgacttgcaggttcaagcaattctcctgcctcagcctcctgagtagctgggattacagacatgtgccaccaggcccagctaatttttatatttttagtagagacggggtttcaccatgttggccaggctggtctcgaactcccaacctcatgtgatctgtccaccttggcctcccaaactgttggaattacaggcgtgagccaccatgcccggccgatccatataccatgttctgagaaactctgcctaaaggggaaggaccatgttcttctctccatatcttttgtgtcgtagatccttagtgagtatttgcggaatgaatttatcccagtgccagagctctgatggggagccattctcctgtgccttttttcaggtttggaattggccgcttcactacagaggaggaagtggactacacagtggagaaatgcattcagcatgtgaagcgtcttcgagaaatgaggtatacatattgtatcagagacgctttggaagaaactctagcactgtctcccctcttgtccttaggctatgtgtttacactgccaaaaccaaagttcaagcgtacttggatcttaggatttagagattccacaaagcaagaaagtagatcttcttggctacttgtcttcacaatgagaaagtgtttttaaaaactaaagaactaggccgggcagggtggcccatgcctgtaatcctagcactttgggaagccgaggcggacagatcacctgaggtcagaagttcgagaccagcctgaccaacatggagaaaccccgtctctactaaaatacaaaaaaattagccgggagtggtggcgcatccctataatcccagctacttgggagactgaggcaggagaatcacttcaacctgggagggggaggttgcgttgagccaagattgtaccattgcattgcagcctgagcaacaagagccaaactccgtcccaaaaaaaaaagccgggcacagtggctcacacctgtaatcccagcactctgggaggctgaggtgggtggatcacaaggtcaggagatcgagaccatcctggctaacacgttgaaaccccgtctctcctaaaaatacaaaaaaattagctgggcgtggtggcgggcacctgtagtcccagctactcgggaggtgaggcaggagaatggcgtgaacctgggaggtggagcttgcagtgagccgagatcacaccactgcactccagcctgggtgacagagtgagactccgtctcaagaaaacaaaaacaaaaacaaaaacaacaaactaaagaactagatgaatgcaggtaatgcaggtagtagttttttttttttttttggagacaagttcttgctctgttattcaggctggagtgcagtggcacaatcacacctcactgcaacttgtgcctcccaagctcaagtgatcctcccacctcagcctcccaagtagctggtactacaggcatgtgccactatgcctggttagtttttgtattttttgtagagacggagttttgctatgttgcccaggctggtctcaaactcccgggctcaagcagtcctcctgtcttggcctcccaaagtgctgggattacaggcacaagccaccgcacctggcccaggtagtattgttcattatgattattattatctttagagaaagtgtctcattctgtcacccaggctggagtgcagtggcacagttgtagttcactgtaactttggactcttgggctcaagttatcctcctgcttcagactcccaagtagctaggactacagctgtgtgcccccacacctagctaattttaaaaatatattttctgtggctgggcacggtggctcacgcctgtaatcccagcacttcgggaggccgaggtgagcggatcatgaggtcaggagatcaagaccatcctggctaacacaatgaaaccccgtctctactaagaatacaaaaaaattagcctggcatggtgggcacctgtagtcccagttacttgggaggctgaggcaggagaatggcgtgaacccaggaggcagagcttgcagtgagctgagatcgcaccactgctctccagcctgggcgacagagcaagactctgtctcaatcaatcaatcaatgtgtttataaaggtaatgagatccttggccagtcagctggcaccagggcttcccctagtagccacagagctcatcttcctcctggaaccttgaggcctctagattttttcagagcctggctctgtcttggttaaccttgactttcaggattctcttgatctagttggtagagagaggaatttcaggtatatactctgcttccctttatgagctctcccaggcctttctgtgttctggatttttctttgtagggtctagctgtattgcttaagtgtctatagcttgctcaactgcaggacccttcctttgtcctcactttctggtattctgtggtatactcacaaggcatttctactgaccacgtggccagcaaagccttttgtttcctatctatgtggcttcggcatctgcaccctattccttctgaccctttacaaactgaatgcagcctggtcctattagctctcagagtcttattttgtgagcctataataataagtggtcttccctaaagaggaaggacaggaaggagatggctaactttaagggccatggaaaatctcatgaatagaaaggcattctgggaatgtttagtatatagaagagggacaagtcaagaatataatgaaatttgataaaattacctggtgaaatctaaactgtaaaatcccatattcatagcacactgaagtaatatctggtctgggaacattatccaagatatccaagcttctgcttggggatcgatcagagcttagcagagatttcttagcagcagctcttgtgtgagatgggatgctcaggtctaagatccaaggaattcttttggattagacccagggatattggaagcacaggccaactctggggagatgaaacgggcaagaactgggtaagggtacagcataccaagatgatgtagggttaagttccacccctaactgggaactagaacaaaaccaagaaacaaatgctgaaaagcgggtaatatgtggtgggctgaaacgagctgcttatacatgtcatatgaagagaggcttaaactagatgtttatacaagtctcaagggtcttggttcctccaagggaaaccatggccatagcctcttaccagtgggatgaaagcttcaagaatatgaccatgtttggtgtccattggctcagggccccactgcaattgagcctgaggaacctagttattcctgttagcagttggggagagctctcaggagagctgacaaggacttacagggagctggagagctcaggataccttaaccacctgtgttagggtctaccagggcaagaggcagaggacagacagggacagaaggaggcaagccattgctcagagccttggggccaatgttgtcgacttcctatctaagccctcactcatttaatgcctcttctctttggcagccctctctgggagatggttcaggatggcattgacctcaagagcatcaagtggacccaacactagaagaatagggccctgactttgtgctggtctggcccctcctgcctcaccaacccgtgcacaaccagacaccttgttacacctagtggatgctctagattggtatagaccagttgacttcagcatcagtccacctctatgacagaaacacaagaaaactgtctttccctagcttcagttccttgggtgtggagcactccccatttcttctcgggtcttaaagtgtgtggacattttcatcccgaagccatagagacatttgctgtcatattgctgctgggcacatctgtgctcttggtgaggagagcaagaggaaccagaagaagtctctttggtcagggaccatgatgctctacatggacatttgagtcttcgtcttctgctgctgctcggctggaccagcttctttaacagcaagcataatccacttcaatgtaatattttctgtagctccaaaggctatctcttcatattgactgcagacagactgaatggacagtttcttagagggcttgtctcctttctacccttgtcctctttcctttcctttgacctaatggagctagaaatatgtctgtgactccaccagttattctaataatttgttttcttgaaaattgttaatttcaagactggagaaataaactcaccttctatttactctgtgactttatgagaggttgagggaaaagtggaagctgtacttgggaattgtggagaagaccgccactccatctgatttgcataaatgactcagtgggcttttgtatctcttcatttaagaattatttgaatgcctgccaggagccagatttgttctgggtattaggaatacactggttaacaggaccaaaaaagaccctgccctcactgagttttaaattttagtggagagatggaaaataattaaacaaataaacaatgttatagattgtg

SEQ ID NO: 38374 - DNA, 49946 bp, Homo sapiens
ggtgctgcggtgctagagcgcggcgcgaccggacgctgcgggcggggaagaggatggagactgtggcgtccgctgcaacggttggggctgcgcgtgagaaggtggcggtgtaggcacctgcgctcggggaaggctggcggcggcggccgagccatggcgggagacccccttctctgggctccctgaagtctcggggagccgtgacccatgggatcgttgagcagccgggtgctgcgccagccaagaccagcccttgcccagcaggcgcagggtgccagggcggggggctcggcccggaggccggacactggagacgatgcggcgggccacggattctgttactgtgcgggcagccacaagcgcaagcggagcagcgggtccttctgctactgtcaccctgactcggagacggacgaggatgaggaggagggggacgagcagcagcggctcctcaacacccctcgaaggtacgtgggggcacgcacccgcgcggacccggacccgcacctgttgggcctggggccgagccggcgcctcgtgcgcttgcggggtgcagcgctccccagcctatggagaggggacgtgcccttgacagggtgaatgtggaagccggcccgatgcggggcggactggggagcgccttgggagacgccaggtgttccgcattttcaaccacagacgcttccagggtgttgttacagccccaagatgaggatgagaaacgccaagcccgagctcgcgtctcgttaaaccttagagacgcccggctggctggccttcccagtccacctttgccctctcaagtgggtagccgcagagtaagttgttttgcatccggttgccttagtacagacactaaatgtaatctctgaaataggcactcttattgtcgcccactcagtggagggtaagtaattgcacacaggagttcttgttaattgtaaaggtgaagtttatcaatagtgtacatttgttcctaactaggaacagagtctgtgcaagtttctagtagttgatgaagtcgttgaccgtggatgtactgtatgtagggcggtgctgctgcagcttgtttaaccccttttttttttttttttggatgagttgaaagatggaatattgacttgtgacctggaatgtagtttataggtagaatatatgcttacacaaacaatttggtttttctgcttttgtttttaaaggttatttggtagggtcacacatgaaattttttaaatgatttctttttctttttgagacagagccttgctctgtcactcaggccggagtgcagtggtgcgatctcaactcactgcaacctccacctcctggttcaagcgattcttgtgcctcagcctcccgagtagctgggactaccggcgcgcaccaccacgcctggctaatgttttctgtttttagtagagacaggtttcatcgtgttggccaggcttgtctcaaattcccgacctcaggtgatctgctggcctcagcctcccaaagtgctggaattataggcgtgagccactgcgcacccggcctaaaattaaactttaaaagcagattcaaaaaggttttgctatacaagtgttatatattgtaaaaaaggaatcatagattaaaaacttaatagtttggtttataaaaccttttgtacctttttttgtatgaatatttgtatttattatacaaaaatgtacccctactgtgaatactattcagtaacttttttaattgtttgtttgatttttggagcttttttctaaaggagtctcactatattgcccaggctggtctcaaacgcctgggttgaagcgatcctcccacctaagcctcccaaagggctgagattacaggtgtgagccaccatgcctgaccctgtaacctttttgaagcgtcagtgtagcatagtttttttttcctttggaaaaatttttctctattttgagacagggtctcgctgtgtcgcccaggctggaatgcagtggtgggatcatgactcactctacctcgacctcacagaatcaggcaattctcccacctcagccttctgtgtagctgagaccacaggcatgcaccaccacacccagctaatttttttatttgtagaaacaaggtctcactctgttgcccacccaggctggcctggaactcctgggttcaagtgatcctgttgccttgacctcccaaagtgttgggattacaggtgtgagccaccattgccaacctatagcatagttttaagagttctgagttcttggccaggtgcagtggctcatgcctataatcccagcactttgggaggctgaagcagacagatcacctgaggtcaggagttcaaaaccagcctggccaacatggcgaaaccctgtctctactaaaaatataaaaactaaccagtcgtggtggcagctgcctgtaatcccagctactcgggacgctgaggcagaagaatggcttgaacctgggaggcgaggttgcagtgagccaagatcgcacaactgcactccagtctgggtgacaaagtgagactctgtctcaaaaaaaaaaaaaaaattctgacttcttgtctgtattctgcacttaatagccttatttccctcatatgtaaattggagatataaatacctgccttttaggctttgacaaatatgagaacaaacaaatgcacaatgtctagaatgtaagcatgcagtaaatatgtctccttgatgaattggcccctttatcataacaaaatgttcatccttctttatccctagtaatttagccactaccacatacatacatacatatatacatttatttatttatatttagggggtacagctgcaggtttctcacatgtatataacaagtagtggtgaagtctgggattgtagtgtatccatcagccactttcttttgataaatgtctgaatgatatcttattttccctcctttcactttttacctgtgtatatttaaaacagatatcaagtaaacagcatatagttgagtcttgcttcttttgtccaacaggacaatctaacctttcaattagtagttagaccacttatatttaacgtaattattgaaatatatgtcacagtgcatttgaaggagagaaatcacacagcaatttgaatacaggaaatttaatataaacattattaacaaggcacagagaattaactactgaggacaaaacgctaaggtaaagagatccctagaaaatacatgtagtagtcagtacttctaaggctgaggcagaatagccacagaaggaacaaatttggaataggtgcccccacccctttcccaagctaagattcagatgatgttgaaggaggtgtggctgtagcccactggatggtggaaaagtttgctcaagtgtggtaagctgaggctggcaagtaggacactgcctactaggatgccaacaaaattatttggaggccttttggcccagaaggctaaagatatttactatctagacctttacagaaaaagtgtaccaactcctagactacatgagtggactggaatggaaagtttttaaggcaaacctttatcggaaaatgcatatcagaatttagtgtctgtatattactggaagatgcttggattattcagcccaatacggatgcagggtgtaagaaaatactaagacgggccaggcgtggtggctcacgcctgtaatcccagcactttgggaagccaaggcaagcagatcactttaggccaggagtttgagaccagcctgaccaacacagtgaaaccccgcctctaccaaaaaatacaaaaattagccaggcttggtggtgcacgcctgtattcctagctacttgggaggctgaggcaggagaattacctgaactcaggaggcggaggttgtagtgagccaagattgcgccactgcgctccagcctgagcaacagagtaagaccctgtctcaaaaactaaacaaataaaaatttaaaagagaaagtattaagatgttgaattttgtgtgttggccctagtatatacttcctgaggttgtctggtgtgctctcccacatcaacagaccactttatgagaagttttagcttttaggcccaacttccacctcatacctttgtcaactgcatgttctacttttacatttacgagactgttaaaacccacactgttctacaaccagatcttgagtgttttgtccgtagcttgtctctaaaaaattgaaacgacattacatagttataactaagtaaatattgtttcagaagagttaagtagtatgctaggattataaatcatacttgatgggtccagtgtcacaactgcttgtctgttcaaagggagaaatttttctaacctcacagtcatatggaatcttttcttgtattccatcaagtgcttaaagtcaggccctgcttttgtttttatcttatttggacagtgcctttttttgtattgcttttttattgtcctagagtttataatggcctttcccccactcttgtcaaaataacaatattccttcatcatggcttcgggtttttctgaaaaaacacagaaaagtcttttgaaacacactttcatggaatccttctctaaaacctagacctcttccatcctcctgttccaatctggatttgtctactcttatgctgggacttactttcaccccatctctaggattgaatccactattttgtgtagcctgcatttctttctcgcttattttaggaactatttaatacatcctcaagtattttccaaggaagggtgcaaaagggggtaatttgtgcgtatctaaatataaatttagtctcttttactttattcatcctctgactgggtatggaaatctaaagtaactttcttcatatctttgatgacgctgcttcattgtcttcaggcctacagtcttgatgaaaaatttgattctggtgtaattctcttttcaggtgaccatttttgctctctggaacttgtggaactttttctttggtattttgggatttaattagaatgtgcttaagtgtgggtcttttaatggccttggtacttgttggatccttataatctggagactcatatactaccttagttttgggaaatttttttccattaatttcttccataatttcctttcgcttcttatctttattttttctttctgggatgcctcttaactggattttggatttcttggattatgcctgtctcttcttttttcctttctttgtctttttgctttatgttctgggaaatttcctttaactttttcatcactatcattaggttgtttggccctaactatgaggtatttcttttggaccaggggtgaaaattactaaaatatgaaatgtgctgtgatccatgaaagcttgggaacctctgctctacaaagcatgccccacctataaccaacttcgtagtcttcttactcaaagaagaggtaccttggaaatagatctatttactcaattaaaacaccatacatcagttattcattcttaaatataagtggacaagcaaggaaggatcacccaacatgaggaagaaaaacaaacaaactattctttggtttatttgtttttttaaatttcagtaatcatgtctttagtctctaaaagctctttcttgttctgagtgatcctttatcatagcagtctatggggtaaatataataatctcagatctctaggtatactggtgagagggtgtttttttcctctcttttccctgaattatatgtttccaggggtggagggagtctctctgtctctctgatatgctcttattcttcctcatggtgggtgatccttccttgcttgtccacttatatttaagaaggagtaactggtgtatggtgttttaattgaggaaatagatctatttccaatgtacctcttctttgagtaagaagactacgaagttggttataggtggggcatgctttgtagagcagaggttcccaagctttcatggatcacagcacatttcatattttagtaattttcacccctggtccaaaagaaatacctcatagttagggccaaacaacctaatgatagcagattgcatggtatctgaaagatgttactgtgtttccttcgaatttaaaatactccacatgcctctctgagttggctgtggtgctctaagttcagatggtatcctgaactggtgaatttcacacacggtttgggaaccatgacttagggtgaatggattgggagtgaacaggccacagattctttaaatttcagaatgaggattgctttgtctgggcaccagcagctacactacagccttagatcttccattagctttgtgctatttctagaaaaaccttggaatctttttgcctcagtatctgtactctccttatctatactctgtgttcatagagtggagaaggcactagtttccccattttctgcccctcttcttacttctgcctttgtttccctgagacctcatccttcttttctcccaagggttctgatgggcagataagcttagcctccatcctagtcctccataatgtattttttggctgtggctgtcactgttctttttcatttgaatttgttttctaactttcagatctgtataaatctctcatcaagtgatgagcctaccctcaccttttcctggtgtggacttattccttttttgtactcttaatctttaatgtaatttggggagggatgggaagccaacatgtgtacattctgccgtcaggaactggaaactacattgtctcttgatttcgcatcataacgagtgaagtggatactattaatgtcctctttttacagctgtgataactgagcagctgggactcaaacccaagtctgttaccactaagacatgtgctgtttttattgtcggctaggaagaggtgttaagtacacaggtgttaaattcgccaattcaggatgtcatctgaaacaattacttcatttttaaaaagagattgaaggttttatgtgctaggaaagctttcagaattggtcaggaatttaagatattgatcagcctctgcctaaggccttttcttagttactggatcattttgagcaatgattttcaaactttatttttttagtcaagtcttcctttaaattaaatctgtgcagaaatccagtatgtttacagatagaataggtgatgctgctctggttgaagttagatgggatgctcacagttcactccttagctctccttggtggcccctaagacttctcctttgagcagttttaaaaacctttcatctaaaataaataaataaataattttaaaaaacaaataggaaaagaaaagaaaacctttgatctaaggttgcaaaccgtttgtccagtggctggaaaacattttaagtagtttaagaataggttggtaccaaaataagattaaatgtaaattattttaaaattacttgggtaggtgaaatgtttactcttgttctccatttcctacttgcagattattgcgctatttgagctccttcatagtgctggtttctaaataaggaaataagcaaaaaatcaacatgctaacttcttaatctattgaatgggtaattaaattagtccaaaattgctaaaacatgtgtagtgaaaagtctgcctcccatgctgcccccctttctccactatctctcccgtgcatagaggaccccagagataaccactattattagtttcttatgtactcttctagacacaagaaaatttgaatatatactatctccctatccttttacacaataggtaagttgactctatttaatagaaattgaataaaaggagtatttagaaatatatgcaaaatcagtaaaacattcagttttatataaatatgtgactttttcatttcttttaacaggaaaaaattaaagagtacatctaaatatatttatcaaacattatttttgaatggtgaaaacagtgacattaagatttgtgctctaggagaagaatggagcttacacaaaatatatttatgtcaagtaagtattttttctatttgagtaacagggtagtcactgaaactcttaagtcatgttcttcctcattgcacttcacagtaatcttttgcatgaacaccatagtggttaaatcctctcatttgatcagtctgtaagaaaaatggcaaacattgttagtgaaaactaagtttggtctagaaagagattttgatatttcagtatcagactagcctaatactacgtatttgtcattacttcataaaatgcttttttcggtgccttctgttgataaaaggggaaaagttggggaaaaaatatttaacattaaagttaagattgtagtgtttattttgcttatggttatttaaattggataaactcatctgaaatgttgctttgtagttcacattgagtgtgaatagaaagttctctcctgaaaaatgcaggtaaagacaacaccaaaaagtatatagactaagtagatttctgtactgaaaatattactacctgccaccccactttaaaaattcagaactttcatagctgacgtggtgttgggcacctgtaatcccagctactcaggaggctgaggcaggagaattgcttgaacctgggagatggaggttgcagtgagctgagatcgtaccactgcattccagcctgggcaacagagcgagactctgtctcaaaaaaaaaaaaaaaaaaaaaaaaaaaatcggagctttcaaaatagaatacaatgttgctctaatggcccaaatattttattcattttctttcatcaaatctataagctaggtattgtttgaggcactagaaataaaacaacagtttttatcctttggaacttacatttttcctctttaccatttgagaataattactggtaagacagcatagtataaaatttttcagtaaaagtatttgaaaatgaattgccttctctaacattttaatcatgttttaaaatgtgtttttgaaacaaatttattttggcttgaagtatgttgcccagatactatatcagaatattgcttttaacttcagggtatgattcatgttgtttctttttaatatctgaaagcagttttgtgaacttgagggtaagaatacctctgttaaaactttacccctcgtggaagatgtattataattcaagccacatgctaaaatataagccccctgaggacagaaacaatatcgattttgtttattgctatattcacagtgccttctacatactaagtactcagtaacatttttaaataaattagttaatatttgatccatttcaaagtaattctaattatgaggagtgctatctggcagatacctaaagacttcattctgtacctttccaagaattcaggtccattctggacatttctcattaaactaaattttggattttccctggtttctttggcgatcatcctgtttttgctgacttgggactggtttggtcctttatagccattcaggtgtacagtaaagattcaacagtttgagtaaaaagctaaccaggttcaaataatatacatgaattcaatttagatagtaatataagaattttagttttttgtcaaaaatagtactaaaccaaaagtatattttgatacacctaatagtgtccttatcttaatttcttttctcctgtggacatatttggcagttctttttctgttgaagtaatagaatggatgagtttagttaatggatagaatagttgcttagaattagaaatgggcaaataatttggaagacacagaaagtacttgataatcgttgacttttttttttgtttaagtctggctacttttctagtatgttcagtggttcttggaaagaatccagcatgaatattattgaactggagattcctgaccagaacattgatgtagaaggtaactaccacaataattactattatgcaacaatcgtaaaaacataatcttattcttctggtagaagataaataattccttccagccttgtagtctagaaaactccttttatcacctcaaggtgataatttgatgttgatttacaccatagtttatcagttctgtccatcttatcactaatctgttttgtcatttgggccttatcagtttgtttacttatctttgtaaatatgcccacctgggatatggaagatgtaggatggaggaaggaaaagtatgaccatttttttttttaattacatagaaaatctgataaataatactgattattccctatgtatgaagatgttttctgggaacaataaataaaaatattgttttagagctaaaagaatccttagttgaggaagctgaggctcagaggagttaagggacttattttggatctcagagcagtttagtgagcctgtgtcagactacagctctcctcattcccattccagtgctcttgctgctcccctcattggtggtccacatggaagtacctggtgcgatacaaaggcaaagaaatactttagttaagaatatttacagcctgtaatcccagcacgttgggaggccaaggtgggtggatcacaaggtcaggagatcgagaccatcctggctaacatggtgaaccccatctctacttaaaaaaatacaaaaaattagccaagcgtggtggcaggcacctgtagtcccagctatttgggaggctgaggcaggagaatggcgtgaacccgggaggcagagcttgcagtgagccgagatcgcgccactgcactccagcctgggcgacagagcgagactccatctcaaaaaaaaaaaaaagaatatttacaaagcaaaccatgtgggacattcataacagtggcagtggaggaaggatgaacaggcatagatcactgtgggggctgggaatgagtgtggcatggacaggactcaggagctgtaccacatttctcagtggtggagtgctgaaagcagccgggttaagattatctttgagtctgcgtatttgtacttaacgattggtctactgaggagtatcttatacaacttcttgcaaggcatcttggttgtgaccactgatgtcaagattacatgttagaagaatgcagctagatttggtagaataaacagaaatttataaccttgttattaaattaacagtgtcaaccagtaaccattactagcgttttaattagagatacttctgttatccttttatgtgcatgccacatttagacggatgtctttgtgtgtgaagacagtcgttgttgttatttgtataacacttgtaatagatataaatattatttcatcctacatgtgtaccttgctttcagcactgcaggttgcatttggttcactgtatcgagatgatgtcttgataaagcccagtcgagttgttgccattttggcagcagcttgtttgctgcagttggtaagtatgcacgttattcgaagaaaggttcagaataataatctttgtctcaaagtgtgtactccaaaaacaaaaataaagcttagcttttttggagtttttaaataaaaatgaaatgtataaatatgacatttattataaatcatttaaaatgcctaaccaaaagcaatttattacaaccgagggagtcatgatgtctgcataaaatgaatgcaggccatttctgtgtagatatcttagtatgactataatgtggaaaaaacgtacttgtctaaggtcatttacagatttcattaatgacttgactattaagcagatggcttatgattaccaattaatttcattcatgggttcaaataaacatgcatgcctactatttaaatttctcttaattttgaaagaattgtgtataaatcacatatatgtattttaatctactggcagaatgacagatttgttcattgaagagaagtgtgttgagcactgtgtcaaactagacacagaaagccaaaggtaacttaagacgtaatccttactttcaaaaagttcacaacatagtatgtatgtgtggagaggggagggagggttgatatacaaacccaaaggtaaagtaagagctgttcaatattataggtatgataataaacatcctgtagcatttagtgaatggataaagaagggagtggtcagttcatcctggtggtgtcacatacgaaagttacattttcacacagagtcttgaaagtgtgtttgtattgcaaagtaagaagaggggaaggaagagcatttcagacagagagaacagagtaaactaagatctagtgatgtgaaataatggaggattcaagactctaacagaaacatggctcccacataaacataagaaggattgcagaagaggggggcagaagccagatcatgaaaatacatctatacattgctaagaagtttagcatacacagtacctttggaatattttaatcaggggaaagacgaagttatgttttagaaagaatacttcagtaacaatgtgacagatgaattgaaggaaagatgagtacagcattagagacaaaaacttgttgcattcgtccaagggaggaaagtagggtagtagcaataagcttggaggggaaaaagtggataccagagagattcagggataatccactggacttggtgatagactaaatgttaagaggaaaggggaggagtctagaatgatttccaggtaagtttaaaatcctaatggagtcaatgttttattttaatcttaaaaaattgtttacttttatgtggtatttttgtactgatttatttgaagtattaatagcttgctaaatatccttggttgagatcatttgattttcaaaatgttttgatcctttcaatacttacttccaataagtatactttattatctaactctggtccttttggttttgttctaaattcaccttctgcttacttttatgatttactaactctttaacttaatatacctgcatgatgaatgtatttcagaaatttgaatgaaaagtagtattcttcccatatattaaagttagttcacttaaaacctatataaacattttaggttaaaactttaatgttaatcatttgaaataataatatacttgttttaagtctatctcttagatattgtagttattttaaacttgatcactttctgctaatgcatactgttagtttagtcccatcacatggttaactgactatgtagacttcttaatttaaaaagaaatggcaaaacagacaaaatgctgctaaagaaatttgcaaaggtctcagacaggggaagaatagaaaagaaaaagaatagcagtattcattctctaccttactactcccccccaccttccattttcaaattccaagtatttagttgaatacttgctgaacttttttcagtatttttattggacttgttaaaaaaaaaaaaaaaaacttaggtttgctgcacttaatgagttttctttcttttctttcttctttttttttttcttttactttttaatatgtaaaagctgtcagagctaatttttcccacgtgaaatgggcctttccagtgcttatttatatttacaggacggtttaatacagcagtgtggtgagacaatgaaggaaacagttaatgtgaaaactgtatgtggctattacacatcagcagggacctatggattagattctgtaaagaaaaagtgagttgcctttcttgtttttcttcctatcccacttttaggaatttggttgctttagtttcttaagagaatgtatagctataagaaagaaagaattaaggaaaaataggatagggggatggaattttattaaataaaaagccccttttaacttttggactaattagtaaattcctcaaaagtgtcgtctttgtaagtgaccataggtgggttatatacatgcttataaaaaccatggtcaccttggtcgggtgtggtggctaacacctgtaatcccagtggtttgggaggccaaggcagaaagatcacttgggcccaggagattaagaccagcctgagcaatgtagggagaccccatctctacaaaaaattttaaaaattagccaggcatggtggcatgcacctgtggtccccactattctggaggctgaggtcagaggattctttgagcccaggaggttcaagactgcaatgagccgtgatcatgccactgcactttatagtatattttctattaaaattgtttaagaagtaggcctgatagactgacagtccttctaactcttgagagttgcagtacctgttttgagattttaaagaaggttatactagtatgcagaccccttaataaactatttaacacaaactcaaaatgaagttttaaaactggaaatgctctcgttaatataaaggaaatattctcttaataatatccactgacaaaaataatactaaatttcctattgttaagctaaaagttttgagcatgttctggcaagattaatctgattttattttaactataagtcctacttaataaattgtaaatacatggcatataatgtaataattatatattttaatttcaggtgccttgaatggcttctaaacaatttgatgactcaccagaatgttgaactttttaaagaactcaggtatttgaatttcaagtaacttcataattagtcatcctaaaatattgtttatcatttgttaaagtacataacatttttgtagaacacaaaaatatattatgaaaaagcaaacaatttaatgaaagggcttgactacatccataaactgaagaaatgctgtgcaaacttatttctttgttgtgaataatataatggatattatgtctactgttttaaccgaaaaatgcattactgttataagactatagaaaagtttcaggttttgccaggctgttagagaatttaaaagttatattttaaaaatcatcttttttattgagaaataagtttgaagaaactgttttggcctttttttttttttttttttaccttcaaaaacttttcatgttgatccgttttctcactaggatgaattctctgatgtggagtaacaaatgtgtgtctcctataaatgtatatttttccatctctgattatttcacaccttgaatccaaatctgtagtcccagctactctggaggctgaggcaggaggattgcttaagccatagaggtcaaggttgcagtgagctgtgattgcgacactgctctccagcctcagtgagagtgagacaagttaccatggttcttcaccgtcacctcctggtacaaggtcttctgaaccaggtcaaggtattcccactcctgatgagagaagtctgtggccatgtccctgaatgttacaaattcacaggccatggttttagacaagcaaaagccaatcagtcctcagggtttctctaccagaaaagcgatttgggaaaacctagacctataatcccagcactttgggaggccaaggtgggaggattgcttgaatctaggagttcgagatcatcctgggcaacatagtgacatcccctctctttgagaaaatatcaatcttcctttaaaaaaaacctgttagcgccacacagggtcccatgcaggcttcaggctggggctgcagaggctcctgcagtcaactgcgccgccttcgtcctcaagcgggacctggtcagacgcagcacagcgcagagccagaggtcctggagatggagccagaggtccaagatttctccatcacctgtggactatgtagtccaagctggaataataggaccgcagtcacccgtgagaaatggattccagggttctaaaaacctacaagaaatatggcggtgacaatgaggactgcccaccctgcccaccacccaagctgcagagcagcctttcttttttaaagagatgggggccttggtatgttgcccaggctagactcaaactcctgagctcaagcagtcctcctgcctcagcctccaagtagcagggattataggcacataccactgcacccagcttagtttggctttttggattaagtacgcatattatccatttattcctgcagcaagtacttcctgactgtcctttatatgtaaagatactctattaggggctgtgaagaatgcagagatgattttgtcatggtctcttgctgtcaaagagcttatttgtagtaatgggactaagatatttgtgatgggtctgagaaaatctggctagcagttaacttttgaaggctggttggcattacagtcattttctggcttgcatttccctgacagcagtgcttctgagacaaggatacaaatgtgtccgagagtatgtgacattctgatggaaatgtacaaaaccaaagtcaaacattacatagcttcccagaatgtgaattttactgattttttttttttttttggtggggaggaggtggggaagaggtaaatatttttatgtttaaatacattatggaatagagggaattcaaatttccttgaactctcaagatacaatttatagaaatgttactttttatggttagaccacctcctagattatggggtttttttcctttcttttgcctttacgagataatttggtagagaagtgtgagagactttcatcacctggtgatgtcaaggcataaataaatcaccgtagaatgtttgatttgaaaatcgttagaaacactttaatacagtcaaccctgcttatccatgggttctccatttgtggattctaccaactgccgattgaaaagatttgggggaaaaactataaaaaataataacaaaaaaacccaatgtagtatgacaactattgcataacatttacattgtattaggtactgtaagaacacctagagatgatttaaagtatatgagaggatgtgcataggttacatgcaaatactatgccattttatataagggacttgagcatagaggattttggtatttgtaggaggttctgaaaccaatcccccacagatacagggggatgactctaatttctcactgaactttttgaaaaaggagcaggatcctcttaaaaacccacgtgctctcttggctttttatggctcaaaggaaagaaagaacaaaggaaaagcaaaacaaaacaaataactggtgatatcattttcactctaaataactagcacgtttcttgatcttattgtcttgaatagtactaaaaccatagtttatgactaagcaattctcttaagcctagaggttaaagattactttgacgatatagctgttttagtgtctttttttttttggttttggagacagtgtcttgctctgttgcccaggctggagtgcagtggtaacagtcttggctcactgcagcctccacctcttgggctcaagcgatccttcccaccccttcagcctcccgagtagctgggactacaggtgcacaccaacatgattggctaatttttttttttttttttttggtagcacgaggtctcaccatgttgtccaggctggtctcaaacatctggcctcaaatgattctcctgcctcccaaagtgctgggattacagatgtgagccactatgcctggcctttttttaaagaacaaaacaaaacgtagaagtggagtggtggaaggcaaaagaggaagactgccattttatcagagcatacttaaagttatcttaccggaaccttgctttaacttgattaatcagcagatcagagctctttgtttccctatcagtgtgaaaaggacctttcacagcacactatctgaattaaaagtatccttgtatccagatagattgcactatctgaattaaaagtatccttgtatccagatagattgttttctaagattctttgtcttgggcagaaggactgctgtcatttttaattccacatatttttttacaagaaagacttaaagcttttatttctaccaggatcctttagcctgtgcctaaagataagctcactccctctatttatccttttcagtataaatgtcatgaaacagctcattggttcatctaacttatttgtgatgcaagtggagatggatatatacactgctctaaaaaaggtactgacgtaatatgatgtcatattatacaaggatgtcacctcagcaatgcgtataatggtgaaaaactggaaacagtatccagtaataaagggatggttataaatgtaggaaaaggaaataggccgaaaccttaaaaagtctttatatttagggatttggaatcattagtgattttaactttattttttgtacttttctattttaggaatacttttctgttttttcccagacttttctttaacaaaaaatatgttattgctatttgtttatttacataatcaaaaatgttttatattgtttttaggaacgttttcaaagttgagcttcagttaatgatggcatttttacacacgctttttctaagaaatgttgaaatttttcttttaaaggcctgtttgtgtgtctggcatatgttttacttcatgcttttgaaaagtttcaacatttaaaaaatctaattttattttcacaactctttgaagacacagatcagccattattcttccatgtagatagtgagactcagagcaggtttgaggcagagactgggtcttgggagtcctagtccattgccctcttcctactgcataatcctgcctttacccttttgtccgcaaaacagtgttgtgagtatttaacacagttgtgaaacttcagactgagacactttctagcttatctcatagggactctttgtttgtttgtttctatggtagaggtgaaattttgttactgtttttcttcaaggaactttactatctgggctatccaatcttttaaaaaattggtgcagaggtcaggcacagtggcttacgcctgtaatcccagcaatttgggaggcccaggctggcggatcgcttgaggcctggagttcaagatcagcttgggtaacatggcaaaaacccctctctacaaaaaatacaaaagattagctgggtgtggtggttcgtgcctgtagtcccagctactcagcaggctgaggtgggaggatcacctgagcctaggaggtggagcctgcagtgagttgtcacagtggcattcatttctgttattaaaactgctttttgccagtaatggtaagtactaatacttacaggatgtttacgtgccgtgcaccattctaagtatttatgtatattaaatattttaatgtcctatgaggtaaacatattatcatgctcattttacaaatgaagaaattaaggcccagagatactaggtaatgtgcccggctcttaagtgccaggttcaggatttaaaagtttttgctcttacctactctgcgtattatctcagcagcagtaagacaaagaagctcctttttcccatgttcatttcttgcttttataatctcatatagtatttagtgaaattgagttgttagtagaataaattagtataaaatttctaattaatatacatatatattaaacctttacctttttaatacagtaatctccagtgtgttaccataaatacttctgaaggattggcttactccttagcacacacatccaatttttatcactggactatgatttttttttcttttttcctggagacaaggtctcgctctgtcacctagactagaacatagtggtgcgatcatggctcactgcacctcgacctctagggctcaaaaggttctctcacctcagcctcttgagtagctgggactccagatgcataccactatgcccagctagttttttttctgtgtgtagagatggggtttgaccatgtttcccaggctggtctaaacctctctcaagtgatctgcccaccttggcctcccaagtgctgggattataggtgtgagccacagcacccagccattggactatgataatgccatgataaattgagtgcttatagttgtactttctttcttgcaattgctggtaaagtagaagttaaattttttagctattatattttaaggtgaaagcaatttgaaaatgtaaaatcataaaatgatgaaatttcataattgttttcttatttaattttttttaacttagtggatgttccttcaacttgtgccttcttggaatggatctttaaaacagcttttgacagaaacagatgtctggttttctaaacagaggaaaggtaggcctgaagtttttgagaacttgtcttttaaaaggaaatttgttaaaatcaggccccatgagaacagaaaataaataaattaattaattaaatgaaatcaggccctgacttgtttatagacttaattttagagcttggagaagaccttagcaattatctacttcacccctcatttacagtgagaaaatcaaggctagataagaaaaataccttaactatcattatctgaattgttactccttgaactgtcatcatactcttgatcgccaaaaactattgtttttcccattttatcactaacagatcttgttgattgcatttgtcttgaccacactgagttttctctaacaagctataccccgtcaggcaaccattcttaacataggggccatagataggctttcatgtgtcactgactcccaaaagtgggtacagaatttgatatgtgtgtgtgctgctgcatacatttgtgagaggagagcttccataccttccgtcagattcttagtggagactgatctaaaattggttaagatcaactgctataaggtcttatctgtgcaaaggagggcatgcaatataaaaaaaatacatgtgtatactaagttaaaatgtatgtatgttattttttactttgctaaaacatatctagaaaaagtattttttacggctgtcaggtgcaaagaactggataaatccttagttcgtgattttcttagtttatggccacctttttggtttatttttaatacgttgagcctttgtgacctaatctttgagtactagaacatcagtaacttcagtcttaactcatgtgcttcttttctattgtgtccctctgacttttcctaaccactatcttgaacttcatgtttattcttttgctttataaatatatattattgcaccatgtatatacgtcttaacatatattacatagtggtgtgctaataagctgactctgaaaaaataatccttgattagtaccatttcttaattcccatggtacaaattttcccatcatggctgattgattgcaagctaccaacatgacatcactgaatgagaaaggagatgcacacagctcctatgagctagcagcaacacgccactgtataatatatcattttgttttagttgttatggaactatgtcacattgtggccttaattttaatgtcctttataactaaagagattgaatgactcttaatatggttattagccatatgtttcctcttctgtgagatatctgttcaggtatgtttcctattttaatgtcagatttgtcttttcttattgatttgtaggcattctttatgtattcctgataactaatcctttgtcatacatatgttctgcacttccagtttgtaggttatctttttaatttattaaagatgtctttttggttgggtgccgtggctcatgcctgtaatcccagcactttgggaggtcaaggcaggaggctcacttgagaccaggagttcaaggacagcctgggcaacatatcaagaccctgtccctacaaaaagtttaaagaattagcagggcagcctggcacggaggctgatgcctgtactcccagcactttgggaggctgacgcctgtactcccagcgctttgggaggctgaggtgggcagatcacaaggtcaggagttggagaccagcgtggccaacatggtgaaaccctgtctctactaaaaatacaaaaattagccgggtatggtggtggtcgcctataatcccagctgctagggaggctgaaggaggagaatcgctggaaaccagaaggcggaagttgcagggggccgagattgcgccattgcactccagcctgggcaacgagcaaaactctgtctcaaaaaaaaagaattagcagggcgtggtggcatgtacttgtctgtattcccagctactggggggaggatcacctgaccctgggggtgtcagggctgcagtgagccatggccacacaccactgcactccagcctggacagcagagtgagaccctgtctcaaaaggaaaaaaaatgtcttttgatgaatagatattcttagttttaaaatttcatgctctttatatcttagttaaatacattttatagaattattttatgtagtcaaattacctacctcagagccagataaattaattttctataaagttcctgaagtaaaaatgtgtaaagaaccatatcagtgaaatataacttgatttccttgaagaacaaaaatactaaacttgtatcttaaattatacttttgtgttacgttatggcaattaaagaaggactagggaaattatagaggagaaaagtaggggaaagcatttaaatagaagagagagaaaagctgaaagagacaaggatggtgaagaagttaaaaagacaaagagactcagtagaaacagtagatattaggcaaatgttgatagaaccttatgatcatttgtgctccagatagatccaccacagcaatcaatcaaaagagaaattgccctgtagcctaagtggcagaaactagagaagcaagctgtggtccacttctggattcccacttgaggctctccctcccagcccctgaggtgtgaaagtatacagttcaagataacttttcaaggagacattgattgcacaaaccaaaatgtatgtctgatgctcttgtttttctatgaagattttacagagtcattttcaatagttttaaaattataaataagatgcatacttaggaaataggatagaaaaatcacctgtgatccctcactcgttatattttggcatatgtctgtctgtctttttttttttgagacagagtcttgctctgtcacccaggctggaagtgcagtggtgcgatcttggctcagtgcaacctccacctcccagattcaagcaattctcctgcctcagcctcccgagtagctgggactacaggtgcatgccaccacacccagctaatattttgtatttttagtacagatggagtttgccatgttggccaggctggtcttgaacttctgtcctcgagtgatctgcctgcctcggcctcccaatgtgctaggattacaggcatgagccaccacacctgccatatatttttgtatatttcttttaagttttcttaattatttgacttttcagatctatatggatcaggactacaagaaacaacagaaatttagaaagttttctacacaattatacttaaggattgctattgaatttggctgatggaataagtatggccacatgttgtccagcaagaaactttaaaacattttttttggttctataaattcttacagaagtaaatgagccagtctcttctacagccgtgacgaaaaggcttcatgagttagaatcaccagatttctatgagacaatccagaattagatttttatatcttgttcatgtgacagaacacttgtaaaaacaaaatggtattctcagcacaccccctgaaattggcacatttaattcaacatatgaactggaaccaatgttgttatttttaaactcaagagatataaatccactgtcacacacctgttgtataaataagtgaagttaactattaattttttaatgaatttactgctttcttgtttgctttgctgactctaggcaggtgccaagggaatacaaaaaatatatgagataatgtggaaattcttttcattaacttggctgtctttttacaattttcaggaaaaaaatattttagtggggaacaccttctggtctacagaaaacctgtgttccatgtgaagcatggtttgagacataatagtctataatggcaactgtcatgtttttctccttatccttaatagcaacaggactgggtatacatactctcctgggtatatgtcgtttaacagaaaacatagactagggctcatgcacaaatacctgtttgatagcagtaactctaaacctttccttctgactcatgaaagcacactggaatgtaactgagggtaatttttaggaataaccttaaattctccctaaaagaaaaaaaattatatacttcataaacttgaattattctattttcttttctttttttgagacagagtttcactctgtcacccaggctagagtgcagtggcgcaatctcagctcactgcatcctctgcctcccgggtttaagcaattctctgcctcagcctcccagttagctgggtttacagatgcccactaccacacccagctaattttttttgtatttttagtagagacagggtttcatcatcttggccaggctgatcttgaactcctgacctcgtgatccaccctcctcggcctcccaaagtgttgggattacaggcgtgagccaccacgcccagccaaattattctattttcagtattattattattattattattattattatcattattacttattttagagacaagttcttgctctgtcacacaggctggagtgcagtggtgcaatcatagctcactgcaagctgaaactcctgggctcaagcaatctttccacctcagcctcctgagtagctgggatcacaggcgtgagccaccacgcctagccatacagtgtctttcttattttgtatttcaatagagaattaatatattaactagtgttcattacatgtagctgaaatgtaagttaaaagaaattaagagatattctttgtcctgtgtaccttatccttgagtgaggcttttgggctccagagtttcactggcctgttcaggtcttgggagggggattctggcgagaatgtgtaatcctaagtacctttctcaagccttcctttcccaacttgctgcactatacatgccaaatgcccagaaacagctgaattcccagcctgggggtttcattaagaccaaagttaatttcctgggattttaaaataaatctccttatgttcttatctgtaaacctaaggtttataaaattcttgagaactttaaaactagcttattttgtattctaatagacatgaatgtacgtatcccccgtccacaaaaacatttaagaataataggtttgaaaagaatggctgtttaacttacatggttttttatagattttgaaggtatggcctttcttgaaactgaacaaggaaaaccatttgtgtcagtattcagacatttaaggttacaatatattatcagtgatctggcttctgcaagaattattgaacaagatgctgtagtaccttcaggtaagagaacataatttgtaattttaagtaatatatttctgattataaagtaatatagatcatagaaaagaacaaggaaagaagtagaaattattattaatcccaaaaaggtatacatctttatgccaaagtggaatcatcctatagaagtaattttctgtgcttacatatcatgagtattttcccatatcatatttcatgaaatactctctagaatatttaaatgattatctagtattctgtaatatggatgttctttaatttaataaaccagtacatgattttggatgagactttttaaaatgacttttgaagtatttaaagatcataagtgatttttctattagtgctccttaaatttgtttattttgattttttcttattctaaagtcttaaacttcatgttgaagcaaatgtgtctttgctaattataatttaaattttttgaaataactactgatttacctttctgagttaaatctctagtgcttgtgaataattctatttagtactatatatacatatacaaaattgaaaatagaatttctgtttgaacatttacatgtaatgtttgtagtaataattatagatttgtctaaaaagttgtgattatttttgacaccttaattgtgacatagctatatgtttatagatttttgttcctgatatctgtatacttatttggaaagaaattgaagggaaggaaaacttagagttaactcttctggtatatttggaagtgatgcatttttataaaatcactttagcaagtttatagatactgtttaagtcacaaattctctgaattttacattgcttatagtatagcagttctataatagttttagtatctgttaaataccaggccctagcaataatgtaatgttagatgccaaagccaattacatatgccgctctaactgtacttccttttaaggctttttgcaaatgtattttgtaagagattggggaaaagtctgttctaaagtagtttaatttaagtgtgcctgtgatgcaagtggataagctttatatttttggattgcaagatgggtacaagtatttctagtctaaaatattttgttcagtataaaatcagaaagaatttagatcctgtattttttggcagatttcagtcattgttaccgtatcttacagataattatttatcacattgtgaagagacagaaggaagccacctaattcacattattgagataggctgatatatgctctcagtaggaaggtatcttagatttgaaattagttgaaattattttgattaatcaacctaaaacttgatcatttttcagaaatagtgccaaacatgtgttaacgttaatcaaagttaggcgtttggcaatatggggaatttgggtacatctgtttaccatctttaggtgaaaaatttagaagcatgtttaattaaaagttgaattgggactttgtatagaagcactttattttaggattcaactgtgtcaagcacagttcaactccattatttcatggaattaggtttatcttaggtcattaggttcattaactgtcttattccatactcttgtcatgctttcctccacttggatacctctgacctatcttgttactattcctcccagacctttctactatatgccctggaaccagggacaacaaaatcttccatctcttccctccttttttttttttttttttttttttttttaacttccagaataagctattttccctccgtagaagactttctggctctcacaccctactaatatagggccaggagaccaccgtcctagccccctcagtgtgcactttccaaaccattattgcatgccatctgagcctgttttctcttctgacccctaatcatttctttgcattcatttaagacttagacacttattttactgtctatttctcccccaatccagtcacataatatgtccatatgaacaaatacatttaatatcccagcctcctagtagttttttgacctcagctctcagcctcctagttatttgacctctttgccaaacattaggcactttcttcctaaaacctggatatgccatgaaccttgtgaacccagaatttctcagcatcagaaacctggtagttttcaggctattatatagcctagcatgttcatagcctcattcccttttacactgctctttaacttccaacccattttaagcccttcattttctgccagtctttcaaacctctcctgtcttttcttccctctcaggcttggatttcatgatagatcatgttaggtcactctcacagttgtcttcaactctgtgtccttcacttggcaaaatcctagaactaaattaaaccttctttgttcctataccctctactttgtgctgagtactgcagatcatcctacagcttttgtattggtgtcactgcaaattcacatttcaacactaagcttgaaccttgggacttcttacactacttttagttcattatttctctttttcatttccttcagcaattgtatcaatttctgccactctgttccaactttctacccaattacctcattgtcagttttgtgaaaataagttactgaaaatgaaaaggtatgtaaatccatgtaataaactcagaaaatagcttcagaactagattttgacgttattatacataagcatttttgaaccaggcttctccataattttgtgttaatattttatacctagatactctatacagaatactcttatttgtccatgtaggaatttttactatgtaaatgtttagtcactcatcttcattatctacatctaatttatgtgtttcataagttgttcaacttgtaggcttagttttttgctataagccatattagttttaagtggattcatgttagtgtatgtatacctgaagatacacttttcccttcacttaaacaaaaaatactgggcaaattaggaagtatcttttttttgctttttaaagtttgtgaatgtaagacatgagattttcaaataatatggttttagagggccctttcccatattctttgtgtaaaactagggaaataatctaaataaattcaatctaatgtatctcatttattccattgggaaaatactgggtttatattcaaaactgctgtagactagatcacagctgcagatcagatccgtgacgctgtcaaataccaccttgaaatgtccatattttttccccctgcaggctggggaggggcaggtgggtagagacagagtcttgccatgttacccaggctgttctcaaacttctagtcttaagcaatgcttctgcctcggtctcccaaaatgctggaattacaggcatgagtcactgtacccagcccctattttgagtttttgttttggaccttggtctgataaagtttaaaataagtgcggaaacatattactatttagtcaaaatttagtctacttagtcaaagtttcttgaaggcactttttcagaatctttccagctaacagtagctctctgccaaaaagggttctggcaaactcttcctagtgtttcttcctttttggagatgattgcatacaaacatattgaaaactctgtgtaaaagaacctgcttcacttattttcatcccatattttaccagggattctttttttttccttttgcaatgctattaacattgcatttgaacttgtgttacattgacttatttttggaatgctgcttttaagacatgggacctagaatccttgagctaccaatgaccagaaagatttcaagtttgactttttattcttttggattaaactatgacaagaggaacaaaaatatgtactcatgtttttaacttgttcaaatgcttttggttttaaaggaggttatgcaaaaattgttggaatttaaattctaaaacatttttggccgggtgtggtggctcacgcctgtaatcccagcactttggaaggccgaggcaggtggatcatgaggtaaggagatcgagaccatcctgaccaacatggtgaaactccgtctctactaaaatacaaaaaataagccaggtgtggtggcacatgcctgtaatcccagctactcgggaggctgaggcagaggaatcgcttgaacctgggaggtggaggttgctgtgaacccagatcgcgccaccacactccagcctggtgacagagcaagactctgtctcaaaaaaaaaaaaaaaaaaaaaaatttatgggatacatctaacatgatatttgagaatatttacgtatgtctgactctttcattccaattttacaaatgagtcatgaaatgccatatgctatctctagatcaatgagtttcaaactccaggtattttaataggtagggatcagctttaaatatatatatatatatgaatttttttaaatatatgtgtgtatgtgtgctgagtcatgtaatagttgctactagtatttacctatgaagacaaattatctgtactagacacttaaattccttataatagcaagaatgtaattttggaggaccctgaaagaaagattcaaaagtgtatttaggccagacatggtggctcacgcctgtaatcccagcactttaggtggccgaagcaggagaccccttctccataaaaaatggaaaaattagctaggcatggtggcagacacctatagtcccagctactctggaggctgagaggagaactgcttgagcccaggagttcaaggctgcagtttaccaagatagggccaccggaccccagcctgggccacagagtgagaccgtgtctctctctctctaaaaaaaaaaaaaaaagtatatatgggatgttttaaggaaagacaccagtaaatcattggaagtcaccggattacttttattaagtagagacctaggaagtgacaatccagattttaattgcactacgatttctacccctcttttacatagagattgagaaataatttaagaacttaaaaaaaaatagaaaaactacccattctagttgggaataaacaagagcagaaagataaatagtgctgagccaattctatttgtatttatttattttttttgaggcaggttcttgctctgttgcccaggttttgagtgcattggcatgtccagggctcgctgcagccttgatctctcagactcaagagatctttctgcctcagcctcctgagtagctgggactacaggtgcacgcacctaatttttgtggttttggagagatcaggtctcactatgttgcccaggctggtctagaactcctgggctcaagtgatcctcctacctcagcctcccaaagtgcttgggattacaagcatgagccatctcacctggcctactcttatttttaatctgtttttatctaaaatagctaatgtttccacttacacaggcttattttgtgggaaaaatatttattattaaaggaatgtctgtaattacaatttttattctatttagaataatttaaaatattttaatttttatgttatctaaatctaatattctagaattatttattgagtgtgcatgtttcatctacgaatttagggatggcttatttcccaaaaaaccaattaattgtttttttatgttaataatggaagagtttattattcaattttctgtcagaacttctgtaaacactaaaaatatagtttcagatatgatttttacaattgaaaaattaatatgaactatgaaagggaaaacgttaaacgcaagaatatgcttttaactatcccaatttaaatgtatgcaatgtaataagtacagtctagcctgagacaaagctgtaaaacctttaccactttaaagatcattcagccattatagtatttttgtaaaatataagctacctaccagtttcgtttgtttgtttgtttgtctgtctgtttgattgtttgagacagagtcttgctctgtcacacaggctggagtgcagtggcatgatcttggctccctgcaacctccgcctcctgggttcaagcgattctcccgcctcagccccccaagtagttgggattacaggcgcccaccaccacacccggctaatttttgtatttttagtagagacggggttttgccatgttagtcaggctgatctcgaactcctgacctcaggtgatccacctgccttggcctcccaaagtgctgggattataggcatgagccaccatgcttggcctaagctacctaatttttaaattgctattttaaacttgtatttagaaatggtaacaattttgtcaactatgaatgtttaaatcctttatgttcttcagtcgttatttattattattaatttattcttacatttcagaatggctctcttctgtgtataaacagcagtggtttgctatgctgcgggcagaacaggacagtgaggtggggtaagtatattataccttatcatttttcattaaaaaaatttgctatgaattttttaatgcattcattatgttgaaaaatcattaacagtattgaaaactcaagctgttgaagtaaagatcatataatcactttttattatatttttgcaacattatcagtcttataaatgtctttctggtcaattagatagtataatgcaattatggaaatgtcatttgctttattagtaaaattgaacatgtaatccatatatactttgtttcacttagtatcatatgattttctttcaacatactgaactattatttgaggtaatgctttcataaagcataatttttatatttatgtctaggtaaatctgtttttcttatggtagtattgtcaaattctgattaatgtaataaatagtttttgaagatctttaagtctaaaatgaatttaaaaaccatccaggctgggcacggtggctcacgcctgtaatcccagcactttgggaggctgaggtgggaggatcacttggggtcaagagttcgagaccagcctggccaacatagtgaaaccccgtctctactaaaccctggaagtggaggttgcggtaagccaaaattgctccactgcacttccaagcctgggggataaagtgagactcagtctcaaaaaaacaaaacaaacaaacaaacaaaaaaacaccatctggttacagataccttccccaaaaacatatgactccccccacaaaacattaatcctctttcttcatcttaaaggaaagattattatagtgctttgtagttcacagaacttttatatttgtgatttgatccttctgctagcttcttaatatataggtattgtggagagactgagtgtacagaaagaccttcaaagtttaattttttgccctgatctctttgaactcatttttatatactaaataatttttttaaataatgacctaattataagttttcatcctaacagtaagtgtatgaaagtattacataaattcatgatgattatgtcatttttattatccaggatcctagtttctactttgattataattatatattttttcaaacatattcccagtatatttatccagcataaataatagtaagattgttgaggctgggtgtggtggctcacacctgtaatcccagcactttgggaggccggggtgggtggatcacctgaggtcaggagttcgagacaagcctgaccgagatggagaaaccctgtctctactaaaaatacaaaattagctgggtgtggtagcgcatgcctgtaatcccagctactcaggaggctgaggcaggagaatcgcttgaacccgggaggcggaagttgcagtgagccaagattgcgccattgcactccagcctgggcaacaagagcaaaactccatcccaaaaaaaaaaaagattgttgaaatacaaataataaattgaaatcaaaaagtgagctatttaatggaattgagaactgaagcattttgtagtatatgaagtaacgatgagctatttaatggaattcagaactgaagcattttgtagtgtatgaagtaacttataaatcatcctacttcttctgtatattcaatttttaaattttggatgttctttatttttcatgattttcctcacccatgtccttattgaggtaatacagagtctcatctaagatactgcactagaataagtctttagttttttgccttaagaagtacagtcattttgggggaattggtttcaggacccctgcgtataccaaaatccacacatactctagtcccgcagttagttgaccctgcaaaacccacatatacgaaaagttggctctccatatacacagatttcacatcctacaaatactgcatttttgatctgattttggttgagaaaaatctgtataaatggacccaagcagttcaaacctgttgttcaagggtcaactgtatatgatatatcccctcttaggaaatgttctgttcagcagataccaagcatctgctcactgctgcaggactgctaaagtgaggaagacactatattccctggatgctaggttataatctggtgtcaaatttccctctgggcttctcctcataaaactcttgtctatgttgccaagagggttatctttctaaaacagaaataaaactgtgtcacttctctacttaaatatgtccagggatatttgatgacagttaagggattatagtattgctgttcaagattattgaagctagatggtaagaaaatttggctcatactattttctctgctttcatatgtttgtagtttttcgtaacaaaaagtttaaaagttacagaataaatgcttgggaacttgttacctacaagagcagttgaaactttttagcatgatctgtggggactgtcagcattctatcccagatgtctttagcttcctctcctttcatgttcatctgcactaaatgtgcactaaattcttatgttcatatgctgcagctgcattaaattcctttacattttggttttctgttatgctccagttcctttttatccactatttcttctgcctggaatactcttacccctccatagaattcacccctcacctccaccccacccaacaagcttccactcgggcacaaataatatttactctctaatgatccccctctaatcctaggcaataaatctgtaccttcttcatgtgcttaacatcacaaaccacaaattattaatattattataattaactgtagtataattattatttatgtctagttccctactgaactgagctcttggatatcaaggatatgttttattagtcttatttacacttatttatttattgtatttgtttcattattttattatgtattatatatgctattattgtacccaatttctaggcatttcatgttgtgaatgaatatatgaatgaatgtattatattactgttatcatttggaataatgatgctaattataataccatatttattacaactttagataacagtatttctcttagttgattaaggtttttaaactagggaaccaaataaagacttaactgataaaattttacagccattttctattaatattgattttgcatagttacactatatgaaaaatggtttgcatgtgaaacaagtaatattaagtggtaggtgatatcaagtcacatcttatttacagaaataatagattttagcttattttacttgtagttagacttttacttttttttttttttttttttttggcaaatagaatttttcaggttttttttcctctactctggtttggctgagccctaataaaagtagtccagaagtcagggcaataagtgaaacatagaagatattaaatcttttttatctagcaaaaataatggactaaatttaatcaacactttcttatttttatctgtaccacaaaaacttatttttaaatctggtagcaagattttctgttcttaactcatagttcttttttaattattagttgcatattttctatgaacgttcatattttatgtatatttttaggcctcaagaaatcaataaagaagaactagagggaaacagcatgaggtgtggtagaaagcttgccaaagatggtgaagtaagtatgggttgtgactgttaatattcttatacaaattgtattatcagcacatcctgcacctgtaagtagtaatcatgacacctgtcatacctcagaagagcttgtttgatacactttctgtagcatgatctgctgggaaagtagttacagccaccacactcagtagtgattgattacttggccttgtatgagaatgctgaacttaaattttgagttcagataagacatacaagaagagggtcccttagcaatccagaaattaagataaagaagaaattgtgagggatctgttacatagtcttaaaagtgattctgtgttacagttgtcctaaatcaaagacattcaaatccattgattgttacccacattaggaattaccttttcttggccaggtgcggtggctcacgcctataatcccagcactttggaaggctgagatgggcggatcacttgaggccaggagttcaagaccagcctggccaacatggtgaaaccccatctctactaaaaatacagaagttagccaggcatggtggtgcatgcctgtaaacccagctaccagggaggctgaggcacgagaatcacctgaactcgggaggcagaggttgcagtaagccgagatcatgccactgcactccagcctgggcgacaaagtaagactccatctcaaaaaaaaaaagatattttttcattaccacccaatataaatgtatataagtgaaagaaaagtatttaaaaacaatacttacccctgtgcatccagaaattattttttctatttaatacttttattttatgttatttgttagagacaggctctccctctgtcacccaacctggagtgcagtggcgtgaccacagctcactgcagcctttaactcccaggctcaagcacttctcccatcccagcctcccaaatagctgggattgtaagcatgagccaccatgcccagccttctatttaatatttttttaaaaaaactgattgtggctgggcacggcggctcatgcctgtaattccagcactttgggagactgaggcaggcagatcatgaggtcaggagatcaagaccatcctggctaacatggtgaaaccctgtctctactaaaaatacaaaaattctctgggcgtagtggtgtatgcctgtagtcctagctactcggaaggctgaggcaggagattgcttgaactcgtaaggcagacgttgcagtgagtcaagattgtgacactgcacttcagcctggtgacagagcgagtctccatctcaagaaaaaaaaaaaaaaactgattgtatcttattaaattgattttacaatccactaatgagacatgaactacatttttaaatattcccccctaactaatcataatttttgtttttcaaaaaaaatcaaccttatatagatacctatttggttatttctctcccaaacttttcctcattttgactttatttatttttaatttttaaaagttgattattttacgttcacattgattgactgatggacagtgtctcactgtgtcgcccaggttggagtgcagtggcacaatcatcgctcactgcagcctcaatgctctggactaaaagcaacagtctctggagtagctgagactacagacacgtgtcaccacagccagctaattttatttttttactttttgtagagttgggggtctccctgtgttgcccaggctagtctcgaattagtgggctcaagagatcttcctgccttagcctcccaaagtgctagaattataggcatgagccaccacacccagcctatgtttgcctttgtattatgataaatgttcagagtataaaagaatagttttctttagttctcattcttccttgttgctgctttcagatcttcttgttactttgaagcaaattctcctactataccacctactactcttattgtggccataattcactgagttcactgcctttcttttcttttctttcttttttttttgagacagagtctcactctgttgcccaggctggagtgtagtggcatgatcatgactcactgaagccttgacttcctgggctcaagtgatcctcccacctgagcctcccaagtagctgggactacaagaatgcaccaccacgcctggctaattttttaaaatttttgtagagacgaggtctcactatgttgcccaggctgttctcagactcctgggctcaagtggtcctcctaccttggcctcccaaattgttgagattataggcatgagccaccacgtccagccctcactacctttctttaccactactcttattctcggtcgtgttgatttcaatatctctgttccctgaccttccttcccccatgctcttgtgctccaccctacctcaggcatccattcctgtgagcataccctcaatttttgcattattaattactacaccaccttcaaaatctccatttcaggcatcccgttttcagaccccacctcgtctttctagctcattctctctagcacctggactccaacaattttttaactccattctggatatacaatacattgtttttacaacctttccctatcacctttctgaccacatttctacttcttattttgcttgacttatattttatgttccatcgtaaaattggtcccttgcttatactcttttaacttttctttttcctcattgacatgttaaactcacctggctaaaccccaactcttgtcaagggttgcactccatgcctgcatccagacagatgaatgtgattaaagacaaacaccgtaccccattgggttccacttgaatgtggtaaccatgaacttgaagtaggttagtgctgcatcatgatctgtctgcattttcctagtgaattgatcctcccattagctgaggtaactcataccttctctccttaaaagggcaatgctcccacccttattcttatctgatggccttgctgcctactgcaatgaaaagagaatctgtacatcatcttaccagtagttctgccagtctacctgcacctgtagctatgcgctatgcatttcatcttattagaaaaatgaactgcctacttctatcttagtccattccctctctttgtactggactctatccatgctcacctattcaaaagctttgctccagccaggcacagtggtatgcacctgcaattccagctacttgggaggcttaggtggaaaaattgcttgaacccaggagttagagttcagcctgggcaatataacgagaccctgtctctttaaaaaaaaaaaagctttgcccttacagttatcacctctactagggcagaaactgtatgttatttactgctatgattccattgcttagaggagtgcctggcatataatatgtgctcaataaatatcagttaaatactgaattgcaattcagggtgtcagccaaacacttgaagccctaactacttctctgtatcacactaccttatctgatactctcacattaactattagctgatagaataaacaaactcgtgaaccccatgatgatatttaaataacccagttgtgtgttacttgagttagagtattttatttttatttttatttttatttttttttattcttttttgtatttttagtagagatggggtttcgccatgttggccaggctgtttttgaacctcagacctcaggtgatccacccgcctcggcctcccaaagtgctgggattacaggcgtgagccaccacacccagcccttaagagtatttttaaagcaaggtggattttaatgggctcttaattaccttagtgctctagaaactcttagtgctctaagctatatacccacttagagttgcagtgaaaagccttattattgctgggtgcagtggctcacgcctgtaatcccagcgctttgggaggccgaggcgtgtggatcacaaggtcagcagttcaagaccagcctggccaacatagtgaaaccccgtctctactcaaaatacaaaaaaaaaaggccgggcacagtggcttacactttgtagtcccagcactttgggaggccgaggcgggcggatcacctgaggtcgggagttcgagaccagcctgaccaacatggaaaaaccccgtctctactaaaaatacaaaattagccaggcttggcgcatgcctgtaatcccagctactcaggaggctgaggcaggagaatcgcttgaacccgggaggtggaggttgtggtgagccaagatcatgccattgcactccagcctgggcaactagagcaaacctctgtctcaaaaaaaaaaaaaaaaaaattagccgggcgtggtggcagggacctgtagtcccagctacttgggaggctgaggcaggagaatcgcttgaacccgggaggtggaggttgcagtgagccaagatcatgccactgcactccagcctgagtgacagaatgagactctgtctcaaaaaaaaaaaaaaaaaaaaaaagccttattatttatggtagaattgcagtatggagagataaggaaactgatcatgaagaggaaagtagcttagagaattatgatcattaagggcagcttttctagcttagataaatagttttgggtggtaagccttaagaaaaagtcactgacaaaaagtcgaccacccatgagggaaatacttggaatgagttagagacaaaaagacattttgaattttttattttctacttgctaatatgataaactgaaataagtcttctctcttgtattttttagtactgctggcgttggacaggttttaacttcggcttcgacctacttgtaacttacaccaatcgatacatcattttcaaacgcaatacactgaatcagccatgtagcggatctgtcagtttacagcctcgaaggagcatagcatttaggtaggatgagatttccccaccccactcctcctcactccagagaaaatataagaaataaaaccttgataatttacaccaacattagtagaactttggtaagctacagtatatgtggaagtggtaggaaatgacgaggctccattcctgtgaaatctattgttagtaatcagaatcataggatctagtatgtcagggagaatgaataggctggaatatataccagtagggaatatcagccttgaagtcgttgccttgttgctattcctagcaaataaaagatccagactgttgaaatatgtagcaaggtatgtttccaggaaaacacatattatccttaactttttaaaggatttaatatgttaaattttgcccagtagttgctggcaatctttttctgagaggataccagaagctgacaaattggacagtagcttaatgaacatgatttaaaagtcatatatttatacttaccttacaccaaatacaaaaattaacttaaaatggatcaaagatctaagcataagaactgcaactatgaaactcttggaagaaaacataggggaaaagcttcataacaattgatttggcagtgatttcttccataagacacccaagcacaggcaacaaaagaagcagtagataaaattggacttcatcaaaatcacaaacttgtgtatcagaggacagtgtcaagacagtgaaaaggcaacccatggaatgagagcagatatttgtaacgctacatttgataagacattaatacccagaatatatagaaaactcctacaactctataatttaaaaagaaaactcaactcagctcaaaaatgggccaaagacttccataaacatttctccaaagaagatatataaatggctaataaacacatgaaaagatgttcaacattactaattagggacatacaaaccaaaatcacaatgagctatcacttcacacctattaggatagctattagtaaaaacagaatagaaaaaaaacaacaaaagtaacaggtgttggcaaggatgtggagtatttagaacccttgtgtactgctcgtggccatgtaaaatggcacagccactatggagcatggtatgacacttcctcaaaaaaattaaacagaattaccatatgatccagcagtttctcttctatagaccagaagaattgaaaatagggacttaaacagatatttttgtatacttatgttcataacagcattattcacaatagccaaaaggtggaagcaacccacatgttcactgacagatgctagagaaacaaaatgtggtatatacataaaatagaacattatttagccttgaaaaggaagcaaattctcatacatgctaaacatggatgaacctggaagacatgccaagtgaaataagccactcacaaagcacaaatattgtaagattccactcatacgaagtacctagagtagacaaattcataggtacagaggatacactggtggttgccagggcctgagggaagggaaagtggggagttagtgtttaatgggtaaggagcttcagcgagggaaaattaaaatgttctagagatgggtgcagaacaatgtggaaatatatttaatgccacagaactatatactttaaaatggttaaaatgataaatgttacgtatattttaccacaataaaaacatttataaatgatttctcttggccagatatgtataatagcacaggcttgtcactgaatgcagtcagattacagtttgaaaagacttcctaaaagtcttttatcaaataaaaaacagaggaaaaagtaaatatgaaagtaaggaagagcttgtttaatctgtggtttaaaaatcttgtgtttattttttattttttttttaatcctagattacgtttggcttcttttgatagtagtggaaaactaatatgtagtagaacaactggctatcaaatacttacacttgaaaaggatcaggtatgttcgattatcttctggtatgtcatcataatatttgtcttttgaatcctcttttgaaaattcttaagtagaattaacattaaagtgatggcattttgacctaaaagttggtttaaaagtcttttgaaggtaaagatgaaagtaccacattcacttatgcataattgaccccatcccaatggaagcataattaggagaaaaaaagaaaacactgtttgaggggcagggaaacactgattataaggaaataattgtttatcctgaatatcagcagcactaaaattcattcctaaaattttaggaatcttaagtgctttatccattgtgtacatagtgcatttatttatacattcacagcaggcatcttaaagacaatcctgtatgtctccatagctccgaatatcataagagcattattctctagcccattaggttcgtaagatggcaaactctgcaatgttccccagattatctccaaagccatttatttattcatacatcacacacatggagaagtttcaaagtgtcatgatgagaaagtagaccatttttaaaagtaaaactgaaagctgttaaaatattgaggaactttatttctattaaaagtaatcatcattccaaagggcataatgttttattaaaggattcaaagcctgttatagtttacataaattatgagaagttagtagttttcctcagactgaagagactatcatagaacatccttagcattgcaagtaaccccggaagtgatcattgtaacctcacatgccctatatgagaacttcttttaacagcattcttacagagggggtcatccacccattgttgaaactctaactgacccccatcttacatgaaaggtaatatgtaggaatgtccatttcaaggcaggtatataatgagaaagtccaaatctgcctccatcagaactctctgttggtccttcttgtaacctctgcagctgaacagacaatgactatctttatcttctacctgaaacttcatgaaaaatactgtcatggctcaaacccagccagagacctaaaaaagcaccaggccaagataatagttgtattcccatgttccttcagcaaacatttgtgtccccaccatgtgcttggttctcagctagaagtagaagaaataaagacaggcttgtgttaatatagcctagtgtaagtagcatgatagaattagctcagagtgtgcaaccttgagggagaagactctgacctgtaactgagcagctgccgtggttgggggtggttattggaggaggaggagaaagaaagacagctcagggaaaacatcctctcctggaaaagtgttaaagtgaatgcatacctgaaccaagcctcaaatggtgagtaagatttccggaagcaagggaatacatgggtcatattcaaggaactgaaagatggttggaagagttcagtataactagagccagggcatgagggctgtggatggagtttgggagatttactttgggagttgtctccgtgttttatataggttatagatgttgtcgaaaaaatagaaaatatgagtcagctgaaacaacaatcatacatgtaccactcagatacattgctgagtttttccttcacctgtatcatttttgcaaaattggatcacagtaggttagctattttgtaacctgcttttttttttaatggtgaaaaacatatatatttagaatttgccagctggattcaacttagatgatcccaattttttggcagcctctaaaagcagcatgctcaggagccagctgaacatgggctttcttctctccatcagccctgatcacggtgttgatcttggccacattggtgtcatagagctcctccacagcctgtttgatcttatgctttttgacctcgacatccacaatgaacacaagtgcattgttgtcctctgtcttcttcatggccaagtcagtggcctgggagaacttgttggtcgcatagtggtcaggcctgggggagaggcaaaatggggtcacctggcctgggcccagtagaagaaaggcttggtcctctttcagagcccaaggccaggtgagcctaggtgcatcagacagtgaggtagtaattgtaacctttttttttttttttcactttgttgtacatagctttttttggtcaataaatatatattcacagcatcatttttatgaacggcataatattagttgttttggctataccgtaacttagataattcctctttattggataaagttgtttctcattttttttcattactataggaaatatacatatatctttgtccatttttatgatatttttaaagcataaattccaagaagtagaattcttgttgcatggtgcatacaattttctaatggccaaattgccctccaaagctactgtccaatttatacttccccctggcagcagtacaggagagtatacccaatattgtatcttattctttttcatctctatcccagcgtagtaaatgtgaaaacaaatatttgttttaattttcatttctttttgtttgtttgttttgagacagagtcttgctctgtcgcccaggctggagtgcactaatttttagtagagacaggatttcaccatgttagccaggctggtcttgaacttctggcctcaagtaatccacctgccttggcctcccaaagtgctgggattacaggtgtgagccaccgcgcctggcccttaattttcaattttcatttctttggttactgtattgttgggtttttttatgcttattgaacgtatcatctcatgtaaactgacagcttatattgttcctgtttaattttttattaaaatttcatttttttcttgctaatttttaacagcttttatatattaaaaatacatttgtgatactctatagtttttacttttttttttttttccgagacaggttgtcactctgtcactcaggctggagtgcaatggtacaatcttggctcactgcagcttccacctcctgggcccaacctttccacgcacctcagcctcacaagtagctgagactacaggctcgcaccaccatgcccagctaacttttttgtatttttttatagagacgaggttttgccacgttgcctgggcttgtctggaattcctaggctcaagtgatccacctgcctccgcctcccaaagtgctgggattacaggcatgagccaccaggcccaaacagtttttacatttttgtcatttgtcttttcaaccttcaaaacaatctatctttttcttttatgatttcttttttttggtgttatccttaggcctccatcttactaggattatataaatagtcatctatatattcttctgttctttttatggcttaattttttactttggagtatttgacgatatatctgaaatgtactggatgtatcaatgtatttgaaatgccttattgtacatgaaatacttataaacttgctttcatttctggactttttgttttattgatttctttgttatgaagacaaggcattgttttaattaggctaactttaaaatgcattttaatatttagttacgcaaaaccaccttcatttttctttttttcaaaaatctctcagttctttgtgcatgattattctcctgtatgggatgtaggatcattttatcaagtttccttgcaaaaattcctatggggattttaatttatatgattaaatatgtagagtagtttgtggaccattgatgtcttcctttctggaatatggtattttctacatttacgtaggtcttcccttatgtctgtctctaaaatttgtagtttttcccatattgttcctgtgtatttcctggaagtataacacttagtattttacatttctttttttttttttgaaacggagtcttgttctgtcgccaggctggaatgcagtggcgtgatctcagctcactgcaacctccacctcccgggttcaagcgattcccctgcctcagcctcccaagtagctgggattataggcacatgccaccacgcccagcttttttgtattttagtagagacagggtttcactctgttggccaagatggtctcgatctcctgacctcgtgatccgcccacctcaggctcccaaagtgctggggttacaggtgtaagccaccgcacccagccagtattttacatttcagttgctaatatgaaatgaatcatttgttctaatagtttttgataatgtaagaaagttagtgatttttgtatatttattttgtaactgtccatcttataagaccatgctaaatggattttcactatagaaggttccgtcagacagcaatgtgtaggaaggattaaagatatgataatggcaataaaacaatttatgattatatagctataattcagattaaaagtgataagaaccttaaagaatgtagcaatgaagaggaaaatattgatgggttctggaaataaagtggtgcaattgagaatttgattcttaattgtgtgtgtgcatgaggaaatgtcagatggttttctgatttgagcaatttaatttacagtagtggttttacctgagatttgaattataggaaggaaaatgaacatgacatagtgttggtgatggtgaagagatgatgaattctgtttagggcatgtttaatttgagagcatcaaggtgaaaatttgataggctggtgaataatggatttggagtttacaagtaatgcctgaactagaaataataattggatgagataatgtacaggaaatgtgtagagaatatgacaggatagaaccctagggaccactggtatttaagagatggacaaaaaaggtaacctggtgagacattgaaaagctgggatggagaatcaaagccaaattgcaggcttggcgtggtagctcatgcctgtaatcccagcactttgggagaccaaggccagaggattgcttgagaccaggagttcaagaccagccctggcaacttagcaaaaccctatctatacaaaaaattgaaaaattagccgggcgtggtggcatgtgcctgtggtaccacctacttggaagctgaggcaggaagatcacttgagcctgggaggctgaggctgcaatgagccatgatcatgccaccgcactccagcctgggtgacagagtcagaccctgtctcaaaacaaaaacagacagacaaaaaacactaccaacaacaacaaatacccagaaatttatttaattgtctggaagtagaaatggggacctaggaagttgctgctgctctgctgctgctatatgtgggctccacagattccatccacaatggaataaggaaaatagaactttgctataaaggtacttcaatgcaaatgtagatgcagattgaacctttaggtgaaacaacagatttgatgaagctcggatcgacctatcctgtttgggaatggagagtggggattaatacaatttaatattcaaaaattggtgtatccattcagccaagtgatatccacgtgccttccttctttctccagagttggccctttgacctacccttccctgcctcaatcttaactgtattcaaatactagaaggctaatcttcctcagagccttttagttatggaacagaatcttgatttttatcatcagatatacatatcatcaaaacatttgtcctcaacaaatttggtaaatgtgccttcacccagattattgatataaattttgactagttcaggatgtctcaagcatctgaagaccaaccatgctttggcataattcctctctggtgacacttgttagcacagtctaggtgatggcctcccctgattttgttcactgatgtctttttataataccactttccctcgtacagagagagagattgtgtgtttgtgtgtgtgtgtgtgtgtgtgtgtgtgagacatttgtactctctaccttctttattcaaatttatcttcttgttccctcaacacagaagctgtgtctagtgagtctgcttcagtcacacagatattctagttttagttcctcttcatgcaggaatacatgtctcagtaaaaaattaaaactttggatttaaacagtgtttaatagtatcttatccaaaataaataaagtgtaactaatgcatactattgcagagagcatatcccaggcatttaaaacgtaggaattctcattttagtgtttcttcttttactctgaggattgattctatttaccaaatgcttctagtaaaggatatatgaggttccaaacagagatctgtagcatcagggatgttatatttgtgtagtgtcagctcctgtctctgggagttctgagcattcttgtgtgtgttgatgtaactgaacctgaaattgcttttccatgataatgtattttatgtttcaggagacaaattacatgtttgtcatagggacagtgggaaatgtcaatagtaggaaccctgctttttgatgatgataatgactcccgaccttcatctgggtgatttgctgtacccaacggccatcagtaattgaagccaagtagccaggcacagtggcacctgcctgtagtcccagctactcaggaggctgaggcgggaggatgaggcaggaagatctcttgagcccaggagttcaaggccagcttgggcaatatagaaagaccctatctcatttttaaaaataattaattaattttgtaaaaggaaataaatttttttaaaaattgaagcccagtgagaagtttatgtatttctagacattgtatctgttgacaaaatatgtaagtatttgatagaaatttttgcaataatgaaaataactaccattattgagtacttaatagatagctggctttgcaaaaccccctgtgtattatctcttgtaatcctcctttaagtcaggtactcttactgtccccatcttacagtgaggaagctgcatttgacaaggtcacacagctaatgggtgggagtttggagagtggagttgtggatctcagactcaggacactatctcctttggttcactcagttcaacagtttggttttttgtttttattttatctaattgtcattgaatctacaaatctgtcttataggaacaagtggtgatgaacttggacagcaggcttctgatcttccctttatatatctgctgtaacttcttgtatatatcaccagaaaaaaagaattgaaaataatcgtcacccagaaaatccagaaaactgaagatttcatcagttggaaacagtagcactttgaaaactttttaggccagctttaatttaatggccctactgatattcacatcgaaggtgactaacaatgacaaaggccttatgaactgtacagacaatacagaagattattcttatcctcattgcatttctatgcatatgcgtaagaacattttaaagccaagaaaatatctgtcaaaccatttctgttagaacgatgtcaattcatgcttttaatttagcatcaatagaaaattgctgtaggtaaatctcacatttatctgcaacaaaatatagatttaatttttagcttaaactttgtttctaccttatgttagtggacctcagttatccatctgtaaatttctttttatttggctaaaataatctaaaagaataatttggttggccaattagaaatgcctttttcagttggtgtattgaaagctttcctttaacattttcacctgctcattgtgattcctccttttagtctaatatctttccaggtcatacttgtttttaatcattaaatattttcttcctggttttggagactaagctgataaactttttttaaaactt

SEQ ID NO: 38375 - DNA, 60026 bp, Homo sapiens
cagaccacttccacatgcagtcggagtctctgatcgggcccctgatgcagaccatctcccaccagcactggaaggtccgtgtggccgccattgaagccacaggcgcagtgatccattttggcaacgggaagtccgtggacgacgtgctttcccattttgctcagcgactgtttgatgacgtcccgcaggtaactggtgtttctcctggacagtctgttcctctctccaacacaggcgggctgacgtgctgtttttaactaactcacttgttcttttttcagagtgctgtatgcaccaaatgtcctttcattattcctagtcacaggacgttcctgttcacatcttggaaaaactagaagagagctgaactgttttaatgtttgatgttatgaattccaaggatgttagaaaggatgacttgtgtagttattgtctcttaggcacagtgtgcacttcagcagttgcagaaggttccttagtgctcccatccatcaagacgcactttcccgaaaagccaccatggttggtggacctggactgggagaagagtggagtcggggttggtttgttggggataattatgtcgttgggctttggaacccaccaagagacgggcaggcaggcaggcaggagtcctacagatggggctgagtgttggctttactgctggcagaatctggcctggagggcatgtcttggatctgaggccccagtgacttgctaaaatgctacacactgtggccaccggggaagctgagtgacctctgatctttctgtctctgagttacctgtcatcgtagtcagacatgtgatcttttgtgtctggcctcttcactgtgcatggttccaggtttcagccttgaagaggtaggtttcctgatgagaaatggcttgaaggtggtgagttgaagagtcactcggggtattctggggccaggatggaagccctgactcgctccctcgtctgtgctgctggggtccacccgtagggccggctccaggtgtgacatagcacctgctcaggacacccctgctttgcctccatggccaggcttcattctccggctctctccctccagcagcagagtggctgcctaggggctgtgcgcagagacacagggggaccctttcccaccaggagcctttgttcacccccttggtctcatcaggccagcggaagttgagtcaccatgtacgctggccggcccctcctggagctggcgtgggttcggcaccaggcagcacagagggcccctgaggacatcaggctctgcccagtggggagaaagtgggcagagtgcggggtcagtgtccatgctgcccggcacttgcagcaggcacttctggcactggctaaatatttgggctgcggagggcagttcaaggggccagggcaagaacagagcccagcaagaagtgcaggcggccggctggtttttctctcccaccttccttaagcctgaggcagagcatggcccacaaggaaagtggagtctgtgtcatgggccaagtcttactcctcaaaacagtgtgatgactctgtatggagagctctgtgtgaatactgaagctccatagctgatagctgtcggtgtaagcctactgtcactgtctaaaaataaccatcactgtctaaaaataccgtcactgtctaaaaataccatcactgtatcgatagctgtctgtaaatactggaactctgtggagcacgctctgtaaatactggaactctattgctagctgtaaacggtgtaactcagtataactataccgtaactctaaaaataccataactatgtgtcgacagctgcctataaatgctataactgtattggtagctatgtataagcagcctactctgtatcaatagctgtctgttagaaagctgacatcacattgttgatctaaagcaagcttgtccaacctgcggcccgtgggccacatgcagcccgggacggctttgaatgctgcccaacaccaattcataaactttcttaaaatgttacgagattgtttttgtgatttttttttttcttttagctcgtcagctatcattagtgttagtgttattttatgtgtggcccaagacaattcttccagcatggcccgtttcttcccaatggggtttgcgtcctattagagaccctgcacggcccttcacgtgagtttcgtgtggagtcacggtgctgccccttttactctgatcagccctgcgaccccgtcctggagctccatgtgggctccttgcagacacctccaccccctcaacaacccagggactggtgccctgggaccccatcctctctgcacagaaggtcctgactgccttctgactcgtaggaaaccttccagcagcctgctagactcggcttaaatcactgaacttcactggaagggcctggaaataacttcatctcctccttacaaggctcagaggcctcagagctcactcaggtagcacagccaggtgagcctcagagcaaggtcaggacacaggcggtctagccgccctggagccttaggccccgggatggtgtctgaagttgtggaaagggggtgtcccagtgcggcaggggctaatgcatctccccacgctcacatgactgcagctccgagcccaggacactgaccacacccagaaccccggcgaggcaggcaggacggacgtatggccgtgcagttgtgaagcaggccttgaacaaactgccctgtgccgccctcaggtggatgactcatggacttcgccctgcaggggtgccctggttgtcgccaggcctgcagtcggcagctgctcagctttgctgcagttttcctgctcgatgtgtgctgctggtgaggccaccaggcctgttcttgtcaagagagaccttccgggaacaacagatgttacaggagagactggggatgcatggacagcttttcagagatgagtgtttgtcacgttcctgccaagtacctgtttgccatttgtatgccttcttttgagaaatgtctattcagatctgtccatttttaaatcgcgttattagatttttttctattgagtttgagctccttatggattctggttgtcagtcccttgtcagatgggtatttgtgcagctgtttgctcccatcctgtgggttgtctcctcactattgattgttttatttgctgtgcagaagctttttaacttgatgtgatcccatttgcccaggccatgtcccagagagtttccccaatgttttcttttagtggtttcatagtttgaggtcttagattgaggtctttaatctattttgatttgatttttgtacatggtgagagataggggtccagtttcatttttctgcatatggagttccagttttcccagcaccatttattgaagaaactgtcctctccccaagatatgtccttggcacctttgtcaaaataagttcactgtaaatgtatggatttaatttctggcttctctattctgttccattggtctgtgtgtctgtttttatgccagtgccaagctgttctggtcgctgtagctctgtagtataaattgaagtcaggtaatgtgatccctccagttttttgtttgtttttgtcttgttttgttttttgctcaggatggctttggctattcaacgtctttcgaggttccatataaatttaggattattttttctatttctgtgaagaatgtcattggtattttgatagggattgcgttgagtctgtaaattgctttgggtagtatggacattttgggtagtatggacaatattgattcttccagtccatggagtatgttaccattttttgtgtgtgtcctcttcagttttctcatgtcagtggtttatagttttctttcttttttttgagacagtctcgctctgtcatccagggtggagtgcagtggtgcgatctctgcttactgcaagctccgcctcccaggttcacgccattctccttcctcagcctcccgagtagctgggactacaggcgcctgccaccgcacctggctaattttttgtgtttttagtagagacagtttcaccatgttagccaggatggtctcaatctcctgacttcgtgatccgactgcctcagcctcccaaagtgctgggattacaggtgtgagccactgcgcctggccttatagttttcattgtagagatctttcacttctttggttaagttaattcctaggtatcttattttgtttgtagctattgtaaatggaattactttcttgatttctttttcagatttgttaactgttggcatgtagaaatgctactggggcttttttggtgattttgtatcctgcaactttactgaatttgtttatctgttctaataggttttttgtggaatctttaggtttttccaaatgtaagattatatcatctgcaaacaagaataattatcttccttttcaatttggattccctttatttttcttgtctaattgttctagctagagcttccagtactgtgttaactaacagtggtgaaagcgagcatccttgtcttgctccagatttagaagaaaggctttcaatttttccccattcagtgtggtactagctgtgagtcttgtatatggcttttattgtactgaggtgtgttccttctatacccagttttttgaagatttttatcatgtagggatgttgaattttatcaatacttttcagcatcacttgaaataatcacgtagttcttgtccttcattctgccgatatgatgtgtcacattgatggatttgtgtatgttgagccatccttgcattcctggaataaatctcacttggtcatgacaaatgatctttctcatgtgctgttgaaacagtggaaactttgcgtcagtgttcatcagggatattgtcctgtagttttccttttcgattgcatctggctggttctggtatcagggtagtactggcctcataaattaagtttggaggtattccttcctcttctagttcttggaatagtttgagtaggagtgacattagttctttaaacgtttgataacatttggcagtgaaatattgcgacccgggcttttctttgctcagtggcttttcattgcggcttcaatatcattacttgttactggtctgttcaaggtttggatttatgatttaatctgtgtaggtcatatgtgtctaggaatttatccatttcttctaggttttccaatttattggcatatagttgctcacagtatagttgctcacagtgtagctgctcacggtgttgctcacagtgtcgttgctcatattgtagttgctcatattgttgctcatagtgttgttcttcatggtatagctgctcacagtgtcgctgctcacgatgtcattgctcacggtgtagttcatggtgtagctgctcacggtgtagctgctcacagtgtcgttgctcatattgtagttgctcatactgttgctcatggtgttcttcatggtgtagctgctcacagtgtcgccactcacgatgtcattgctcacggtgtagttcatggtgtagctgctcatggtgtagctgctcacggtgtagctgctcacggtgtcattgctcatattgtagttgctcataccgttgctcgtggtgttgttcttcatggtgtagctgctcacagtgtcgccgctcacgatgtcattgctcacggtgtagttcatggtgtagctgctcacggtgtagctgctcatggtgtcgttgctcatattgtagttgctcatattgctcatggtgttgttcttcatggtgtagctgcttacaacgtcgctgctcacagtgtagttgttcatggtgtagctgctcccggtgtagctgctcatggtgtcgttgctcatattgtagttgctcatattgttgctcacggttttcttcatggtgtagctgctcacagtgtcgctgctcacgatgtcattgctcacagtgtagttgctcacagtctctaatgatgctttgaatttctgtagtatcagttgtttgtaatgtcctcttcgatctctgattttatttacttgggtcttctctttttcttagtctggttaaaggtgtgttgattttgcttgtccaaaaatctaactgttcattttgttggtcttttttattttttttaatttcaatttcatttatttctgctcttatttcttgtcttctactaattttgggtttggtttgctcttgctttcctagttctttacgatgcagtgttaggttgctgtttgaagttatctgctctttgaatgtaggtgctaattgctatacacttgcctcttagtgctgcttttgctgtttttgcatattgtgtttccattttcatttaagaatttttaaaatttccttcttaatttcttcattgacccaccggtcattcaggagcatattatttaatttccatgtatttgtatagtttccaaagttcttgttattaatttctagtttcatgttttaaggcttgtttcgtggcctaacatatggtctgtccttgaaaatgatctgtgtgctgaggagaagaatgtgtattctgtagctcttggatgcaatgttctataaatacctatgaggtccattagatctatagtacagattaagtctgatgtttctttgttgattttctctctggatgatttgtccagtactggaagtggggcattgaagcctctagctgttactgtgttggagtctgtctctctctttagctctagtaatatttggtttatatatctggatactccagtgttgggtgcatatatatttaaagttgttatatcctcttgctgagttgacccctttatcattatatgatgacctttgtctcttagtatagttttcgtcttgaaatctgttttgtcttaagtgtagctattcctgctctttcttgctttccatttgtatggaatatcttttttcgcatccctttattttcagcctacgtgtgcctttttagtgacgtgtatttcttgtaggcaacagattgctgggtcctgtttttctttacccattcagccgctctgtcttttgaatggagagtttagtctggttacgttcaatgttgttattgataagtaaggacttactcctgccgttttgttgttttctggttgtttcgtggtctgctcttccttccttcttgccttcttgttttcctttttatgaagatgattttctctggcggtatgttttaatttcttttttgtgtgtgtgtgtgtatctgttgtggcgttttttatttgaagttaccatgaggcttgcaaataacataacccattattttaaactgatagctgaacactgattccaaaaacaagcaagccaagaaaaaaatgaataaaaactctacaccttaattttatgccctcagctttttaactttttgttgtttttacttatatctttgtcttgaaaagtcattgtagttatttttatttttatttatttatttatttttattgttttatttttgagatggagtctcactctgtcacccaggctggagtgcaatggcgccatctcagctcactgcaacctatgcctcccaggttcaagcgattctcctgcctcagcctcccgagtagctgggactacaggcacccaccaccacacccagctaatttttgtatttttagtagagacaaggtttcatcatgttggccaggcttgtcttgaactcctgagctcaggtgatctgcccacctcagcctcccaaagtgctgggattacaggtgtgagccactgcacccaaccagttagttatttttcataggctcatcttttagtctttctagtcaagatgtgagtagtttacacatcacagttacagtgttacaacattgtgttgttctgtgtgcttactgttaccactgagttttatccttttagatgatttcttattgctcctcagcatccttatttttcagattgaagaaccctctttaacatttcctgtaggacaggtctgatgttgatgaaattcctcagcttttgtttgtctgggaaagtctgtctccttcatgtttgaaggatttttcactggatacactagggtaaaagtttactttccttcagcactttaaatatgccaagccactgtctcctgcccagtgaggtctcctctgagaagtcgttgccaggcgtactggagctgcgttgtacgtgatttgttgttttttctcttgctgcttttagaaccctttcttcatctttgatctttgggagtttgattgttaaatgtcttgaggtagttttattgggttaaatctggttggtgttctgtagccttcttgtacttcagtgctggtatctttttctaggtttggaaaattctttgatattatccctttgagtaaactttctaccccgatttctctctacctgctcttgaaggccaggaactcttagatttgcccctttgaggctattttccagatgctgtacatgtgcttcattctttctattcttttttcttttgtcttctctgtgtattttcaaatagcccgtcttcaagctgctcactaattctttcttccacatagtcagttctgctgttgagaggctccaatgcattcttcagtatgctaattccttttttctacgccagaatttctgcttgatgctttttaattatttcaatatctgttaatttctctgataggattctgaattctttctccatgttatcttggattttgctgggcttcctcaaatagctattttgagttttctgtctgaaaggtcacctatccctgtcaccccaggattggtcaccggagccttatttagttcacttggtgaggtcatgttttcctggatgctcctgatgcttgtggctgttggtcgatcttgctaggtatttactgtcatctttgcagtctgggcttgtttgtacccatctgtcttgggaaggcttctaatccatttattttgctttttagaaaaaaaaaattgaaaaacgtcctgcttttttaaactcttatatggcagttcggtgttcagtgctgtttttgaactaaaagaaaagggataattcgtctcatgctaattggaatttgcaggtttcttatgatactaagtagagactgatagaaaaggtggcagtccgtgagactcaggagcagccccaaatcccggccctagctgtccttgctatcaggtgagatgtttgaagctcctttctgcaaaagaagcctatctgtgggttccgacagacaggtggccgtcctgggtggggccccgcagagaccctggcacacagtgcaggaggtcagggaggagaaagcagcgaggccaaacccagcgagttcagactgctccctggctgccggcctggggcagagtgtgctcaggccttgtggccctggacgcctgcccatctcccggagagggccccatcactgtacacctgtttgggctgggggctggctgcagtctggcttgtctcagccacgccctctgccccatcactgtatacctgtttgggctgggggctggctgcagtctggcttgtctcagccacgccctctgcctgacaggctttgcagcatctcagcacatggcactgggtgagcttggagtttgccgctcacctggattagcgtcgtggcaggtgcggccgtggcaggtgtcgactgcattaaaccctgggctgtctctgctcgagacctgccggcgccatgggtgaagacgacagtgacagtttgttctgtggggactctctagccaggtggtggaatggccgtggagctgatttgggtttctcttagttgttatctgggcatttgtatttgtggttgctagtaaggccctgtgtcagttaatgaccccggcaaacgcgccacacattcctgtgtcccctcgcgtgcttccctgctgctcgcacgccgagagtcgcctgtgcgcaccgcacgggcagcgggagtcaggcgcaacgggcctctccttgtgtgaacttgccctcccctcacgggaccttagtgacgagccctgtcagtcattctttcccatcttccaggtggcaatgaacttcggagcagtcaggccagggcccgggtcccaggccggcaggggcggatcctaggtgcgtctgcttggctctgggccttgttggagccggggcggagcagcccctcctccgagtcccagcgagtgaccacgccatgggcacagctgctgctcgggtcccctgcacctacgactggctgtgagcgctattgctaatggtgcatggctgggcagagacgcttcatccaaagtgtcaggagggatgaggctcctgctccccacggcccagccagggactgatggcaccacggagtcggcccctggcctcacaggggacagctctgtagctcgttcacaccccagagctcccaggatccgtctgcggctggcttcagccccaccgcttcctcacctggcttcttcctggccgttcccgcttcccttaaggagtgttggtgctggtccccgtctcaggcattgccctttgggagcttggctagagcacctggtgtgtgtgaagctggtttcttccgcctgcataggcaaggtaggcagaggccctcgtgccccctcttcagacacccagcagcagaactggggaccctactggtttcctccagagtccctgggctctgggaccagacgcctttgaggtatggccacggtgcaccacacttgctgtagccacggctcaccaagcacccagggtgagacaggcccagcccggccaggaggttttcatgcagaagactttgaacacgctgcacggctcaggtagcagctgggagcctgctctcgccaacaggaccaggccggggcacggggtatgtgtgtgtgagcctgcaggacagcagcattcctctccggcccagccaggagggactggcggagctggccgggacccaggcttggtggcgcccaggaccccggccacgcgcctctgtcttggggatggcatctaggcggtggtaggtggcccaggacctggccgtgcctctgcctcaggcagcgtccgtatggcagcactcagagccgcaccgtggcgtcagccccggcatcccctttgcctacacgaatccttatcccttcctctcatgcgcaggtccggcgggcggtggcctccgtggtgggcggctggctgctgtgtctgcgtgaccgttactccttcttccacaagctcatccctctgctgctcagtagcctcaacgacgaggtgcctgaggtcaggtacgtgggcaggcggccgcgggccttgtcttcctaaacggtcatgtgtagcagtggtggtttctctttgctcccagtctctcacagaaacctgctggtgtcccttcgtccctgtgctccgaagggatgtgccgtacagaagtcgtctcgttttgtaaatggcatttcccatctttttaacattggactgagtatatcgacagagatcagacggccccctttgtgtactgtcagtagagtgctcacaagatgaagtggaatttctggtccaccttttcgggggttggggagcttcccgctctcacgcaatggggtctttgggtgacccgtgtcctggcgcagccctgcggcctcccctgcgtgccctgccctgagccactgttgtctgtctgttgtgccgcaggcagctggctgccagcctctgggaggacgttggcctgcagtggcagaaggagaatgaggaggacctgaaggacaagctggactttgcccctcccaccccaccccattaccctccacatggtgagtgaccgcggcagaggggagcgccaggaggcgagcccttgttgggtgggaaaggggcttctgagcctgaaggaagcttcagctcttgcagttctgagcccaggcggccgcgtcggaaaggtgcaggcgtctccccactgggctggggctcctgcatcctgggcagagcacgtctctcctcagcatctggagagcccccatgtgccttgcagtgacctctcccctcctctggccagctttattttaaaaaggctgtgggcttctgaaagtgtccagcgcactgccagatggtgtccgcccccctcccttggctgtgcacacaagggtgcattgaactctgggttcttgggcagctctgctggtggttggggggtgttggaaacagtgggatgaggggcttatcatttcaccaagacagagctcagcacgagggccacgggtgaggtgaggtcttcttcatggttccacatgatttccaacctgggaacagggtctcctgctgcgtggcctccccgcccttcccacatttgctccctggccatgttgcaggcacccatgtgcatctctccgcagagcccagcaggtctggctgagtctgagtggaggctcccaggtccagccccaacacatttgctctgccacgccgccggcccaccttgggcttcatctgtttagaaaccgccctcctctcgcggggctgagtgtcttccacttgcacgcggtcaagtgctttcatcacttgagtctatctgcggggcatcttcttaaaagtaaataatagatacgcactgacgaggacaaaaagtaggtgaagcgcagcccacatcagatgcccagcccaaatcagatgcccagctcaaatcagacgcccagctcaaatcacatgcccagctcaaatcagacgcccagctcaaatcaatcagatgcccagcccaaatcagacgcccagctcaaatcacatgcccagctcaaatcaatcatgcccagctcaaatcacatgcccagctcaaatcaatcatgcccagctcaaatcaatcatgcccagctcaaatcagatgcccagctcaaatcaatcagatgcccagcccaaatcagacgcccagctcaaatcaatcagatgcccagcccaaattagacgcccagctcaaatcacatgcccagctcaaatcaatcatgcccagctcaaatcacatgcccagctcaaatcaatcatgcccagctcaaatcacatgcccagctcaaatcaatcatgcccagctcaaatcacatgcccagctcaaatcaatcatgcccagctcaaatcaatcatgcccagctcaaatcagatgcccagctcaaatcaatcagatgcccagcccaaatcagacgcccagctcaaatcacatgcccagctcaaatcaatcatgcccagctcaaatcacatgccccgctcaaatcaatcatgcccagctcaaatcagatgcccagctcaaatcaatcatgtccagctcaaatcaatcattcccagctcaaatcagatgcacagcccaaatcagatgccctgagagatttgcagtctcaacttacttcccatgtcacctccctggcctagttgaggcgctgaagtagcccggggtcaggtcctggagggaaatgtattccgtcaaatacagcattaaagtagcttcttggccgggcacagtagctcacgcctgtatcccaactacacggggggccagggtgggaggatcacctgagcccaggagttggagaccaacctgggcaacacagcaagactcctactttacaaatattttaacaaaaacaaaacaaattcgctgggcgtggtggtgcatgcctgtatcccagctgctccggaggctgaggtgggaggatcgcttgggtccaggaagttgaggctgcggtgagctatgaccacacccctgcactccagcctgggtgacagagtgagaccccgtttaaaacaaacaaacaaaaaacagtttctcatgtctggtattgatgtttggtgccctgttaaatccacgcctacagagccgtggctcctcccgagcctgtgaatcacagggttgcttttcctcccggtcggcattctccaccttgcagccccaccccacgctgcacagttgctgtacagggaaagcaagcacacatgtttggaaaaggcacagaaattagttgcaagcaaggtttgttctgatggagtgaagccagtgagaacgctcgatctttttttttttttttttttgagacagagtttcactcctgttgcccaggctggagtgcaatgactcagtctcggctcactgcaacctccaacttccaggttcaagcgattctcctgcgtcagcctcccaagtagctgggattacaggcactcaccaccacgcccagctaattttgtatttttagtttatatttatttatttatttttgtttcaataggtttttggtgaacaggtggtatttggttacataaataagttctttttttatttttttattatttattatttatttttattttattttattattattatactttaagttttagggtacatgtgcacaatgtgcaggttagttacatatgtatacatgtgccatgctggtgtgctgcacccattaactcgtcatttagcattaggtatatctcctaatgctatccctcccccctcacctcaccccacaacagttctcagagtgtgatgttccccttcctgtgtccatgtgttctcattgttcaattctcacctatgagtgagaatatgcggcgtttggttttttgttcttgcgatagtttactgagaatgatgattttgaatttcatccatgtccctacaaaggacatgaactcatcattttttatggctgcatagtattccatggtgtatatgtaccacgttttcttaatccagtctatcattgttggacatttgggttggttccaagtctttgctattgtgaatagagctgcaataaacatacatgtgcctgtgtctttatagcagcatgatttatagtcctttgggtatatacccagtaatgggatggctgggtcaaatggtatgtgggcgaaggacatgaacagacacttctcaaaagaagacatttatgcagccaaaaaacacatgaaaaaatgctcatgatcactggccatcagagaaatgcaaatcaaaaccacagtgagataccatctcacaccagttagaatggcaatcattaaaaagtcaggaaacaacaagtgctggagaggatgtggagaaataggaacacttttacactgttggtgggactgtaaactagttcaaccattgtggaagtcagtgtggcgattcctcagggatctagaactaattttgtatttttaatagagacggggtttcgccatgttggtcagggtggtctcgaactccagacctcaggtgatccgcctgcctcagcctcccaaagtgctggtattacagaggtgagccaccacgcctggaccactcaatctgttttaaaatgtggaacttagacacgaggccacttacgaactcactgttgaactcacactcttgtctctgcatcagtgatgggagtggaatcccacgcgtgctgtggtgctctgtcagtgcctctccctccagccgcctgtggtgggcttctgcgttggtcggacctttaagctaagctgtgggttgtttgctcctggtgatttcagctgggctctcctcaccaatgaggaaatgctgctccttagagagggtccagcctgtctgcctaattcatgctacacggagcccaagctgcatggcaaatcgttctccacgtgctcactgagaaaccagtggaagacccttcaggtgtcagtggggcaggaatggcagtccccaagacccaggagggtccagtccttcccgctgtgcaccggagagggaggcggggggtcggggggactgtttctggaaggtacgatctatgatccttggaatgcggtaagggagaagacagagcgaggcgcacacgcatacacacacacacacatattcacatgcatgcacatgtacacacacacctgtgcacacatgtacatgcatatcgcacacacgtgcacatatgcacacgtgtgtacatgcatatcgtcacacgcgtacacacatccttgcacatgtgcacacccatatacacatctgcacacgtatacacatacacacctgtgcacacacgtgtacatgtatatcctcacacacgtacacacttatcctcacacacgtgtacacacgtatacacatctgcacacgtgtgtacatgcatatcacacgtacgtgtgtgtgcacatacatgtacacatgtacatacacatcctgccctaccccgccaactgtctggccctgctagtaggttcccggaaggggcttcctccctgtggtggaaacacaggctctttggaggctgcctgatttagaattggttcaaggacttgggaatgttcctgactgataattacaaaaacacagttagttatccgtgccgaggcgtagagagtgtcgttaggcacagaacttttgtttcaagtggagcagagtaaatttagaattgaatgacagtcagtcagtcgcataagcactacgttgtgttagatttttggcattttctcctcaaattacttttctccagtctgtagatttgaattttaaatacgatttctcagatttttttctacagtattttaaatgtcagatcagaagattttttgagtctcttcctcagaagtttgcactggccctgtattgccaagcacacaccctccctgccgtcctgccaccccccgcctgccgtgcccagggtctgtgacgctctccttactgtcttgcccccccccgcccgctgggcccaggctctgtgtcctcactttcccccgcccgtcatgcctagggcctgtgacgccctccttaccgtcctgctgccccccacccaacatgcccagggcctgtgacgccctccttaccgtcctgctgccccccgcccgtcatgcctagggcctgtgacgccctccttaccgtcctgctgccccccacccaacatgcccagggtttgtgacgccctccttaccgtcctgccctgtccagcgtctgtgtcatccctttcccccgcccgccgtgcccaggctctgtgtcgtcccttttccccgcccgtcgtgcctagggactgtgacgccctccttacggtcctgccaccccccacccaccttgcccagggtctgtgacgtccttaccatcctgccaccccctgcccaccctgcccagggtctgtgatagcccttcccccgggaccacgctgcattcacccttcagggctgcagctctgtgagttttgagcagcaccgcctctgtcccctgcatgtgggcatctccaccgcccagaactgctcatgggccctggcactgctgctgtgggctgcgtcctgtgtgtcccttccaggatgtcacttgcatgaggttgtgggagcgtggccgctggcgtctgctctttcctctctgtgtcggaggctcatgcatggcacctgtgtctgcagcactttccttcttcgcgtgagtcacggtccctcccgtggatggaccatctggtcaccagcaggggcatattcgggtcctttctagtttttggccatcacaggtaaagctgatgtaaacacttgcagactggtttttgtgagagtgttttattggataaacactcaggcgtggggttgctgggccataggtacagtccttactttgttagaaactcaccacacgctgttttccacacccttcgcgccatgtcacatccccacgggcactggatgagatttccaggtgctgcagtcaggccagcgtgtggggtggagtttgctgtttttagtgtgtcggttggtgtgcagtgttggcacacggtgttggtgtccagtgttgacacacggtattggggtttgctgtttttagtgtgtccagctggtgtgcaatggtggcacagggtgttggtggggtttgctattttcagcgtgtccggctggtgtgcagtggtggcccacggtgttggtggggtttgctgtttttaccgtgtctggctggtgtgcagtgttgtcacacagggttggtggggtttgctgtttttagcgtatccggctggtgtgcagtgttgtcacacagggttggtggggtttgctgtttttagtgtgtccagttggtgtgcagtggtggcccacagtgttggtggggtttgctggtttcagtgtgtccggctggtgtgcagtggtggcccacggtgttggtggggtttgctggtttcagcgtgtccggctggtgtgcagtgttgtcacacagggttggtggggtttgctggtttcagtgtgtccagttggtgtgcagtggtggcccacggtgttggtggggtttgctggtttgagcgtgtccggctggtgtgcagtggtggcccacggtgttggtggggtttgctggtttcagcgtgtccggctggtgtgcagtgttgtcacacagggttggtggggtttgctggtttcagtgtgtccagttggtgtgcagtggtggcccacggtgttggtggggtttgctggtttgagcgtgtccggctggtgtgcagtggtggcccacggtgttggtggggtttgctggtttcagcgtgtccggctggtgtgcagtggtggcccatggtgttttactttgcgattccctaatgagaggacattggggccttttcctgtgctgtggtgtgcttctgtgcacccgtacgtcgtctttggtggccattcagaactgccatccattaaatcgagttctgtgtttctgagtgcggagtttgaggaccccttccgtgctctggatgcaggtccctcatcagactgttttaggctccacagccaggcctcagctccagctcccgctcctctcctcagagctccggcagctgccgcccccatcccccctgctctgtttcctcctgccccctaccacagtagaggtgctccttctcctcggtggactcgggccctgtgctcacctcaccgctcgctccaggggccagtctgtctgctgccatcctctgcacccagaggcggtgagccaggcttagtggctctgtgagcacccagcgagctgatgagtggctgcgtgtcctgtcttaccagcaagaacggacagtccaaccgtgtggttgggttgccgagtgcgtgaacaggcaaagttcggtaatattttcagaccactgctaatgcagacggtgctcagaggtaatgacctatcaataaggaattcacatgggcctggatctgaagtttcatcagagtccagttttcctgtttcctaagaaaataaggtacacaccatgtggaaatataattcgtaccatataatttgttgttagctttgcagacacagcgtaagtttccattaacagcactgaaacctccgccttaaaaaccaagcttcgtgctgggagggttgggagggcaccacttaccgtcctcaagtcggtcatttccctgaacagagtgcccttctcacacggaagcacacgttcacgcctggtgtgtatctgacaatcacactgccagccgccagcagcagatggcttggtgacagcggctccagagtcctgtctgctttgagattatccctctgttaagattgttttccttggcaatgcctgagcgtaaaggaaagcgtctcgatgctggtgagtggccggccagagcttttcacacaggaggacagagttggctcttcttaaagcctgacttagaagtgagcagggttccctgtggatgaacgctgccacgtgacagccttcccccttcattctcctgttctgccttggagctcgcacccattctgctttgcttgtgtgtttcatccatgtgtttggaaagatggaagcttgaatggaaattgtcagaaacgttacgttgtgcaaatgggctggaaaagctggttaacattgtttgaagccagcaaggtcccacgagcattggcccactctgagttagccgggggtgttacagaagaaggaacttctttttctttttttgaggcagacttgctctgtcacccaggctggagtgcagtggtgcgatcccagctcactgcaacctccgcctcccagattcaagcaactactgtcctgcctcagcctcccgagtagctgtgattacagacgcgcaccaccgcacctggataatttttgtgtttttagtagagacagggtttcaccatatcagtcaggctggtctccaactcctggcctcaggtgatccacccgccttggcctcccaaagtgctaggattacaggtgtgagccacggtgcccagcctatgtctgctataatattaagtatagaaaaacaggcttcagaaccatgttcagaagcatgtgctgagtaacagcgtttgagtccataaggaccacgtggaggagggtggtcccctctgatagtaacattgtgtttctcctttttctgtgtttggaaacactcactcactgtctgtgctacagtttctgcgtgttgagtgcagtcacctgctgcacaggttcgtggcctaggagcctcacaggctatatcgcacagcccaggcatcgcacagccaggcacgtaggaggctgcgccatctaggcttgtgtacgtcactgtagtacgttcacacggcaacgaaatcacccaatgacgtgtttcccagaacgcaccccccaccgttcagcaacgcttgactgtaccagcggtcccctgccattttggcaccagggactggttttgtggaagacaatttttccatgggtggggcagggagcagggtggtttcaggttgaaattgttctacctcagatcatgaggcattcaattctcataaggagcacgtaacccaggtccctcacacgcacagttcacaggagggtttgccctcccctgagaatctcatgccgccactgatctgacaggaggtggagctcaggcggtcacactccttcaccatctgctcacctcctgctgtggggcccagttcctaacaggccttaaaccagtcccagcctgtgtccaggccttgcgtacccctgcccagcaccggccagtatttctttggaaacacccagaagcccaggtgcccacaaagctctgttcagctgtcagcagacccctccccggctgttcctggtcacgcatctctcattttgcaaactttccagagcggatcgtcatcaggaagaaaggtgcagctgggcgtggtggcgcatgcctgtaatactgaggtcaagagttcaagaccaggctggccaacatggtgaaaccccatctctactaaaaatacaaaacttagccaggtgtggtggcatgcacctgtagtaccagctactcaggaggctgagacatgagaatggagaattgcctgaactcaggaggtgaaggttgcagtgagctgagatcgcaccattgcactccagcctggatgacagagcgagactgcatttcaaaaaaaaacgaagagaggtgtgtttgcaccctggcttttttgttttttacaaaatgatgacaggatcatttaaacagccagcagaattttaattatttggaactaattccataatacaggataaaaacagaaaaataaccagaaaaaggttaaaaatggggtgtcctggtacaagctgttcttattaaaacataccctttagcctggatgcagtggctcacacctgtaatcttagcactttgagaggccgaggcaggagggttacttaagcccagaaggtcagtgctgcagtgagctgtgatcgtaccactgcactccagcctgggtgacagagtgagaccctttctctaaaaatagaaaaagaccctttaaatcctgacatatcatggtttcatttctatctttacagttgttctgaatttttttttttttttttttgagatggagtctcactctgtcgcccaggctggagtgcagtggtgtaatcttggctcactgcaacccccacctcctgggttcaagtgattctgctgcctcagcctctgagtagctgggattacaggcgctcgccagcacgaccggcttattttttctatttttagtagagacggggtttcaccatgttagtcagggtggtcttgaactcctgacctcaggtgacccgcctgccttggcctcgcaaagtgctgggattacaggcatgagccaccgtgcccggcctgaattttgaagatcagaatcttttcatcaaagtccctgaaggcttttctgtagaaatcgacaaactgattgtgaaattctcgtgggcgtgcaaaggacccacagctgccgaaacactggggaggagtgaagctgaatggcagcaggtcctgggtgcaagactcacaaaaccacagtcatggggccacgtggtgttggctttcagaccgatgagcagaacgagagcgtccagaaacaggcgcccacacgcggaccactgacttgatgaaggctcaaagaccatttaatggcatcttttaataaggatactgtaaatgataggatcactcatacaccagaaagtgaacttggagtcaaaaaattaaccccagatgcgtcagggatctgaaggtaaagcccagaaccgcagagctagggcgaagcctttgtgacagtgggccgggccacacttcgtgggatacgtcctcaaaagaccgcagagtgatgacgaagcctttgtcaccgcgggccgggccacgcttccctgggtgcatcctcaaaagactgcagagtgacgacgaagccttcgtgaccgcgggctgggccacgcttcgtgggatacgtcctcaaaagaccacagagtgacgacgaagcctttgtcaccacgggccaggccacacttccctgggtgcatcctcaaaagactgcagagtgacgacgaagccttcgtgaccacgggccgggccacacttcgcgggatacgtcctcaaaagaccacagaatgatgacgaagcctttgtcaccgcgggccgggccacgcttccctgggtgcatcctcaaaagactgcagagtgacgacgaagccttcgtgaccacgggccgggccacacttcgcgggatacgtcctcaaaagaccacagaatgatgacgaagcctttgtcaccgcgggccgggccacgcttccctgggtgcatcctcaaaagactgcagagtgacgacgaagccttcgtgaccgcgggccaggccacgcttccctgggtgcatcctcaaaagaccgcagagctaggacgaaggcttcgtgaccgcgggccgggccacgcttccctgggtgcgtcctcaaaagaccgctctgtaacagggtaaagcaatgtgtggacttcatcaaaatgaacacttctgctttttcaaaggcctgttgaaaaaacgaaaagacaaaccaaagactgagatgtttggagatgatgtatgtaaggatttatctccagagtataggaagagctcttgaaactcagcaggaaaacaatccatttttttaaatgggcagaaaacaatttggaaagaccctttaccagggaagataggcggcaaacaagcctgtgaagaagacgctcggcgtcgttagtcatcggggaatgcaaaggaaaagcacacggaaatgccactgtgcctctcggactgctttcaattcaagactgagcgtaccgcgtgccgctgagagtgggaaggagcgcggactggctcaaacactttggaaaatggttggacagtttctaaaacagttaaacgtgcaccttccctgtggcccagcccttccacagctggtatttgtcccggcacagtgaaagcccaggccacacagacttgccctggacaccatttgaatgcttctccacagaggagcgggcactaaactggcatctccccagaacaggccacttcccaggttcagaaaggagcgggcacaggcgggcctcagaaaacgacgcagagtgaaagaagcggagaagggaggagagtgaacgagaggcttccacttgtgtcaggctctagaaagtgcagctcagtcacgggacagatccaggggtgccggggtgccttgggggctgcagtgcagaggagcagaggaagccgggcgaaggacgcagctgtcacccccaccatgccgatggcttcgcagccgtgtctctcatatggcgatggcttcgaaggcatgtctctctgatcatatggggacggcttcacagacgtgtctctctcatcatatggggacggcttcacaggcgtgtctctgtcatcatatggcgatggcttcgcaggcttgtctctctgatcatatggggacggcttcgcaggcgtgtctctctcatatggggacggcttcgcaggcgtgtctctctgatcatatggcgacggcttcgcaggcgtgtctctctcatcatatggcgatggcttcgcaggcgtgtctctctcatcatatggggatggcttcgcaggcgtgtctctctgatcatatggcgacggcttcgcaggcgtctctctctcatcatatggcgatggcttcgcaggcgtgtgtctctctgatcatatggggacggcttcgcaggcgtgtctctctcatcatatggcgatggcttcgcaggcgtgtgtctctctgatcatagggggacggcttcgcaggcgtgtctctcatcatatggcgatggcttcgcaggcgtgtgtctctctgatcatagggggacggcttcgcaggcgtgtctctctgatcatacacgtcagcacgtgtggcaagtgtgttgtttgcatctctgtgtggctctaaatgtttgttttttgagacagggtctcgctctgtcacccaggctggagtgctgtggcgcaatcctcccacctcagactcctgcgtagctgggaccacaggcatgcaccacggcacctggctaatcttcctgttttttatagagatggggtctttgccatgttgcccaggctggtcttgacttcctgggctctagtgatccacctgccttggcctccacagggctaggactgcagccgtgcaccgcctctgtgaatgttctgaacgacggggcatttgtcagctttgcgtccaccccaagacttgttttgaaatggtgaggttgaaactcacaggtgtcccttaaatgtgatgtgcggtaacttgagttgttgaggttttgcttgtgaatttctcattcttctttccctttttcgttccagagcgccgccctgtgctgggctgccgggagctcgtcttcaggaacctctccaagatcctccctgccctgtgccacgacatcaccgactgggtggtggggacccgagtgaagtcggcacagctgctcccagtgctgctgctgcatgccgaggaccacgccacgcagcacctggaggtcgtcctccggaccctgttccaggcctgcaccgacgaggaggcagccgtggtccaaagtgtaagtggccgtgttccagtcgtggtcgcggagctgtaactcgagcttaagatcccgcctctgtggtgtgcggggcccgaggctgtactgtagccaagacagcgttcccctcacccctgggccgcaggccctccccacacccagcccctgggaacaactgatctcctttctgtgcccgtaggtaacagcgtgttgagggtgaacccttcatgctcattttcaagcacactcgggggtgcagtgccaggtgcatgttgtgtagacgtgttgtgtagacgtgccgtgcaccagacagacagggcccgggctgctgacacaggaccgagatgcccagcgttcagcattgacatctgggctgtcctgagggcccttccaggcctcgcaggggctgtgggagcacccagacgggggatgatggcacagcttcgggtgtcctgcgagtggtgtccctggtgcagtcctctttctcactccctgtccacactcggctgctggttatcgcctcgtcaccactgggtacgcacgagggagtcccatgctcaggcctctcctcctcactaggccgggccacgccctgcgctgacagtcaccaccatgaggacttcacacccacctcacaaggatgcttcctagtgctcaggagaacaactaaagctttgacttgagatttcagttgaaaatatcctcatcttgaaccttaaattccattgcaaggtagcctggccagcagcttttacttctagtggtccaggtcactgttactagcccggcgtagtggcgtgcacctgtggttccagctcccgggaggctgaggtgggaggatcgcttgagcccgggagtttgaggcctcagtgagctatgattgcgccactactctccagcctgggcgacggaatgagacactgtctcagataaaacaaaaaaatctaaatcattgtgactgatttaaagtaaatgttccaggttccatgttatttacatgtcatgtttctgcttttcaaaaactaccgtgaatttaaaattgtctgtagttctctgtggaacctacaggagagcaagagacacgggggtgaggctgagaggacgagagacgtgtgtgggatccgctgtggaatcccacggtgcagaggggctggtgtgtgtgtgatccactgtggaatcccacagtgcagaggggctggtgtgtgtgtgatccggtgtgaaatcccacggtgcagaggggctggtgtgtgtgtgatccgctgtggaatcccacggtgcagaggggctggtgtgtgtgtgatccgctgtggaatcccatggtgcagaggggctggtgtgtgtgtgatccgctgtggaatcccacggtgcagaggggctggtgtgtgtgtgatccgctgtggaatcccatggtgcagaggggctggtgtgtggtgtccactgtggaatcccatggtgcagaggggctggtgtgtgtgtgatccgctgtggaatcccacagtgcagaggggctggtgtgtgtgtgatccgctgtggaatcccacggtgcagaggggctggtgtgtggtgtccactgtggaatcccacggtgcagaggggctggtgagtgtgtgatccactgtgggcttccacggtacagaggggctggtgtgtattgatcagcttagtgatgggaaggttgggtcactggtgtccgatgaggggtgtgtggtgaaccccacagctgggacacagcatcctttgggccagacttcactgcctgggaggcgtgtccggctcgctggcctcagggacgttctgagaccacacccggacccttgtacctttcctgagggctctgagcatgtgccaaggactcactctgcctaacacggggctctgtctggtgcacggctgtgtctgggaggccacggcgccgagagcaggagcccggctgagaccctcgggtttggctctgagttttctcatgtttctttctcgcagtgtaccagatccgcagagctcgtcgggacgtttgtcagccctgaggtgtttctgaagctgatcttatcgacgctgaagaagacgccctctgcctccggcctcctggtgctggcctccgccatgcggggttgcccccgagaagccctccagccgcacctggcagccatcgccacagagctggcacaggcccacatctgccaggcatctgaaaacgtaagagcacttgggagatgcgggagtggagaggaggagcctcccctgcccggccgtcagccatcgtaatgacatgtctgtgggttgccctgtgccgccaggctgggctgtcggaagcacccagcgacgtgtctgtgggtccgccccgtgccgccaggccgggccatcggaaacacctgcagtaaccggagtgccctcgctgatagcccttgttccggggcctcgtcctgggctgtgcagagctccagccctagccccagccccagctgcaggcggccgctcacgtttacattcgttgctgcccctttcttggccacactgaccacagttcacgtgtttgatgactcaggaggcgtccatggccgggaccctctggcccatgctgctgggggtagatgtggggtccacgtcatcccacccctgaggagcgtggtcgcacgtccaccatcccatccagtccccagggtacctgcacagatcgcacgtcctcagggggcactgatagcctgttccccatcagccctgcctggcgttccgatctgtgcttctcacagcccagctgaggatttgccagagacatttgtttaattttaaattgagcagcaaatccttgagctcagaagctggaacagcctgggtagttgggctcaattgtttggaataatccatagttgtattccatggaagaagaggtgatggctttgctttcatttgaaggtgagtggtccctgtcagtgtgtgtgttggactcagcaccccagatatttctgggacacagggctgcccccaccaggcggccgtgccatgcagggcgggcctcagctcacccctggaggcacttgctccggctcgatcgtttccggcggcttctatggacccaaagctggcctggggcacggggacttgccactgtgctctcagcccggcctgtcctgtgtcaggctccctctccgtcctcagaacgagaggtggggctgttgacagtcatttttgtaaactgttttaagaaacctgtaagcagttcctggaatacatagagggaaggaaacggagctggggtaaggaagggagcgggggaggggcccaggccgcgtgctcatggcatttcagccatgcttcagcttttcccaaaacccgtttttaacacatcatcgaatgtgtgtcagttctccactttccttcacccacgaggggttatgaggatgcctttgatttctgtatacagatttgcaagccagaagcattttttcctagaagggcataacttgaaaatgtgcacaggtgcctaaatccttatctcacaaactttatagcaaagaaagtgtagttttcacatctccatgttggttacaggaaaacggaattgtgtcatcccacagttgtgcatttggctccccatcttccagttttatcgaggaaaaatttaatcacaatctttcaaacagagacgtctttctgacaaagtccagtcacacgggacccctgggaagccagcctcaaccttccaggctgcgaacgtgtgtcggccctttggccaaggagccagtcacagtgaaaacccaagacgtacatttcactcctttcttgtttttatttttttgttttaggttgatcctcccacctcagcctcctgagtcactgggactacaggtgtgcaccaccacacctgggtaatttttttttatttatttttatttatttactttttgggacagagtcttgctctgtcacccaggctagaatgcagtggcgcaatcttggctcactgcagcctccgcctcccaggttcaagcgattctcctgcctcagcctcccaagtagctgggattacaggcatgcaccaccacacccggctaatttttgtgtttttagtagagacggggtttctccatgttggccaggctggtcttgaactcctgacttcaagtgatcagcccacctcggcctcccaaagtgctgggattacaggtgtgagccactgcacctggccccattttactccttaacagacttaaatttttggcaagaaagggtgaaggtactcaggtctcagtcagaatcaggcccgtggttctgtgctcttcccacgcccctgtgctcttcccgcggccggccgggctttgtgtcatgtcatttgggaagtcgattatgtttcccacagctattctccagtagctatgagaacaggttgaaaatgtctttcaagaacaaaccgaaattgttttaaaagctcgtgtttaaacagagaagtccgtgtaaatgtattctaaactgagcctggcttcactccctgccctggggttcacaggaaatctggctttagcagtaggtacttccaggtgtctcgggcccagtaggtcccctagagctcgacagacgggaactggagtctcctgggaaggagtttaggacaggtgtctagagtgaggaaatgggtaactcaccgatttgcttctcacacagggaagccagcagttgtgggatgccattgccattgttgaaataggagtctcttgtgcttttctgaattaaaaacctttgcagtcttagataacattgtttcagaaaacaatgtttgaaatagtatttcaaaaaatactgagaattatttcctgctgtatcttttttctttttcgttctgtgtgtgtgcgttgtatgtaggcagacactgaaaattgtctggtcaaatatagagaaatctataaatgtgaagtcttgtcacttcctcagagacggtgctgcgttcgtggcaggagggtggtgcttgctgcaaaggatgcctgattccctgtttgttcctgtgcttggaggtgtggtcagccaggaggggctgtgtcttctaaacgcacctgccttttgattttaaccgaaaagatgatcgctcctgaaatgtacatgacaggtcattctagaaactagccagatattgtcctcagaagtcagccagttagtacaggccttagagaaattgggctgtgggaaaaatcaggaatggaataaaaacaaatctgtggcttctgtgggagttggggccacgacagggccacacggctcctccagctccgagggagacggggccgcgcggctcctccagctccgagggagatggagccatgcagctctgtgtcttctgtgggtcagggcggggccggggtgcaaggacagaacgctgctgtagtacagtgggagtgttttgtttagtcttccatgatttacgtcagtggggaatgaggcttagagttttagagctgattaggaaatttagaaccaacccattgtctagccaaataattaccaaacttctttgaacttgcacccccattagtaaaaacagtttttaagcataggcctccaatatatgtacactgttgataaatcacgtgtttaaattacatggccacggtcctgactcactctgtactttatgaaacatacataaaatagacattagagggacgttataagaagtaaatacaggccaggcgtggtggttcttatctatgatcccagcactttgagaggccacggcaggaggatcacttaaggctaggagtttgagactgcagttagccacgattgcaccactgcactccagcctgggcgacagagcaagaccctgtctctaaaaaataagttaaaatttatttagaaagaagtaagcacacgcaaagccttaggaattcttgggtccagcacacgcctgctgtgttgcgggcttcagagcctggctgattcacagtggatgaggctggagccgggaggggaagccattcatccagcgcagccgtaggtgcagagctgagactccacctccccgtcaatcagtaaacatgttaagccatagaattttatttgtcttaaaacttggtgttatagaaaagctcaaaaatgcacagaagaggggcaggcagcagagcgactgccagcttcagcgctgaccagcccttggcatgcgtgttctgcctgcctggggccacttttctttttaactttggagggcggggagaacttgggcatgttgtaaagcagataatgcagtgcgccgtcatttccctcacaggtgccgtgtgcatcactaacgcagcttctccaccacatagctcaagtgcctgttcacatttcacaaaataagcacagattccttagctcccagtctgtgttcagttttcccatcaacaagcacgcccttttatggttgacatgccggcaccctacctccagcgcctggggggctctccctgcaagggctctcccatggctgctgcccctcgtgagccgtagactaggagccccgggcgggctctgtcggccctggcactggggccggagcgggagccctgtattagtccattctcatgtcgctaataaagatctaccacagactgggtaatttataaagaaaaagaggcttaatggactcaaagttccacatggctgtgcaggcctcaccatcatggtggaaggcaaaggaggagcaaagtcacgtcttacgtggcggcaggcgagagagtgtgcaggggaactgccctttatactaacatcagatcttgtgagacttaatatcaagagaacagcacgggaaagacccacccccatgattcagttccctcccacagggtccctcccaggatacgtggggattatgggagctacagttcaagatgggattcgggtggggacacgaccaaattgtaccaagctctgacggtgctgccggtctcttccaggacctctacctggagcgcctgctgctgtgtgtgcaggctctggtgtctgtgtgtcatgaggactgtggcgtggccagcctgcagctcttggacgtgctgctgacaatagtggccctcgcaggtgctaccggcctgagggacaaggtaaggctgacagtggtggctgctgcttgacctagcggagctcacagctggaaggcatctctaagtgaggtgaactgtctcctatgcatcccctctgtgcttgagccccaggcctcaaacatgtctgaccagcaaagaccagggattgagaaccttgcgggtgagtccccgggcaacggccttcggggcagctctccagctgccagtgtattctggcatcagggagtggagacagctgtttaatgttagggtcttcagcaaagaagcaaacaagaaataagaggtaacctttaaacctgcgcacttgagtagggtttaatagtgcacatgtcgctgggcgtggcagctcacgcctgtaatcccagcactttgggaggccgaggtgggcggatcacctgaggtcaggagtttgagaccagcctgaccaacatggtgaaaccccgtctctactaaaaatacaaaaaattagccaggcgtgttggcatgtgcctgtagtcccagctactcaggaggctgaggcaggaaaattgcttgaaccagggaagcagaggttgcagtgagccaagatcgtgccactgcactccagcctgggctgagcaacagagcgagactccgtccaaaaaaaaaaaaaagtgcatgtgcatgtgtgactgagtcgagagaagataccgtgatttcccgctctcattgcagcacagcgttcagaagtacttctcgcccatgggctccctgtttatgcccaaaaatcatcttttttcttcagtggagtctcgctctgtcacccaggctggagtgcagtggcgcgatctcggctcactgcaacttctgcctcccaggttcaagtgattctcctgcctcagcctcctgagtagccgggattacaggcgcccaccaccatacccggctaatttttatatttttagtagagacaaggttttgccacgttggccaggttggtctcaagctcctgactgcaggtgatccacctgcctcagcctcccaaagggctgggatcataggcatgagccaccgcacctggccattatgcccaaaaatcttttaaccccaaccttctaatgggcttctagggcccctggaggccccagtatctgtctgcctctctggaagctgagacttagttcctcctcccattctgtctctgtggacagcccctctcggcagattctctctctgggagatttacggcctgaatgtactatggggaacctggtgtggaggaggctgctgccctccccttccttcttggggcctctaaaaacaagcttcccaaggggcgtgtgtctcagcagatgctgtcactgttagggcctgaggtaccagcaaaagcaaagtctttgcctgctggtcatgggggaggaagccaggtagccccagattcagactccaggcttggggcagtggccaccggggagcctcagcccttcctctgttcctaagcccccaaggagagcagccagctaaaagtaaaaggtggccaaggttatcatctctgtctgcccagttacttttacctggaggtctggtctgctgggcttaactctttaagccacttgcccgcccctctctgctcctcaccacctcagaggagccctgcctgcccaggcggacaccacgtccgtgtaagccccaggaccacctgtgctgtgtgcatcccagtgtgcacagtgcctgcttcatgattcgctgcagagacggcgttggtgtgaacgggatcagggtctcgccctgcacccgcggctctcgctctcctgcaccctgggcggggctccctgtggcagcctccctcccgattatcctggcaggcccggcctatgtggttcttacgcgtgagggggatagtgagtcccagcaggcaggcaggcttgagccctgagtgttggaattgtctcagtctctgacttgtaacctccaggcacaggagacgatggactcactggccatggtggagggtgtcagcagctgccaggacctctaccgcaagcacattggtcccctcctggagcgggtgaccgcgtcgcaccttgactggaccgcacactcgccggagctcctgcagttcagtgtcatcgtcgcacagtcaggtgagccgtcccgacagctggcgtgccgtgcctggccccactcaggctacacacctgctcccccaggtgctcagcaggtaccagcgccgaccagctgagctgtggttcactgaagcgtgttgttaaaagtacccaatagtcactcttgcctggggagaagcagcattttaaggagcatcgcattgaagactgtgggacgcagctcttccacttggcccgggcacacgctttcatgtgaaaccttcaaagtgtgcttttccgtggcctgttttgtagcctggcttcttaaatacgtctggattttgttgcagaatctagatgtctagccgcatgggtgctgtgtgtgtgacatgggggccttagccccagcccctctgagaccagcatttctgtggttctctttgagcctgcggatcagccacttttcctgggatggacagtgtggcccagtggggcttcagcgcggggcaagatccactgcagaaccctaaggagacgtccgctcagcagccatagtgccttgggacacacggcccgcgctgctccacgggccgtgaactcgctgcggtagctcttcctcgtttgcctccccggccctcccgctcccacctgcagctccgagtgcccccgcctcctgttggatgtgtgcaccagggtggtcgtgctctgcatctgaggatgctaagatcgttcttacacaatctctgtgcctggtagggactcaccttttttttcctgagacttggaaaaatacccaaaattgttctttgtcagttgcattcaaaactgtttccaaattagaaaagaaaatactggctgggcgtggtggctcacgcctgtaatcccagcactttgggaggctgaagtgggaggatcacttgagctcaggagttcgagaccagcctggccaacacggcaagagctcatctctacaaaaagatgaaaaaaaccgcacgtgcacctctgaatctaaaatttaaaaataaataaaatacagttagccaggcgtggtggtgtgcgcctgtggccccagctactcaggaagctgaagcgggaggatccctggagcccaggagttcgaagcttcagtgagctgtgactgcactgctgcactccagcctgggcaacagagcaaggccctgtctctaaaaccaaacaaaaaacaaagctggcgattgctgacgtgcactcggggcattaaacactttatgccagacgctgctctgcaagccttagggccgtcagctcatctaccctcacagccggcctgtgtggtgggaactgtgaccccgtttcacagacaaggaggcagagcacagagaactcccgaggcagcgactccagagcctccctcagcccctctcccacgggcctcttggatgggggcccagggtgttgcatttcagatttttactgaatgttactcctaacaacctcttgcaccaaattactccagccttcacctcacagtccagaaaattgggcacacaaaccccgagagacgtggcttgcagtgaagccaggacttgcatttactgcagctctggtggcttctccaccatctgttcttcctctttgcagaagcatttcttatggtgttggcggaactgattggcagcttggaacacacatctctttgggcccacatctcctgtcattcactgaaaggcaggaagactgcagtatgccgttcagtgtcaagagctgggtataaaactgtatgggtttttttgttttttgttttttgagacggtctcacgctgtcacccaggctggagtgcagtggtacgatcacagctcactgtagcctcaaacttctgggatcaagtgatttttctgccttagcctcctgagtagatgggattgtaggcatacgccacctggctacttctgtatgtttttctagaaatggggtcatatatgctgccaggctagtcttgaactcctgggctcaagcgatcctcctgcctcagcctcctgagtagctgggaccacaggcacccaccaccacgcctggctaatttttgtattttttgtagacatggggtctctttatgttgcccaggctgacctcaaactcctaggctcgaacagtcttcccacctcaccctcccaaagtgctgggattaacaggcataagccaccatgcctggtttaaaactgcatttcccaatgatgattatgttctctgagccccatctgagcgcacacatgtgtggtgctctcgggagtcgggggcacagcctcaaatataatacaatatttccaacatcgtgtccttggaatacagatgatttttattttcttctttatttttttctatgtttttctaagctttctctaatgagcatgcactactgtaataaacagaagacaaaaggattaaaacaattttttaataggagaaatttttaaatttctcatttacaaaagttctatgagaagataccttttaaattttaattattttaaacatacagaaagggataatttctaaactttgagaggatgggggatctacaaagacattgatttgactatatacatttgaaccaaaataaaaggaacatagacttaggaaaatatttgcaataaggatgacagtgtgagatctttgttacataaagctgacacaaaatgagaacaaaagcattaagagttgggcacggtggctcacgcctataatctcagcactctgagtccataaccgagcagcctgctctgatgatagaggctgaggcaaggaggctcacgtgagctcagaaattgaggcttcagggagctgtgattgtaccactgcactccagcccggacaacagagagagaccatgattccaaaaaacaaaaagcattaactcccaaacaaacaggcaaaatatccacattttataaaaaagaattaatacaactaataagcaaatagagtgggaactatccagcccttctagtgatgaggaaatatgaattaaagactgtagggtcccgctgggcgtggtggctcacgcctgtaatcccagcactttgggaggccgaggcgggcagatcccgatgtcaggagatcaagaccatcctggctaacatgatgaaaccccgtctctactaaaaatacaaaaaattagctgggtgcggtggcgggcgcttgtggtcccagctactcgggaggctgaggcaggacaatggcgtgaacccaggagacggggcttgcagtgagccgagactgtgccactgccctccagcctaggcgacagagtgagactcggtctcaaaaaaaaaaaaaaaaaagactgtagggtcccatttcttcatttatccaattaagtgaaataaacagctgctgcctagggtggctgagctgggagtgccaaggtgcttttggaaagccgtgggacggtgcgcatctggaattgccaatgtcttcactcctttcatccagcaatcacattcatgagaatctatccttccaattctaattatggaaaaagctatgcacccaaaaatatgcatcggggcataatttaatagaaattgtaagtgacccaaatacctcatacgaagttaaatacataatgatatttccatagaagaaatgctctggcaaccattaaaaacaattatcctaagcctttatagcaaaatgggaagacaggtgtggtgtgatatggagggaaagtgaagccagtgcagaagtgtccgtgctgcaagcaggaactcgcactgggaggggagacacgtgatcagggcggaagtgtccgtgctgcgaggaggagctggcactgggaggggagacacgtgatccgggcggaagtgtccgtgctgccagcaggagctcccgctgggagggcagacacgtggtccgggtggaagtgtccctgctgcgagcaggagctcacgctgggagggcagacacatggtcccgtggaagtgtccctgctgcaagcaggagcgctagtgctgggagggcggacacgtggctccgggcagaagtgtccgccagcaggagcgctcgtgcttggaaggtagacacgtggcccgggcggaagtatccttgcagcgagcaggagctggcgctgggagggcagacacgtggtccgggcggaagtgtccgtgcagccagcgggagctcgcgctgggagcggagacaggtgatctgggcggaagtgtccatgctgcgagtgctcgcggctgggagcgcagacacgtggtccaggcggaagtgtccatgctgcagcaggagctcgcactgggaggggagacacgtgatcagggcggaagtgtccgtgctgcgaggaggagctagcgctgggaggggagacacgtggtctgggcggaagtgtccgtgctgcgagcaggagctctcgctgggagggcagacacgtgatcctggcggaagtgtccgtgctgcgagccgcagctcacactgggagggaagacacgtggtccgggcggaagtgtctgtgctgcgagtaggcgctccggctgggagggcagacacgtggtccgggcggaagtgtccgtgcagcgagcaggagctcgcgctgggagggcagacaagtggtccagtggaagtgtccgtgctgcaagcaggagcgctagtgctgggagggcggacacgtggcccaggcggaagtgtccacgcctacctcgagcaggagcgctcatgctgggaaggcagatgggtggcccgggcagaagtgtctgtgctgcaagcaggagcgctcatgctgggaaggcagacacgtggcccaggcgtcaggtttgaacattcttgacagcaagtggctcacccgtcagcgtgctgctttttcccatcccaggagttggacttgacctgtggacatttggctgttttctttttgtttttaagccagaaacactgtcttgtttccagtttaagatgtagagagggtgaaacagtcagaaactgggtcagaagcagcgtggttctcgtggcagggcggcacttggcccaagactcgtgctttggcgggaggctcaagtcaggcgtcccagcagcttcggtgcaacgcctcctgcccggctgcgtggggaggccctccaagacaccagctggtctcaccgcgaggcctgacttcgagccagagcagcgagtacattgcgtctccgtgtggcaagggcaggtgcgggggtctcagtccactaccgagcagcctgctctgatgactggcggcgccagggagaagggtcacatcgcgaggtccccagcaacggctcaaggtgactcacagttgcttggataagccagtggacgctccctctacactggcccggggccagagcgcctccttctgcggccccaacccagtccccaccctgagccttcagctcctgggcctgcaggctgagcctggcaggagacgctgcagggactctcagagctgtccttgccctgtcattcatggagacttacagggaggcggggcggccctactgcagtggggaccccttggggcgtaggatgcacagtgcaggcgcccaagcctcgcgcccaccggagagcagccacggtgcaggagcttggccctgagtgtgggcggggtgagggctgcaacgctgagaagcagatattaaagaagttctttcactgaaacaattgattttggtcgttgtttcaactattgcttgactttaatttttcaaaaaaatttagaaaaggttaagaaaaatggaaggttgttttgtttttgagatggagttttgctcttggtgcccaggctggagtgcaatagtgcgatctcagctcaccgcaacttccgcctcacgggttcaagcagtcaagcagctgggattacaggcgcccaccaccacgcccagctaattttgtatttttagtagagatgggatttttctccatgttggtcaggctggtctcgaactcccgacctcaggtgacctcaggtcacccatcttggctttccaaagtgctggaattataggcgtgagccaccacgtccaggttttgtttttgtttttgtttttttgagacatagtctcactttgtcacccaggctggagtgcagtggcacgatctcggctcactgcaacctccacctcccaggttcaagtgattctcctgcctcagcctcccaagtagatgggactacaggtatatgccaccatgctagggtaatttttgtatttttagtggagatggggtttcaccatgttgaccaggctggtctcaaactctggacctcaggtgatcctccctccttggcctcccaaagtgctgggattataggcatgagccaccatgcctgaccaaataggttttcatatggaaaaacgtgatttcggggggttaaaattttctgctgcttttctgtgataatcaccttactgattgagaaagaggaagcggggaggtggtggccgatagtgccctctcccaggtgggagcgcctgagcctgggcctgtgctggatggggcctcctcccgtctcctgagggccgtgcacaggagcctctgttgtgtcttacaggccctgccctgggagaagccctgccacacgtcgtgcccacgctgagggcctgtctgcagccctcccaagacccgcagatgcgcctgaagctgttctccatcctgtccaccgcgctgctcagagccacggacaccatcaactcccaggggtaggtccgggctctgcctctgcacggcccccagctggggcctgggccaggggtccccatctccctccccaacagctcactgagcaagggggttcccacctccttccccaacactgcactgcgcaaggggttccccatctccctcccccacactgagtcaaaggtgggccgggggtccccacctccctcccccacgccgagtctaaggtgggctgggggtccccacctccctcccccacagcactctgggcgagggttccccacaccaagtctgaggtgggcgtgtgcagtgacccctgagcttaactggcctggaagcagctagtccatcctcactgggtaaacacaagctctcggcagggaacaagctctcggcagggaatgcacagagaagcactaagtcaaagtcatctccgtgtggtcattaaaattccagtgaatgaaaaagttttagggaacattaactgttaatggcttatgtattagctgttctctgttttaaaagcctttgggcacttttcaaacctaacaaacaactgattgaatttctattgatggtcaaagtggtaaaaatacctctttgttatctaagacaacttttaggtggcattaagaccccgagggtctagggcctccaggtgtacggctttgaagtaagggcaagaagcatgggtgccctctaggagcactgggagggacagtggaggaagaggccccgcccgggtgccactgctgaggcagctcttagggccctgccacttactttgctcagagcaaaaggtgccgtcagctgggtcctacccccgcctgtgcggctggatctgggctgcgtcagcaccgggacccgccccagcagcacatctgtcaaagcggaaagcagttcacacaccagagcctcatgtggaaagagtccaggcgctcagacttttctccttcatgaccctcatctctgctctcgggcctcagcccgcctgtcgtactgcaggaaattttgtttcctgcttgtcttcaaagacttcagggcttagaacggaccatagaaagatatgaaccgagagccgtggcagctgtccagcttgcaggctgatatttgtgtagatgccatgcagataacacagcagggtccaggcccttccctctggaactcacactcggctgtattttgggaggaaccgctgggcaggttctgcccaggaacagttaactctgcagagcacagtttccacatctgggctgagttcccaaagaaagtgcgcctaacaacgtcttgtggaaggcggttggcgtcaagagaagtaaagtgttcagatggcagtgattttaatgaacttactagctattttaataggaaagattttttttttatccgtttggtttttatttttagaatcatgaaatagcaagttggctctgctgaagtagaaatggtgggcggggagtcgccactgaccatcgtctgcgcagagcaccttcctgctgaccgcagctgtgagcgccggctgtacgcaggtccctgctgtgcgggtgcccaagagggctgagggctgcgtctgccatggtgtctccaccttggacaccatgaatcatgagaggttctcagggctgcctcccacaggctttctgtgtcttacctgggacactcgggactagttgtgtttaggttttcttaaaattctgtagtaattgcattgtagagcatccctaatccgaacttcagaaatccaaaatgctccagtgagtatttcatttgagcatcatgtcagtgctcagatatggtcagaccctggagcactttgcattctgaagtgaaggatgctcagcctgcgtctgacagaagctccagagaagtggctgcgagttcagggcaagaggctcctggctttgaggctgcaccgtttctggaagtcaagccccacagtggacctcgagtccctctgtgaataggaatgtgctcgggcagggaacccggagcaccagccgctgggcccctcgttccccggctctgcagcgtcttcgggtcctgtgggtctggctgtgcccagccctgctgcccgtggactatagtgtcttggggtcctgcaggcctggctgtacccggccccagtgcatggtggcaagtgcctgtgatcccagctactcaggaggctgaggcaggagaatcacttgaacctgggaggcagaggttgcagtgagcggagattgcgccatttcactccagcctgggcagcaagagcgagactttgtctcaaaaaaaaggaacgtgcctcattcagtggttcgatggtggttctgatcaatgcccagaagttctgatggagcttctgtcagacacaggctgagtatccttcaccccaaaattaaaaaaaaaaaaaaaaaatttaaaaaaacctaagcactcctaggtggcgcccgtgtggcacgcctggcccacacttggaccccacaccctgaaggccaggacttccaggccatttcatgtggtcaccatggagcaggcgctgggttcgttcattccagagagccctcttgcaagtcacggtgccgaaaatggcagctctgcttaaaaacgaacccacgccagaaacctcgcggaatgcgtgtaaatcacaccacaccaacgtcactttccacatctgctcatctacctggctggtcccaacatggcccctgccaggagcaagccggtggcgcctccagaagaggaagggacgctgtgcaggcttcacggacgctggagggctgcgggctgtggagctggtcttggagaccagagccacctttgaaacataccgtggtgttgggatgtcactaatgagtgtgtcattttgctttgagtttgtcttggtggcactttgacctgactggtcaccatcaggacgaagtcgccgacagggtgggaactgcccgtctctctgagctgtggcccttgggtccccggaccgcgcctgtggccctcccatcccgcctctgtgaagccgcagcgactgtccttgctggacagagggttctgtggctggagagacttggcctttttctgggggagggatgcagatgggaaaggggctcactgggtgctgccgacaccaccgcacctgccctagcccaggcgtcactcaggcctccttttgaagctaggagcggcgaggggctgaaagtgcaccctcggcccagggcctctggctcgcctctggagaacaggacctacgcgggccgcaggagaggccaggggcacaggcacccctgtctccccggtagggttgggcctggaggaacctcccaattcgcactgagaagcagctcctgagaggaggaggggcctcgtgttttggggtcgagttcgttttcctgtttggctcccccctcagccccattcatccccagtctgaaacgtttcttccgagcacctgtccagtctcctcatccaccctctccgttccggttccaggcagtttcccagctacctcgagacggtgacaaaggacatcctggcccccaatctgcagtggcatgcggggaggacagccgcggccatccgcacggctgccgtgtcctgcctctgggcgctcaccagcagcgaggtcctgtcggcagagcaggtacggggctccctgcgtgctcggtggacacgggccggggactgcgcaggcttcctggcgcccggcagagctcccgcagcaggaacttgggcaggcagcagctgcacctccacctggggcccgtaccccaagaggctctccccacactggcggcggaagggcaggagccggcggccgggctgcggttcagacagcaggcgggagagcgggagccaggccgcgggcccagccagcccggtcgtgctgcgggttttgcagccgctcatgagcgtgcggtttctcggtttccggcccaatgctggctgcaagaccaggagtcgaatcccaggatccaggccagaggacgggcctgagcccaggcccgtttctatgaacacctccggctggtaccaggtgtcagaaaacagacactgatgcccgcccgcgtcctggtcgccgcccggcgggaaggcgctgccctgggcgcccgtgcagcatcagcgccacctcctggtgcacgcggggtggtgcggtcggtgctccagccgaaagccccacgtccttggggcccaggcgagccattaccctggtttagggttagtgcctcacctaggagttgtgaacagtgtgcgtattttctaaaaatcaagtaagcaagttaaaaattgctcaaaatctaaattttacaatgaagattcaagcctactttttaggtaaagctttcaagccccctaagtccttccaggcaggagtgcacggatggtgagcacccccaccccaccccaggacagatgtaagtcacgtcgtatgtgtttgctgattgcagatacgggacgtgcaggaaacactgatgccccaggtcctgaccaccctggaggaggattcgaagatgacgcgactgatctcatgccgtattatcaacacgttcttaaaaacctcgggcggcatgacggatccagagaaactcatcaagatttatcctggtaggacatttctgttgttcacagcctgtgtatatgcagtcagccctccgtgtccctgggttccgtttgcatccatggagtcacccaaactcagatcaaaactatctcgggctgggtgtggtggttcacacctttaattccagcactttaggcaggagggttgcttgagcccaggaatttgagaccagcctgggcaacatagccataccccgatctcaacaaaaaatttaaaaattagccagggctggtggcacacacctgtagtcccagctactcaggaagctgaggcaggaggatcgcttgagcccagcctgggcaacagaccaaaaccttgtctttaaaagtaggggtgtgtgtgtgtgtgtgtgtgtgtatggctacatatatacatgtttgtgcatttatacatacaaatacaaatttgtacttacatttgcatatataaatatgtatgtattggggggcagaattccacagttccaaaaagcaaagcttgaatttgttgggcaccaagtacaacgttgaacccgcatgaagaaagcatcatgtacacattgcattcggccttaaaacaacattggaccctcgtgaaggaagcgtcgtgtggacgttgcgttctgccttaaaacaacgttgaacccacgtgaaggaagcgtcgtgtggatgttacatttagcgttaaacgtaatctagagacagtttaaggtgtgccggaagatgtgtgtgggtcatgtgcaaatactatgcctttttttatcagagacttgagcatttgaggattttggtatcctagaggaggaggattcctggaaccaaaccccacagataccaagggacgactgtatataagtttgatggtggcttgttttatagaaaaaaagcagaaaacgtggccgggcacggtggctcacgcctgtaatcccagcactttgggaggctgaggcaggtggatcacaaagtcaagagatagaaaccatcctggccaaaatggtgaccctgtctctactaaaaataaaaaaattagctggacatggtggtgcgcgcctgtagttccagctactcaggaggctgaggcaagagaatcgcttcaactcaggaggtggaggttgcagtgagccaagatcgcaccattgcactccagcctgggtgacagagccagactccatctcaaaaaaaaaagaaaatagaaaatgctcatctttgacttctgttcaagttggtactatgagaacaaacagcaatgacagatgaaataccacaaattaaacggcacagcaagaagcaaggcagaggtctccaaaccagcactgggtgggggtgacaaggctcagcttccacgcggccgggaagggggacctcagggtggggcggctggagctgcctgtgggggagacggggccgggccaccctgcagcaggaccaggggcacagcctcagtgtcgccgcctcctggagcccaaaccccagaccaaccccaggtgagagcaagcactggggaggggaatggggtggttggcttgaagcccccgaaaagcagcagcactgaacagagtcatgaattcagagagcccctcactcagggcagcctgcacacaaacccctcaggacagggcccccgccacccaggccatgggccagtacctgtccgggtcctgttaggaaccagactgcacagcaggaggtgagaggtgggcgagcgaaacttcatctgtgtttacggctgctccccatcttttgcattaccacctgagctctgcctcctgtcagatcggcaacggcattagattctcataggagcacaaattctattgtgaactgtgcacgcgagggatccaggctgacgctccttatgaaactaatgcctgatgatccgtcactgtctcccatcgtccccacatgggaccgtctagttgcaggaaaacaagctcaggcccccactgattctacaggatgatgagttgtagaattatctcattatatgttacaatgtagtcatagaaataacgtgtacaataaacgtaacgcacgtgactcatcctgaagccatctcaccccctggtccatggaaaattgtcttccatgaaaccagcccctggtgccaaaaaggttggggactgctacctcagaacaccgaagacccggcgctaagggcagcctcgcacccagcccgggaaggaagtgccgataatagaaccacctcaaagttacctttattgaggcgtgtttaagatcctcaaaaagctaaaagaacaacatccactaaaaaacaagttgagaaacaagaagacaagcaggaataaagaacagatggaaacggaagcgatcgctgggaagtccggagtgacacggaatggtgtgctggcactactttgaggaaaggagttacccagcgagggaggaaggggatggggtgggcgggaagcggccactcaggcgttcctgattagctctacttaatgtgattatctatattttgtgtatttatgccagaaatgtttagcagtttttaaaagatggttcttgctaattcctggaaatgaatggagtcatcggaacttcacactctgtgtactgggtcaactctagactgaatgtggctgaaaacaaagttagtgacgtgaaagccaggaatgtggaattcctcaagatcacaagacagagaggggtgcaaggcctggagtgggcgaaggacacgggacggggagggacgcggggcctggagcgggcagaggacacgggatggagagaggtgccgagtgggccgagaggctcccgggcttttctgaatcccaggagaagagaatggaggagagatggtgcctcagaatcttccagaactggagacagacatgaattttcagattcacagtacacacggcgctgggcagaaaaaccgccgcctgctgaactctgaggtccgggggcctttgtcactcattctctcacctttgcttttctgtttttattctttagtaacaaacatcctgttcccactgactctggaacaagttcagtccatgcgattgttgggaattcactcactttttaaaacaggagctggcggaaaggctgcacgcgtttgggcatctgagcgcatttgggcatctgggccacggccccctgtttattttcactacaaaaggttccttgagaggccccttgcctattagtgccagctctgggcttcccagggtgaagtgttggatgaatcatggcctccttggtggggaaggaaggatgtcctgagttgggagcacagacatccaggcctcccaggacagacagacacaaacatgaacagcagacaggccagcgtgagccgattctgcctggcttagtcgtgcatgaaaggaaccctaaactggtacaaaagtggacctgcaggccatccagggagtgaccatcgtaaaaacacaatagccagtgccactctgtgtacttccatagtcgaccgcgccagcaggaggcctcggaggatcctgtccgggcccatagatgtttgctagcgggacaagcttgggtgagttgagcatctgactccgtccttcctcctgagacacgtgcagcgagggcacccactgtgcagcgagggctcccgccgtgcagtgagcataccccctgtgcagtgagggcacctgccgtgcagtgagcataccccccatgcagcaaaagcaccccccatgcagcgagggctcccgctgtgcagtgagcatacccgctgtgcagtgagggcacctgccgtgcagggctgcttcagggtttggcaccataatgcctggatgtgctccgtggcttcctccttggtgcctgtgtttggtggctggaaggcccagcaccctcagggcccagaaccctcagggaagtgcctgggcatctgccaggaattaacccactgggtcccacttgtctcaaagcctggcttggtaggatggcctgaactttggatgtttttcatgcctttcgttacataggatcctcttgctgagggtggatcatgccctccacattgcaaaagcatcagagacccagcccaccctcgcgtctgcagcgggaagatgggcctggtgccaggcgcgggcagccgcccctcccagcgtcgggaagatgggcctcatgccaggcatgggcagctgcccctcccagcgtcgggaagatgggcctccgggtggttttgcgactcagtcatctgcgaatttccggatgctgcacagaagggggtgccaaagtttttttaagatgatgtaaaaaaagcataaatttgataaaaattatgtccattaacctcataagtttctacccatcgggaaggatcatccttctgttttcagcagcagaaaactgaccacagtagggggttgtctgtcactgagtcctcagctctggtgggagggcagggtcagagctgggcagggtggccagcttggggatctgagcatctgggagcaggaggtggagggccaggtgagcacacagctgcgaggaggtggaggaccaggtgagcacacagctacagctacagggaggctctgcgcctgcaggacaggttattacaggggccgcagcagggcctgggccgcctccactctgttggctggggttcaggggtcccaggtcgccaggagcaccttgcatgtggctcgggatgcacggagtctcccgtgaggtgtgggtttcctaggaccccagggcaggtgtcccatgggagtatgaactaaatgcctttgtggacgtttagacgtgaaatgtctgctctagactcacacacctgtctcgctccctccttccagaactcttaaaacgcctagatgacgtgtccaacgatgtgaggatggcagccgcctccaccttggtcacctggctgcagtgtgtcaagggtgccaacgcaaaatcctactatcagagcagtgtccagtacctgtaccgagagttgctggttcaccttgacgatccagagagggccatccaggatgcaattttaggtgagactccgacggcttggccttcgttccgatgcctgctttcggcgcctgccacgggcatctgtagctgagccgtgtgaccggccacagggccctggggcacaggaggggcctcagctccggcctggcacactcttgagttcttggcaaaccctgagagcggctgtctttgtggtgatagctgctgacatttcctctaacagaaatcaaaactgagagtattctagaatacttgttagttgtttaaaataacaatagtaagcccagtatatattgacacagatggcttgtgtttttgaaaaatactttccaaaacaaaatcatctgcaagaacgatttttgcaaatgtcttaaatgtgtagcttgatggaagacactggactttcacatcttccatacagtcagtcatgatgtgtatggctctggctgaaatacgtggaaaataatctggcctcgcctgtggcttcaagtgtagttggacaaaagaagagtattttagtagccttttcagataggcgtgggacttcttcaataccacgccaacagcgacacaggccgtcccttgaaggtcactcacagcacagggcctgaggccacacaccacagagccttccacgctcagtgcattaaaatccgctggtccatctcacacttggaatgtaacgatttgcttttttttttcttttttttttttttgttttgttttgttgttggtgaatataatgacgttgttcttttttttaataaaatttgtatttttaatttttgtgggtacacataggtgtatataaggcatgtgtgatactgtgatacaggcatgcagtgtgtgtaaatcacattggggaaatggggtccccgtcacttcaaacacttacactttctttgtgttacaaataattcagtgatacttttcgttatgtttaaatgtgtgataaattattgttgaccatagtcaccctgttgtgctatcaaatactaaatcttactcattctgtttttgtactcattaaccatccccatctcttcccccggccccattcctcttccgagcctctgggagccatccttctgctctatctccatgagttgaattatttttatttttagttcccacaaatgagaatgtgcggaatttgcccttctgtgcctgacttatttcacttaacatagcgacctccacttccctccatgttgatccaatgactggatctcatttcttttgtggccggataatattccactgcgtgcgctccacgttttccttctcccttcatctgtccgtggacaccccggttgcttccacaccttggctgtcggaacagtggggcattcggcgtgcgcgtgcagctctcccccatagctgaattcctctcttttgggtatttgcccagaagtgggattgccgggctgtatggggctctatttttagttttggagggacctccagactgttctcccagcggtgctcatttacattcccaccagcagcgtgagggttcccttgtctccacatccgcgccgggacttgtttccgcagccattttaactggggtcagaggatgtctcacttgtttctatgtgcatttctctgaggagcggtgctggtgggcaccttttcagacgcctgtttgtcatttccatgctgtcttttgagagctgtctgttcaggtcttttacccatttttaattggattattagattgtctgctattgagcctgagctcctcatatattccagtgattaatccttgtcaggcggcggttctaagatacagtctcccatcccgtacccgcgggctgtccctgcggctgtactctgctcattcttccctttgctgtgtggaagctttgggcctggatgtgctgactttgccttttgcctcctttggaaaatacttagaccttccccgcgcagctgcgtccggtttcccggcgtggctacatccggttatgcgatgtcggatcttcctggtgtggccgcctcccgtcgcgcagcgtcagaaactcggatcttcgtggcgtggccgcctcccgacacgcggcgtcagaaactcggatcttcctggcgtggccgcctcccgtcgcgcagcgtcagaaactcggatcttcgtggcgtggccgcctcccgacacgcggcgtcagaaactcggatcttcctggcgtggccgcctcccgtcgcgcggcgtcagaaactcggatcttcgcggcgtggccacctcccgacacgcggcatcagaaactcggatcttcctggcgtggccgcctcccgtcacgcggcgtcagaaactcggctcttcgcggcgtggccgcctcccgtcacgcggcgtcagaaactcgcatcttcccggcgtggccgcctcccgtcacgcggcgtcagaaactcgcatcttcccggcgtggccgcctcccgtcacgcggcgtcagaaactcgcatcttcctggtgtggccgcctcccgtcacgcggcgtcagaaactcggatcttcccggcgtggccgcgtcccgtcacgcggcgtcagaaactcgcatcttcctggtgtggccgcctcccgtcacgcggcgtcagaaactcggatcttcccggcgtggccgcgtcccgttacgcagcgtcagaaactcgatattcctggcgtggccgcctcccgtcacgcagcgtcagaaactcgatcttcctggcgtggccgcctcccgtcacgcagcgtcagaaactcgatcttcctggcgtggccgcctcccgtcacgcagcgtcagaaactcggtcttcctgccatggccacctcccatccggcggcatcagaaactcggaccttcctggcgtggccgcgtcccctcacacagcgtcagaaactcgatcttcctggcgtggccacctcccctccggcggcatcagaaactcggatcgtcctggggtggctgctcttgttacgcaacgtcagaaactctcctgcgtgggcaccaggctcagaagagtccggcttgtggtggcagggccaagctttggctcattgtgattttttgtgtgagagcttgacttgtatcctcggccacaaaccctgtcggttgttctgggagtgagggacttgggccgttcactttcacgccgtgctctgccagatcccgcgtccgcacagccagggtgggtgcactgctcgtccgtccgccattcttcctgggaaaagcagctctgctgcacgaccctggtcctccgtgtgaagcggtgcacctggtgcccactcgcgggtgtaagccgtgtgcgtgagggtgagtgtggcgggtgaagccgtgtgctcgagggtgagtgtggcagggggcgtgggcctcagctgctcccgcatctgcgcaggtgtgagcacagtgacgggcaggccgggcatgctctgcctgcgaccacatgcctggctttgactcacagaccctctgaagggtcctggggaccccgagggccttggagcccatgtcgggagcccctgccttgagtcgtggaatcaggttgtcagccagtgagggagccccagagtccattgatccacggcggggcccgtggtctctccaggtcacggaaagaagctgcgaattggagaccaattggaaattgtttaaaaggaggacagcagctcacgtgcaggcctcgctgggacagcccatcctgccagatccacgcaacgcccccagctccccacactccctggcaaatcccagccctgcctgcgccctcccagctctcctgtcctgcactacacaccatcaacccgagttctgagcttctcctactctcagcctcagcctcactcgtcctcaggaccttgctctaggccgaggagaccagtgcccctgtgcaccagctcagcctgcagccccggccctctcgcctccccaggactgcacagggcatctcccttccccactgcacggtacaggccattctttctcctgtctttaaaaaaacaaaacacagatgccctgtacgccgcccccacctcccccaccgcacatccgcctggcagcaggctccctggaagcagcccgccttacccctcctcgaggccctgggcccatggcaggcatccgcagccgtccacctgcctgcacctctgagcagcgccaggcacagctggcggccacgcaccctcctctggctgtgggacgcccgtgctcagtctcttggtctttccctcgcccatgtgggcccctcactgctcctctgctgtgtctgcaccgctccctcagagctcttctcctggcctcagctccacacacaagtgcagctgcctggtgccgaaccctgggccgctacccccctccctgactgcctgccgggttccgccaccctcagtggctcagtggccatctgtcctcaagactgaaggcggagaccttgaggtcctcctggaccccctcttaactcccagcagaatctgatagactccccagccactgcagcaacctccccatcctcttcctgcctcagctagacacgcccaaccctttctggcccccacccctgcagctcccactgcccccatcacacacaccaccacgagcccctgacacgtttgccttcctgattttcatcatcggccactgcttcccgatgaaccctccgtaagcatgggttcatttccggctgtgtcggtgatgcctggcccgtgggaggtttgcagtcactgcggcaggtgaattggcatccgcaaattggataagaaagtcgcctgtttttctgagcctatttgctcctgtgaaacctgtttctaagcccaaaaatgccacctgaagactctgcaggacatcatttcatggtctgcccacaactgccaggaggcgattttcagttctttgaatgcacgttgtgactgccgtgcacccacccagcagcatcaggttcctcatattcacatagtgaccatgcagcatcaggtcacttgtccacgttgtgactcaggtcattcgtatccacattctgactgccgtccacccgtccagagtgtcagcttacttatatccacgttatgactactgtgcacccatccgctgcatcaggtcgctcgtgtccacactgggactgccgtgcacgtggccagcagcatcaggtcacttgtatccacattatgatcgctggacacccatccagcaggatcaggtcattcgtatccacattgtgactactgggtccccatccagcagcgtcaggtcattcgtccccagattgtgagtcgggtcactcgtattcacattgtgactactgtgtccccatccagcagcgtcaggtcattcgtccccacattgtgagtcggatcactcgtatccgcattgtgactactgtatgtccacccagcagcgtcaggttatttgcagatgcttttacagatgcttgaacttcactacaaagccaatttgcacgagaggtaagattggtttcatgcttgtttctggcatgttcaaggtgtttttctgttttacagaggtcctcaaagagggcagcgggctgttcccagatctcctggtgagggagacggaggccgtcatccacaagcaccgctcggccacctactgcgagcagctcctgcagcatgtgcaggccgtgccagccacacagtgaccacgctggtttcagccacggcacacccttgtccccacctgagccagagtttgtggcctttaaatctcataaacaaggcacctctgtgccagcagtgagactgtgacagcaagaatgtactcctcaggacacctgcccgctctttccctggaataacagcctctgagtggattctgcatgttatgtgatttgttctgttcatcgagagggctcccaaacatctgcagctgatttgaaattaaaagtaagtcgcagccgctcctcccgcagccacttcagcagcatcttagattttaagcctcacgtgcgcagctggttcatgaactattggctgcatcctgcttaggtgcccaccaagaaggtttttacctacttaacaaaaaagaaagaagccaaagtgattagaaagaaatgaaatctctttttgggttctgtctactgaaatttaatatctcagtgaacagactaaaaggaatttagaatcctaacaacttaccagatttctcctgttttaaatatactgggactttaaaggttatatgtccggtcaccgtatgttttaagtcggtgttaatgctaacagtgttgaaaacaatatttcatgagatctaattgtggttgcccctataggtagcaggaaagtaaagttgcatttccctctcgcacattctacacccaagtgcctaaaagatctcattgtaagtgggtagtgttaccggaagccattgtgttcacacgggggaaatgccgtatatatttttcaacaaatattaacgtttatactttcatgtttgaaaatttaattaaaaatatttgttttaatgattgtgtatgcctgactttgtgagttggtaactaaccgacatgtcaggcagggatcccagcctctagaattccagagttcctctgtggggtgtcgtagtgcccgctctggacaccagggggcaggagctcccaacacgttcggggaacacccctggtaaggagggccccataggactcaccttgagaggggctggggcatcagggtgagggcaggccagccttgggggggtgtcagggttgggggaggtcagccttggggggcatcatcagggtgagggcaggccagcgttgggaggggtgtcatggttggggaggtcagccttggggggtgtcagggtcgggtgaggtcagccttggggggcatcagggtgagggcaggccagccttgggggtgtctgggtagggggaggtcagcctggttggcagctggggtgtccaggtgcagagaggtcaatctggatgggggttggtttcagagttgggggacgtcaaccttgatggagggtgttttgtccgggtgggggaaggtcacctttgggattgtctgggtgggggaggtcagccttgggggaggtcagccttgggggtggctggggtgtccaggttgtgggaggtcagcctgggggggacgccggggtggagaggtcagccttggggggtgtctgggttgagggaggtcaacctcggagggtgtcagggttgggtgaggtcagccttggggggtatctggtttgggggaggtcagccttgtggtgtctgggttgggggaggtcagccttggggggtgtctgggttgggggaggtcagccttggggggtgtctgggttgggggaggtcagccttggggggtgtctgagttgggggaggtcactcttggggggagtcagggtgggaggaggtcactcttggggggtgtctgggttaggggaggtcacccctggggggtgtcagggttgggggagttcagccttggggatggctggagtgtccggattgggaggtcagcatgtatagctgagcctgccccatggactcacatcccctgccctagacaccctcgccaccctctggtccccttcagagttgcaccgtcatggctgttccctgcgccagcttctgtaactcgtggccacagggatttcgggggccctcaggggtggtcttccacctcttccttgtgtgccctttgacctctgtggcttctgccacgtccttgaagagccctcaagagcccctgggtcggtggtcctcggtggcgatggagccagtggcagcagcctcacctggaagcttgttagaaaggcacattgcagggcctcaggccagacctactgaggcagagacaggtgggccgcagtcagccctgcaggtgattctgaggctgcggactgggaggacccccacctgtgcaccaagcagttcccatccagctcccatccagcacgaggctccgtcgtctgtctctgtcacaagacccagaaatgaatggcagggagcttgcccgagaggacacacgtgtgaggggcccctcgacccctcggacgcaagtgcaccaacccctgggccgtccctcgccctgcatgctggggccacagcatgggaagagacatcagcgctgccgctccgtctctacacatctgtaaagggagctcccagggacctggcacgtccacaggtgcgtgtgttcagagaaagacggaaacccagcctacaagggttcacagacacccaagaggcattacgtccctctccacttaattctttgaaatgttgataggccgggtgtggtggttcatgcctgtaaaatccagcactttgggatgctgagtggagaggatcacttgagcccaggagttcgagaccagcctggggaacagagggagaccccatctctaccaaaaatttttaaaatgagccgggcgtgttggtggcccatgcctgtaatcccagcactttgggaggccaaggcgggcagatctcttgaggccaggaattcaagaccagcctggacagcattgggaaaccccgtctctacaaaaaaattttaaaaatgagtgggcatggtggcgcacacctgcagtctgagctactcaggagtctgagatggaagaatcacccgagcctgagaaatcgaagctgcagttacccaagattgcactcactttttttaaacaagtgagaccttgtttaaaaaaaaaattttgtaaatcataaatgagtgcattaatacaacatgtactttttttgtcttgcctctttcactcatcagttttgatgtccatctatgttggggtgtccatcaatagttcattcctttttgctgctgcgtaatattccattctatagataagccacagtgtgttcacccactcagcttttgacgtgtgtttgaggtctttccaggttttggctattacaaataaagcttcttccaacatttgtgtacatgtctttgtatggataggtactttcatttctcttggataaacatctagtagaatggcagtcatggtggatgtatactaaatttttaagaaactaccattctattttccagagtggcgggaccatttccaccagccctgtgcaagaattccagttcctcccatatttgccaacactagctaatcagtttttaattttagccattttaataggtacatagttgtatctcattatggttttagtttgcatttccctaatgtctaatgaggctgagcatcttttcatatgcttatttgccatctgtgtatcttttttggtgaagagtctttttaaatattgacatggtttggctgagtgtccccacccaaatctcatgttgaactataattcccagtgttgagggaaggacctggtgggaggtgattggatcatggggatggatttctcccttgctgttctcatgatagtgagttcttatgagatctggttgtttaaaagtgtgccttctctctcccgtcgccatgtgaagatgtgcctggttccccttcaccttctgccatgattggaagtttcctgaggcctccccacccatggagaactgtgagtcaattaaacctcttttcttcataa

SEQ ID NO: 38376 - DNA, 56814 bp, Homo sapiens
cagaccacttccacatgcagtcggagtctctgatcgggcccctgatgcagaccatctcccaccagcactggaaggtccgtgtggccgccattgaagccacaggcgcagtgatccattttggcaacgggaagtccgtggacgacgtgctttcccattttgctcagcgactgtttgatgacgtcccgcaggtaactggtgtttctcctggacagtctgttcctctctccaacacaggcgggctgacgtgctgtttttaactaactcacttgttcttttttcagagtgctgtatgcaccaaatgtcctttcattattcctagtcacaggacgttcctgttcacatcttggaaaaactagaagagagctgaactgttttaatgtttgatgttatgaattccaaggatgttagaaaggatgacttgtgtagttattgtctcttaggcacagtgtgcacttcagcagttgcagaaggttccttagtgctcccatccatcaagacgcactttcccgaaaagccaccatggttggtggacctggactgggagaagagtggagtcggggttggtttgttggggataattatgtcgttgggctttggaacccaccaagagacgggcaggcaggcaggcaggagtcctacagatggggctgagtgttggctttactgctggcagaatctggcctggagggcatgtcttggatctgaggccccagtgacttgctaaaatgctacacactgtggccaccggggaagctgagtgacctctgatctttctgtctctgagttacctgtcatcgtagtcagacatgtgatcttttgtgtctggcctcttcactgtgcatggttccaggtttcagccttgaagaggtaggtttcctgatgagaaatggcttgaaggtggtgagttgaagagtcactcggggtattctggggccaggatggaagccctgactcgctccctcgtctgtgctgctggggtccacccgtagggccggctccaggtgtgacatagcacctgctcaggacacccctgctttgcctccatggccaggcttcattctccggctctctccctccagcagcagagtggctgcctaggggctgtgcgcagagacacagggggaccctttcccaccaggagcctttgttcaccccccttggtctcatcaggccagcggaagttgagtcaccatgtacgctggccggcccctcctggagctggcgtgggttcggcaccaggcagcacagagggcccctgaggacatcaggctctgcccagtggggagaaagtgggcagagtgcggggtcagtgtccatgctgcccggcacttgcagcaggcacttctggcactggctaaatatttgggctgcggagggcagttcaaggggccagggcaagaacagagcccagcaagaagtgcaggcggccggctggtttttctctcccaccttccttaagcctgaggcagagcatggcccacaaggaaagtggagtctgtgtcatgggccaagtcttactcctcaaaacagtgtgatgactctgtatggagagctctgtgtgaatactgaagctccatagctgatagctgtcggtgtaagcctactgtcactgtctaaaaataaccatcactgtctaaaaataccgtcactgtctaaaaataccatcactgtatcgatagctgtctgtaaatactggaactctgtggagcacgctctgtaaatactggaactctattgctagctgtaaacggtgtaactcagtataactataccgtaactctaaaaataccataactatgtgtcgacagctgcctataaatgctataactgtattggtagctatgtataagcagcctactctgtatcaatagctgtctgttagaaagctgacatcacattgttgatctaaagcaagcttgtccaacctgcggcccgtgggccacatgcagcccgggacggctttgaatgctgcccaacaccaattcataaactttcttaaaatgttacgagattgtttttgtgatttttttttttcttttagctcgtcagctatcattagtgttagtgttattttatgtgtggcccaagacaattcttccagcatggcccgtttcttcccaatggggtttgcgtcctattagagaccctgcacggcccttcacgtgagtttcgtgtggagtcacggtgctgccccttttactctgatcagccctgcgaccccgtcctggagctccatgtgggctccttgcagacacctccaccccctcaacaacccagggactggtgccctgggaccccatcctctctgcacagaaggtcctgactgccttctgactcgtaggaaaccttccagcagcctgctagactcggcttaaatcactgaacttcactggaagggcctggaaataacttcatctcctccttacaaggctcagaggcctcagagctcactcaggtagcacagccaggtgagcctcagagcaaggtcaggacacaggcggtctagccgccctggagccttaggccccgggatggtgtctgaagttgtggaaagggggtgtcccagtgcggcaggggctaatgcatctccccacgctcacatgactgcagctccgagcccaggacactgaccacacccagaaccccggcgaggcaggcaggacggacgtatggccgtgcagttgtgaagcaggccttgaacaaactgccctgtgccgccctcaggtgggtgactcatggacttcgccctgcaggggtgccctggttgtcgccaggcctgcagtcggcagctgctcagctttgctgcagttttcctgctcgatgtgtgctgctggtgaggccaccaggcctgttcttgtcaagagagaccttccgggagcaacagatgttacaggagagactggggatgcatggacagcttttcagagatgagtgtttgtcacgttcctgccaagtacctgtttgccatttgtatgccttcttttgagaaatgtctattcagatctgtccatttttaaatcgcgttattagatttttttctattgagtttgagctccttatggattctggttgtcagtcccttgtcagatgggtatttgtgcagctgtttgctcccatcctgtgggttgtctcctcactattgattgttttatttgctgtgcagaagctttttaacttgatgtgatcccatttgcccaggccatgtcccagagagtttccccaatgttttcttttagtggtttcatagtttgaggtcttagattgaggtctttaatctattttgatttgatttttgtacatggtgagagataggggtccagtttcatttttctgcatatggagttccagttttcccagcaccatttattgaagaaactgtcctctccccaagatatgtccttggcacctttgtcaaaataagttcactgtaaatgtatggatttaatttctggcttctctattctgttccattggtctgtgtgtctgtttttatgccagtgccaagctgttctggtcgctgtagctctgtagtataaattgaagtcaggtaatgtgatccctccagttttttgtttgtttttgtcttgttttgttttttgctcaggatggctttggctattcaacgtctttcgaggttccatataaatttaggattattttttctatttctgtgaagaatgtcattggtattttgatagggattgcgttgagtctgtaaattgctttgggtagtatggacattttgggtagtatggacaatattgattcttccagtccatggagtatgttaccattttttgtgtgtgtcctcttcagttttctcatgtcagtggtttatagttttctttcttttttttgagacagtctcgctctgtcatccagggtggagtgcagtggtgcgatctctgcttactgcaagctccgcctcccaggttcacgccattctccttcctcagcctcccgagtagctgggactacaggtgcctgccaccgcacctggctaattttttgtgtttttagtagagacagtttcaccatgttagccaggatggtctcaatctcctgacttcgtgatccgactgcctcagcctcccaaagtgctgggattacaggtgtgagccactgcgcctggccttatagttttcattgtagagatctttcacttctttggttaagttaattcctaggtatcttattttgtttgtagctattgtaaatggaattactttcttgatttctttttcagatttgttaactgttggcatgtagaaatgctactggggcttttttggtgattttgtatcctgcaactttactgaatttgtttatctgttctaataggttttttgtggaatctttaggtttttccaaatgtaagattatatcatctgcaaacaagaataattatcttccttttcaatttggattccctttatttttcttgtctaattgttctagctagagcttccagtactgtgttaactaacagtggtgaaagcgagcatccttgtcttgctccagatttagaagaaaggctttcaatttttccccattcagtgtggtactagctgtgagtcttgtatatggcttttattgtactgaggtgtgttccttctatacccagttttttgaagatttttatcatgtagggatgttgaattttatcaatacttttcagcatcacttgaaataatcacgtagttcttgtccttcattctgccgatatgatgtgtcacattgatggatttgtgtatgttgagccatccttgcattcctggaataaatctcacttggtcatgacaaatgatctttctcatgtgctgttgaaacagtggaaactttgcgtcagtgttcatcagggatattgtcctgtagttttccttttcgattgcatctggctggttctggtatcagggtagtactggcctcataaattaagtttggaggtattccttcctcttctagttcttggaatagtttgagtaggagtgacattagttctttaaacgtttgataacatttggcagtgaaatattgcgacccgggcttttctttgctcagtggcttttcattgcggcttcaatatcattacttgttactggtctgttcaaggtttggatttatgatttaatctgtgtaggtcatatgtgtctaggaatttatccatttcttctaggttttccaatttattggcatatagttgctcacagtatagttgctcacagtgtagctgctcacggtgttgctcacagtgtcgttgctcatattgtagttgctcatattgttgctcatagtgttgttcttcatggtatagctgctcacagtgtcgctgctcacgatgtcattgctcacggtgtagttcatggtgtagctgctcacggtgtagctgctcacagtgtcgttgctcatattgtagttgctcatactgttgctcatggtgttcttcatggtgtagctgctcacagtgtcgccactcacgatgtcattgctcacggtgtagttcatggtgtagctgctcatggtgtagctgctcacggtgtagctgctcacggtgtcattgcttatattgtagttgctcataccgttgctcgtggtgttgttcttcatggtgtagctgctcacagtgtcgccgctcacgatgtcattgctcacggtgtagttcatggtgtagctgctcacggtgtagctgctcatggtgtcgttgctcatattgtagttgctcatattgctcatggtgttgttcttcatggtgtagctgcttacaacgtcgctgctcacggtgtagttgttcatggtgtagctgctcccggtgtagctgctcatggtgtcgttgctcatattgtagttgctgatattgttgctcacggttttcttcatggtgtagctgctcacagtgtcgctgctcacgatgtcattgctcacagtgtagttgctcacagtctctaatgatgctttgaatttctgtagtatcagttgtttgtaatgtcctcttcgatctctgattttatttacttgggtcttctctttttcttagtctggttaaaggtgtgttgattttgcttgtccaaaaatctaactgttcattttgttggtcttttgtattttttttaatttcaatttcatttatttctgctcttatttcttgtcttctactaattttgggtttggtttgctcttgctttcctagttctttacgatgcagtgttaggttgctgtttgaagttatctgctctttgaatgtaggtgctaattgctatacacttgcctcttagtgctgcttttgctgtttttgcatattgtgtttccattttcatttaagaatttttaaaatttccttcttaatttcttcattgacccaccggtcattcaggagcatattatttaatttccatgtatttgtgtagtttccaaagttcttgttattaatttctagtttcatgttttaaggcttgtttcgtggcctaacatatggtctgtccttgaaaatgatctgtgtgctgaggagaagaatgtgtattctgtagctgttggatgcaatgttctataaatacctatgaggtccattagatctatagtacagattaagtctgatgtttctttgttgattttctctctggatgatttgtccagtactggaagtggggcattgaagcctctagctgttactgtgttggagtctgtctctctctttagctctagtaatatttggtttatatatctggatactccagtgttgggtgcatatatatttaaagttgttatatcctcttgctgagttgacccctttatcattatatgatgacctttgtctcttagtatagttttcgtcttgaaatctgttttgtcttaagtgtagctattcctgctctttcttgctttccatttgtatggaatatcttttttcgcatccctttattttcagcctacgtgtgcctttttagtgacgtgtatttcttgtaggcaacagattgctgggtcctgtttttctttacccattcagccgctctgtcttttgaatggagagtttagtctggttacgttcaatgttgttattgataagtaaggacttactcctgccgttttgttgttttctggttgtttcgtggtctgctcttccttccttcttgccttcttgttttcctttttatgaagatgattttctctggcggtatgttttaatttcttttttgtgtgtgtgtgtatctgttgtggcgttttttatttgaagttaccatgaggcttgcaaataacataacccattattttaaactgatagctgaacactgattccaaaaacaagcaagccaagaaaaaaatgaataaaaactctacaccttaattttatgccctcagctttttaactttttgttgtttttacttatatctttgtcttgaaaagtcattgtagttatttttatttttatttatttatttatttttattgttttatttttgagatggagtctcactctgtcacccaggctggagtgcaatggcgccatctcagctcactgcaacctccgcctcccaggttcaagcgattctcctgcctcagcctcccgagtagctgggactacaggcacccaccaccacacccagctaatttttgtatttttagtagagacaaggtttcatcatgttggccaggcttgtcttgaactcctgagctcaggtgatctgcccacctcagcctcccaaagtgctgggattacaggtgtgagccactgcacccaaccagttagttatttttcataggctcatcttttagtctttctagtcaagatgtgagtagtttacacatcacagttacagtgttacaacattgtgttgttctgtgtgcttactgttaccactgagttttatccttttagatgatttcttattgctcctcagcatccttatttttcagattgaagaaccctctttaacatttcctgtaggacaggtctgatgttgatgaaattcctcagcttttgtttgtctgggaaagtctgtctccttcatgtttgaaggatttttcactggatacactagggtaaaagtttactttccttcagcactttaaatatgccaagccactgtctcctgcccagtgaggtctcctctgagaagtcgttgccaggcgtactggagctgcgttgtacgtgatttgttgttttttctcttgctgcttttagaaccctttcttcatctttgatctttgggagtttgattgttaaatgtcttgaggtagttttattgggttaaatctggttggtgttctgtagccttcttgtacttcagtgctggtatctttttctaggtttggaaaattctttgatattatccctttgagtaaactttctaccccgatttctctctacctgctcttgaaggccaggaactcttagatttgcccctttgaggctattttccagatgctgtacatgtgcttcattctttctattcttttttcttttgtcttctctgtgtattttcaaatagcccgtcttcaagctgctcactaattctttcttccacatagtcagttctgctgttgagaggctccaatgcattcttcagtatgctaattccttttttctacgccagaatttctgcttgatgctttttaattatttcaatatctgttaatttctctgataggattctgaattctttctccatgttatcttggattttgctgggcttcctcaaatagctattttgagttttctgtctgaaaggtcacctatccctgtcaccccaggattggtcaccggtgccttatttagttcacttggtgaggtcatgttttcctggatgctcctgatgcttgtggctgttggtcgatcttgctaggtatttactgtcatctttgcagtctgggcttgtttgtacccatctgtcttgggaaggcttctaatccatttattttgctttttagaaaaaaaaattgaaaaacgtcctgcttttttaaactcttatatggcagttcggtgttcagtgctgtttttgaactaaaagaaaagggataattcgtctcatgctaattggaatttgcaggtttcttatgatactaagtagagactgatagaaaaggtggcagtccgtgagactcaggagcagccccaaatcccggccctagctgtccttgctatcaggtgagatgtttgaagctcctttctgcaaaagaagcctatctgtgggttccgacagacaggtggccgtcctgggtggggccccgcagagaccctggcacacagtgcaggaggtcagggaggagaaagcagcgaggccaaacccagcgagttcagactgctccctggctgccggcctggggcagagtgtgctcaggccttgtggccctggacgcctgcccatctcccggagagggccccatcactgtacacctgtttgggctgggggctggctgcagtctggcttgtctcagccacgccctctgccccatcactgtatacctgtttgggctgggggctggctgcagtctggcttgtctcagccacgccctctgccccatcactgtatacctgtttgggctgggggctggctgcagtctggcttgtctcagccacgccctctgcctgacaggctttgcagcatctcagcacatggcactgggtgagcttggagtttgccgctcacctggattagcgtcgtggcaggtgcggccgtggcaggtgtcgactgcattaaaccctgggctgtctctgctcgagacctgccggcgccatgggtgaagacgacagtgacagtttgttctgtggggactctctagccaggtggtggaatggccgtggagctgatttgggtttctcttagttgttatctgggcatttgtatttgtggttgctagtaaggccctgtgtcagttaatgaccccggcaaacgcgccacacattcctgtgtcccctcgcgtgcttccctgctgctcgcacgccgagagtcgcctgtgcgcaccgcacgggcagcgggagtcaggcgcaacgggcctctccttgtgtgaacttgccctcccctcacgggaccttagtgacgagccctgtcagtcattctttcccatcttccaggtggcaatgaacttcggagcagtcaggccagggcccgggtcccaggccggcaggggcggatcctaggtgcgtctgcttggctctgggccttgttggagccggggcggagcagcccctcctccgagtcccagcgagtgaccacgccatgggcacagctgctgctcgggtcccctgcacctacgactggctgtgagcgctattgctaatggtgcatggctgggcagagacgcttcatccaaagtgtcaggagggatgaggctcctgctccccacggcccagccagggactgatggcaccacggagtcggcccctggcctcacaggggacagctctgtagctcgttcacaccccagagctcccaggatcagtctgcggctggcttcagccccaccgcttcctcacctggcttcttcctggccgttcccgcttcccttaaggagtgttggtgctggtccccgtctcaggcattgccctttgggagcttggctagagcacctggtgtgtgtgaagctggtttcttccgcctgcataggcaaggtaggcagaggccctcgtgccccctcttcagacacccagcagcagaactggggaccctactggtttcctccagagtccctgggctctgggaccagacgcctttgaggtatggccacggtgcaccacacttgctgtagccacggctcaccaagcacccagggtgagacaggcccagcccggccaggaggttttcatgcagaagactttgaacacgctgcacggctcaggtagcagctgggagcctgctctcgccaacaggaccaggccggggcacggggtatgtgtgtgtgagcctgcaggacagcagcattcctctccggcccagccaggagggactggcggagctggccgggacccaggcttggtggcgcccaggaccccggccacgcgcctctgtcttggggatggcatctaggcggtggtaggtggcccaggacctggccgtgcctctgcctcaggcagcgtccgtatggcagcactcagagccgcaccgtggcgtcagccccggcatcccctttgcctacacgaatccttatcccttcctctcatgcgcaggtccggcgggcggtggcctccgtggtgggcggctggctgctgtgtctgcgtgaccgttactccttcttccacaagctcatccctctgctgctcagtagcctcaacgacgaggtgcctgaggtcaggtacgtgggcaggcggccgcgggccttgtcttcctaaacggtcatgtgtagcagtggtggtttctctttgctcccagtctctcacagaaacctgctggtgtccctttgtccctgtgctccgaagggatgtgccgtacagaagtcgtctcgttttgtaaatggcatttcccatctttttaacattggactgagtatatcgacagagatcagacggccccctttgtgtactgtcagtagagtgctcacaagatgaagtggaatttctggtccaccttttctggggttggggagcttcccgctctcacgcaatggggtctttgggtgacccgtgtcctggcgcagccctgcggcctcccctgcgtgccctgccctgagccactgttgtctgtctgttgtgcctcaggcagctggctgccagcctctgggaggacgttggcctgcagtggcagaaggagaatgaggaggacctgaaggacaagctggactttgcccctcccaccccaccccattaccctccacatggtgagtgaccgcggcagaggggagcgccaggaggcgagcccttgttgggtgggaaaggggcttctgagcctgaaggaagcttcagctcttgcagttctgagcccaggcggccgcgtcggaaaggtgcaggcgtctccccactgggctggggctcctgcatcctgggcagagcacgtctctcctcagcatctggagagcccccatgtgccttgcagtgacctctcccctcctctggccagctttattttaaaaaggctgtgggcttctgaaagtgtccagcgcactgccagatggtgtccgcccccctccgttggctgtgcacacaagggtgcattgaactctgggttcctgggcagctctgctggtggttggggggtgttggaaacagtgggatgaggggcttatcatttcaccaagacagagctcagcacgagggccacgggtgaggtgaggtcttcttcatggttccacatgatttccaacctgggaacagggtctcctgctgcgtggcctccccgcccttcccacatttgctccctggccatgttgcgggcacccatgtgcatctctccgcagagcccagcaggtctggctgagtctgagtggaggctcccaggtccagccccaacacatttgctctgccacgccgccggcccaccttgggcttcatctgtttagaaaccgccctcctctcgcggggctgagtgtcttccacttgcacgcggtcaagtgctttcatcacttgagtctatctgcggggcatcttcttaaaagtaaataatagatacgcactgacgaggacaaaaagtaggtgaagcgcagcccacatcagatgcccagcccaaatcagatgcccagctcaaatcagacgcccagctcaaatcacatgcccagctcaaatcagacgcccagctcaaatcaatcagatgcccagcccaaatcaagacgcccagctcaaatcacatgcccagctcaaatcaatcatgcccagctcaaatcacatgcccagctcaaatcaatcatgcccagctcaaatcaatcatgcccagctcaaatcagatgcccagctccaatcaatcagatgcccagcccaaatcagacgcccagctcaaatcaatcagatgcccagcccaaatcagacgcccagctcaaatcacatgcccagctcaaatcaatcatgcccagctcaaatcacatgcccagctcaaatcaatcatgcccagctcaaatcaatcatgcccagctcaaatcagatgcccagctcaaatcaatcagatgcccagcccaaatcagacgcccagctcaaatcacatgcccagctcaaatcaatcatgcccagctcaaatcacatgccccgctcaaatcaatcatgcccagctcaaatcaatcatgcccagctcaaatcagatgcccagctcaaatcaatcatgtccagctcaaatcaatcattcccagctcaaatcagatgcacagcccaaatcagatgccctgagagatttgcagtctcaacttacttcccatgtcacctccctggcctagttgaggcgctgaagtagcccggggtcaggtcctggagggaaatgtattccgtcaaatacagcattaaagtagcttcttggccgggcacagtagctcacgcctgtatcccaactacgcggggggccagggtgggaggatcacctgagcccaggagttggagaccaacctgggcaacacagcaagactcctactttacaaatattttaacaaaaacaaaacaaattagctgggcgtggtggtgcatgcctgtatcccagctgctccagaggctgaggtgggaggatcgcttgggtccaggaagttgaggctgcggtgagctatgaccacacccctgcactccagcctgggtgacagagtgagaccccgtttaaaacaaacaaacaaacaaaaaacagtttctcatgtctggtattgatgtttggtgccctgttaaatccacgcctacagagccgtggctcctcccgagcctgtgaatcacagggttgcttttcctcccggtcggcattctccaccttgcagccccaccccacgctgcacagttgctgtacagggaaagcacacatgtttggaaaaggcacagaaattagttgcaagcaaggtttgttctgatggagtgaagccagtgagaacgctcgatctttttttttttttttttttgagacagagtttcactcttgttgcccaggctggagtgcaatgactcagtctcggctcactgcaacctccaacttccaggttcaagcgattctcctgcgtcagcctcccaagtagctgggattacagccactcaccaccacgcccagctaattttgtatttttagtttatatttatttatttatttttgtttcaataggtttttggtgaacaggtggtatttggttacataaataagttctttttttatttttttattatttattatttatttttattttattttattattattatactttaagttttagggtacatgtgcacaatgtgcaggttagttacatatgtatacatgtgccatgctggtgtgctgcacccattaactcgtcatttagcattaggtatatctcctaatgctatccctcccccctcacctcaccccacaacagttctcagagtgtgatgttccccttcctgtgtccatgtgttctcattgttcaattcccacctatgagtgagaatatgcggcgtttggttttttgttcttgcgatagtttactgagaatgatgattttgaatttcatccatgtccctacaaaggacatgaactcatcattttttatggctgcatagtattccatggtgtatatgtaccacgttttcttaatccagtctatcattgttggacatttgggttggttccaagtctttgctattgtgaatagagctgcaataaacatacatgtgcctgtgtctttatagcagcatgatttatagtcctttgggtatatacccagtaatgggatggctgggtcaaatggtatgtgggcgaaggacatgaacagacacttctcaaaagaagacatttatgcagccaaaaaacacatgaaaaaatgctcatgatcactggccatcagagaaatgcaaatcaaaaccacagtgagataccatctcacaccagttagaatggcaatcattaaaaagtcaggaaacaacaagtgctggagaggatgtggagaaataggaacacttttacactgttggtgggactgtaaactagttcaaccattgtggaagtcagtgtggcgattcctcagggatctagaactaattttgtatttttaatagagacagggtttcgccatgttggtcagggtggtctcgaactccagacctcaggtgatccgcctgcctcagcctcccaaagtgctggtattacagaggtgagccaccacgcctggaccactcaatctgttttaaaatgtggaacttagacacgaggccacttacgaactcactgttgaactcacactcttgtctctgcatcagtgatgggagtggaatcccacgcgtgctgtggtgctctgtcagtgcctctccctccagccgcctgtggtgggcttctgcgttggtcggacctttaagctaagctgtgggttgtttgctcctggtgatttcagctgggctctcctcaccaatgaggaaatgctgctccttagagagggtccagcctgtctgcctaattcatgctacacggagcccaagctgcatggcaaatcgttctccacgtgctcactgagaaaccagtggaagacccttcaggtgtcagtggggcaggaatggcagtccccaagacccaggagggtccagtccttcccgctgtgcaccggagagggaggcggggggtcggggggactgtttctggaaggtacgatctatgatccttggaatgcggtaagggagaagacagagcgaggcgcacacgcatacacacacacacacatattcacatgcatgcacatgtacacacacacctgtgcacacatgtacatgcatatcgcacacacgtgcacatatgcacacgtgtgtacatgcatatcgtcacacgcgtacacacatcctcgcacatgtgcacacccatatacacatctgcacacgtatacacatacacacctgtgcacacacgtgtacatgtatatcctcacacacgtacacacttatcctcacacacgtgtacacacatatacacatctgcacacgtgtgtacatgcatatcacacgtacgtgtgtgtgcacatacatgtacacatgtacatacacatcctgccctaccccgccaactgtctggccctgctagtaggttcccggaaggggcttcctccctgtggtggaaacacaggctctttggaggctgcctgatttagaattggttcaaggacttgggaatgttcctgactgataattacaaaaacacagttagttatccgtgccgaggcgtagagagtgtcgttaggcacagaacttttgtttcaagtggagcagagtaaatttagaattgaatgacagtcagtcagtcgcataagcactacgttgtgttagatttttggcattttctcctcaaattacttttctccagtctgtagatttgaattttaaatacgatttctcagatttttttctacagtattttaaatgtcagatcagaagattttttgagtctcttcctcagaagtttgcactggccctgtattgccaagcacacaccctccctgccgtcctgccaccccccgcctgccgtgcccagggtctgtgacgctctccttactgtcttgcccccccctgcccgctgggcccaggctctgtgtcctcactttcccccgcccgtcatgcccagggcctgtgacgccctccttaccgtcctgctgccccccacccaacatgcccagggcctgtgacgccctccttaccgtcctgctgccccccacccaacatgcccagggcctgtgacgccctccttaccgtcctgctgccccccacccaacatgcccagggtttgtgacgccctccttaccgtcctgccctgtccagcgtctgtgtcatccctttcccccgcccgccgtgcccaggctctgtgtcgtcccttttccccgcccgtcgtgcctagggactgtgacgccctccttacggtcctgccaccccccacccaccttgcccagggtctgtgacgtccttaccatcctgccaccccctgcccaccctgcccagggtctgtgatagcccttcccccgggaccacgctgcattcacccttcagggctgcagctctgtgagttttgagcagcaccgcctctgtcccctgcatgtgggcatctccaccgcccagaactgctcatgggccctggcactgctgctgtgggctgcgtcctgtgtgtcccttccaggatgtcacttgcatgaggttgtgggagcgtggccgctggcgtctgctctttcctctctgtgtcggaggctcatgcatggcacctgtgtctgcagcactttccttcttcgcgtgagtcacgttccctcccgtggatggaccatctggtcaccagcaggggcatattcgggtcctttctagtttttggccatcacaggtaaagctgatgtaaacacttgcagactggtttttgtgagagtgttttattggataaacactcaggcgtggggttgctgggccataggtacagtccttactttgttagaaactcaccacacactgttttccacacccttcgcgccatgtcgcatccccacgggcactggatgagatttccaggtgctgcagtcaggccagcgtgtggggtggagtttgctgtttttagtgtgtcggttggtgtgcagtgttggcacacggtgttggtgtccagtgttgacacacggtattggggtttgctgtttttagtgtgtccagctggtgtgcaatggtggcacagggtgttggtggggtttgctattttcagcgtgtccggctggtgtgcagtggtggcccacggtgttggtggggtttgctgtttttaccgtgtctggctggtgtgcagtgttgtcacacagggttggtggggtttgctgtttttagtgtatccagctggtgtgcagtgttgtcacacagggttggtggggtttgctgtttttagtgtgtccagttggtgtgcagtggtggcccacagtgttggtggggtttgctggtttcagtgtgtccggctggtgtgcagtggtggcccacggtgttggtggggtttgctggtttcagcatgtccggctggtgtgcagtggtggcccacggtgttggtggggtttgctggtttcagcgtgtccggctggtgtgcagtgttgtcacacagggttggtggggtttgctggtttcagtgtgtccagttggtgtgcagtggtggcccacggtgttggtggggtttgctggtttgagcgtgtccggctggtgtgcagtggtggcccacggtgttggtggggtttgctggtttcagcgtgtccggctggtgtgcagtgttgtcacacagggttggtggggtttgctggtttcagtgtgtccagttggtgtgcagtggtggcccacggtgttggtggggtttgctggtttgagcgtgtccggctggtgtgcagtggtggcccacggtgttggtggggtttgctggtttcagcgtgtccggctggtgtgcagtgttgtcacacagggttggtggggtttgctggtttcagtgtgtccagttggtgtgcagtggtggcccacggtgttggtggggtttgctggtttgagcgtgtccggctggtgtgcagtggtggcccacggtgttggtggggtttgctggtttcagcgtgtccggctagtgtgcagtggtggcccatggtgttttactttgcgattccctaatgagaggacattggggccttttcctgtgctgtggtgtgcttctgtgcacccgtacgtcgtctttggtggccattcagaactgccatccattaaatcgagttctgtgtttctgagtgcggagtttgaggaccccttccgtgctctggatgcaggtccctcatcagactgttttaggctccacagccaggcctcagctccagctcccgctcctctcctcagagctccggcagctgccgcccccatcccccctgctctgtttcctcctgccccctaccacagtggaggtgctccttctcctcggtggactcgggccctgtgctcacctcaccgctcgctccaggggccagtctgtctgctgccatcctctgcacccagaggcggtgagccaggcttagtggctctgtgagcacccagcgagctgatgagtggctgcgtgtcctgtcttaccagcaagaacggacagtccaaccgtgtggttgggttgccgagtgcgtgaacaggcaaagttcggtaatattttcagaccactgctaatgcagacggtgctcagaggtaatgacctatcaataaggaattcacatgggcctggatctgaagtttcatcagagtccagttttcctgtttcctaagaaaataaggtacacaccatgtggaaatataattcgtaccatataatttgttgttagctttgcagacacagcgtaagtttccattaacagcactgaaacctccgccttaaaaaccaagcttcgtgctgggagggttgggagggcaccacttaccgtcctcaagtcggtcatttccctgaacagagtgcccttctcacacggaagcacacgttcacgcctggtgtgtatctgacaatcacactgccagccgccagcagcagatggcttggtgacagcggctccagagtcctttctgctttgagattatccctctgttaagattgttttccttggcaatgcctgagcgtaaaggaaagcgtctcgatgctggtgagtggccggccagagcttttcacacaggaggacagagttggctcttcttaaagcctgacttagaagtgagcagggttccctgtggatgaacgctgccacgtgacagccttcccccttcattctcctgttctgccttggagctcgcacccattctgctttgcttgtgtgtttcatccatgtgtttggaaagatggaagcttgaatggaaattgtcagaaacgttacgttgtgcaaatgggctggaaaagctggttaacattgtttgaagccagcaaggtcccacgagcattggcccactctgagttagccgggggtgttacagaagaaggaacttctttttctttttttgaggcagacttgctctgtcacccaggctggagtgcagtggtgcgatcccagctcactgcaacctccgcctcccagattcaggcaactactgtcctgcctcagcctcccgagtagctgtgattacagacgcgcaccaccgcacctggataatttttgtgtttttagtagagacagggtttcaccatatcagtcaggctggtctccaactcctggcctcaggtgatccacccgccttggcctcccaaagtgctaggattacaggtgtgagccacggtgcccagcctatgtctgctataatattaagtatagaaaaacaggcttcagaaccatgttcagaagcatgtgctgagtaacagcgtttgagtccataaggaccacgtggaggagggtggtcccctctgatagtaacattgtgtttctcctttttctgtgtttggaaacactcactcactgtctgtgctacagtttctgcgtgttgagtgcagtcacctgctgcacaggttcgtggcctaggagcctcacaggctatatcgcacagcccaggcatcgcacagccaggcacgtaggaggctgcgccatctaggcttgtgtacgtcactgtagtacgttcacacggcaacgaaatcacccaatgacgtgtttcccagaacgcaccccccaccgttcagcaacgcttgactgtaccagcggtcccctgccattttggcaccagggactggttttgtggaagacaatttttccatgggtggggcagggagcagggtggtttcaggttgaaattgttctacctcagatcatgaggcattcaattctcataaggagcacgtaacccaggtccctcacacgcacagttcacaggagggtttgccctcccctgagaatctcatgccgccactgatctgacaggaggtggagctcaggcggtcacactccttcaccatctgctcacctcctgctgtggggcccagttcctaacaggccttaaaccagtcccagcctgtgtccaggccttgcgtacccctgcccagcaccggccagtatttctttggaaacacccagaagcccaggtgcccacaaagctctgttcagctgtcagcagacccctccccggctgttcctggtcacgcatctctcattttgcaaactttccagagcggatcgtcatcaggaagaaaggtgcagctgggcgtggtggcgcatgcctgtaatactgaggtcaagagttcaagaccaggctggccaacatggtgaaaccccatctctactaaaaatacaaaacttagccaggtgtggtggcatgcacctgtagtaccagctactcaggaggctgagacatgagaatggagaattgcctgaactcaggaggtgaaggttgcagtgagctgagatcgcaccattgcactccagcctggatgacagagcgagactgcatttcaaaaaaaaacgaagagaggtgtgtttgcaccctggcttttttgttttttacaaaatgatgacaggatcatttaaacagccagcagaattttaattatttggaactaattccataatacaggataaaaacagaaaaataaccagaaaaaggttaaaaatggggtgtcctggtacaagctgttcttattaaaacataccctttagcctggatgcagtggctcacacctgtaatcttagcactttgagaggccgaggcaggagggttacttaagcccagaaggtcagtgctgcagtgagctgtgatcgtaccactgcactccagcctgggtgacagagtgagaccctttctctaaaaatagaaaaagaccctttaaatcctgacatatcatggtttcatttctatctttacagttgttctgaatttttttttttttttttttttgagatggagtctcactctgtcgcccaggctggagtgcagtggtgtaatcttggctcactgcaacccccacctcctgggttcaagtgattctgctgcctcagcctctgagtagctgggattacaggcgctcgccagcacgaccggcttattttttctatttttagtagagacggggtttcaccatgttagtcagggtggtcttgaactcctgacctcaggtgacccgcctgccttggcctcgcaaagtgctgggattacaggcatgagccaccgtgcccggcctgaattttgaagatcagaatcttttcatcaaagtccctgaaggcttttctgtagaaatcgacaaactgattgtgaaattctcgtgggcgtgcaaaggacccacagctgccgaaacactggggaggagtgaagctgaatggcagcaggtcctgggtgcaagactcacaaaaccacagtcatggggccacgtggtgttggctttcagaccgatgagcagaacgagagcgtccagaaacaggcgcccgcacgcggaccactgacttgatgaaggctcaaagaccatttaatggcatcttttaataaggatactgtaaatgataggatcactcatacaccagaaagtgaacttggagtcaaaaaattaaccccagatgcgtcagggatctgaaggtaaagcccagaaccgcagagctagggcgaagcctttgtgacagtgggccgggccacacttcgtgggatacgtcctcaaaagaccgcagagtgatgacgaagcctttgtcaccgcgggccgggccacgcttccctgggtgcatcctcaaaagactgcagagtgacgacgaagccttcgtgaccacgggccgggccacacttcgcgggatacgtcctcaaaagaccacagagtgatgacgaagcctttgtcaccgcgggccgggccacgcttccctgggtgcatcctcaaaagactgcagagtgacgacgaagccttcgtgaccgcgggccaggccacgcttccctgggtgcatcctcaaaagaccgcagagctaggacgaaggcttcgtgaccgtgggccgggccacgcttccctgggtgcgtcctcaaaagaccgctctgtaacagggtaaagcaatgtgtggacttcatcaaaatgaacacttctgctttttcaaaggcctgttgaaaaaacgaaaagacaaaccaaagactgagatgtttggagatgatgtatgtaaggatttatctccagagtataggaagagctcttgaaactcagcaggaaaacaatccatttttttaaatgggcagaaaacaatttggaaagaccctttaccagggaagataggcggcaaacaagcctgtgaagaagacgctcggcgtcgttagtcatcggggaatgcaaaggaaaagcacacggaaatgccactgtgcctctcggactgctttcaattcaagactgagcgtaccgcgtgccgctgagagtgggaaggagcgcggactggctcaaacactttggaaaatggttggacagtttctaaaacagttaaacgtgcaccttccctgtggcccagcccttccacagctggtatttgtcccggcacagtgaaagcccaggccacacagacttgccctggacaccatttgaatgcttctccacagaggagcgggcactaaactggcatctccccagaacaggccacttcccaggttcagaaaggagcgggcacaggcgggcctcagaaaacgatgcagagtgaaagaagcggagaagggaggagagtgaacgagaggcttccacttgtgtcaggctctagaaagtgcagctcagtcacgggacagatccaggggtgccggggtgccttgggggctgcagtgcagaggagcagaggaagccgggcgaaggacgcagctgtcacccccaccatgccgatggcttcgcagccgtgtctctcatatggcgatggcttcgaaggcatgtctctctgatcatatggggacggcttcacagacgtgtctctcatcatatggggacggcttcacaggcgtatctctgtcatcatatggcgatggcttcgcaggcttgtctctctgatcatatggggacggcttcgcaggcgtgtctctctcatatggggacggcttcgcaggcgtgtctctctgatcatatggcgacggcttcgcaggcgtgtctctctcatcatatggcgatggcttcgcaggcgtgtctctctcatcatatggggatggcttcgcaggcgtgtctctctgatcatatggcgacggcttcgcaggcgtctctctctcatcatatggcgatggcttcgcaggcgtgtgtctctctgatcatatggggacggcttcgcaggcgtgtctctctcatcatatggcgatggcttcgcaggcgtgtgtctctctgatcatagggggacggcttcgcaggcgtgtctctcatcatatggcgatggcttcgcaggcgtgtgtctctctgatcatagggggacggcttcgcaggcgtgtctctctgatcatacacgtcagcacgtgtggcaagtgtgttgtttgcatctctgtgtggctctaaatgtttgttttttgagacagggtctcgctctgtcacccaggctggagtgctgtggcgcaatcctcccacctcagactcctgcgtagctgggaccacaggcatgcaccacggcacctggctaatcttcctgttttttatagagatggggtctttgccatgttgcccaggctggtcttgacttcctgggctctagtgatccacctgccttggcctccacagggctaggactgcagccgtgcaccgcctctgtgaatgttctgaacgacggggcatttgtcagctttgcgtccaccccaagacttgttttgaaatggtgaggttgaaactcacaggtgtcccttaaatgtgatgtgcggtaacttgagttgttgaggttttgcttgtgaatttctcattcttctttccctttttcgttccagagcgccgccctgtgctgggctgccgggagctcgtcttcaggaacctctccaagatcctccctgccctgtgccacgacatcaccgactgggtggtggggacccgagtgaagtcggcacagctgctcccagtgctgctgctgcatgccgaggaccacgccacgcagcacctggaggtcgtcctccggaccctgttccaggcctgcaccgacgaggaggcagccgtggtccaaagtgtaagtggccgtattccagtcgtggtcgcggagctgtaactcgagcttaagatcccgcctctgtggtgtgcggggcccgaggctgtactgtagccaagacagcgttcccctcacccccgggccgcaggccctccccacacccagcccctgggaacaactgatctcctttctgtgcccgtaggtaacagcgtgttgagggtgaacccttcatgctcattttcaagcacactcgggggtgcagtgccaggtgcatgttgtgtagacgtgttgtgtagacgtgccgtgcaccagacagacagggcccgggctgctgacacaggaccgagatgcccagcgttcagcattgacatctggactgtcctgagggcccttccaggcctcgcaggggctgtgggagcacccagacgggggatgatggcacagcttcgggtgtcctgcgagtggtgtccctggtgcagtcctctttctcactccctgtccacactcggctgctggttatcgcctcgtcaccactgggtacgcacgagggagtcccatgctcaggcctctcctcctcactaggccgggccacgccctgcgctgacagtcaccaccatgaggacttcacacccacctcacaaggatgcttcctagtgctcaggagaacaactaaagctttgacttgagatttcagttgaaaatatcctcatcttgaaccttaaattccattgcaaggtagcctggccagcagcttttacttctagtggtccaggtcactgttactagcccagcgtagtggcgtgcacctgtggttccagctcccgggaggctgaggtgggaggatcgcttgagcccgggagtttgaggcctcagtgagctatgattgcgccactactctccagcctgggcgacggaatgagacgctgtctcagataaaacaaaaaaatctaaatcattgtgactgatttaaagtaaatgttccaggttccatgttatttacatgtcatgtttctgcttttcaaaaactaccgtgaatttaaaattgtctgtagttctctgtggaacctacaggagagcaagagacacgggggtgaggctgagaggacgagagacgtgtgtgggatccgctgtggaatcccacggtgcagaggggctggtgtgtgtgtgatccactgtggaatcccacagtgcagaggggctggtgtgtgtgatccggtgtgaaatcccacggtgcagaggggctggtgtatgtgtgatccgctgtggaatcccacggtgcagaggggctggtgtgtgtgtgatccactgtggaatcccatggtgcagaggggctggtgtgtgtgtgatccgctgtggaatcccacggtgcagaggggctggtgtgtgtgtgatccgctgtggaatcccatggtgcagaggggctggtgtgtggtgtccactgtggaatcccatggtgcagaggggctggtgtgtgtgtgatccgctgtggaatcccacagtgcagaggggctggtgtgtgtgtgatccgctgtggaatcccacggtgcagaggggctggtgtgtggtgtccactgtggaatcccacggtgcagaggggctggtgagtgtgtgatccactgtgggcttccacggtacagaggggctggtgtgtattgatcagcttagtgatgggaaggttgggtcactggtgtccgatgaggggtgtgtggtgaaccccacagctgggacacagcatcctttgggccagacttcactgcctgggaggcgtgtccggctcgctggcctcagggacgttctgagaccacacccggacccttgtacctttcctgagggctctgagcatgtgccaaggactcactctgcctaacacggggctctgtctggtgcacggctgtgtctgggaggccacggcgccgagagcaggagcccggctgagaccctcgggtttggctctgagttttctcatgtttctttctcgcagtgtaccagatccgcagagctcgtcgggacgtttgtcagccctgaggtgtttctgaagctgatcttatcgacgctgaagaagacgccctctgcctccggcctcctggtgctggcctccgccatgcggggttgcccccgagaagccctccagccgcacctggcagccatcgccacagagctggcacaggcccacatctgccaggcatctgaaaacgtaagagcacttgggagatgcgggagtggagaggaggagcctcccctgcccggccgtcagccatcgtaatgacatgtctgtgggttgccctgtgccgccaggctgggctgtcggaagcacccagcgacgtgtctgtgggtccgccccgtgccgccaggccgggccatcggaaacacctgcagtaaccggagtgccctcgctgatagcccttgttccggggcctcgtcctgggctgtgcagagctccagccccagccccagccccagctgcaggcggccgctcacgtttacattcgttgctgcccctttcttggccacacaccacagttcacgtgtttgatgactcaggaggcgtccatggccgggaccctctggcccatgctgctgggggtagatgtggggtccacgtcatcccacccctgaggagcgtggtcgcacgtccaccatcccatccagtccccagggtacctgcacagatcgcacgtcctcagggggcactgacagcctgttccccatcagccctgcctggcgttccgatctgtgcttctcacagcccagctgaggatttgccagagacatttgtttaattttaaattgagcagcaaatccttgagctcagaagctggaacagcctgggtagttgggctcaattgtttggaataatccatagttgtattccatggaagaagaggtgatggctttgctttcatttgaaggtgagtggtccctgtcagtgtgtgtgttggactcagcaccccagatatttctgggacacagggctgcccccaccaggcggccgtgccatgcagggcgggcctcagctcacccctggaggcacttgctccggctcgatcgtttccggcggcttctatggccccaaagctggcctggggcacggggacttgccactgtgctctcagcccggcctgtcctgtgtcaggctccctctccgtcctcagaacgagaggtggggctgttgacagtcatttttgtaaactgttttaagaaacctgtaagcagttcctggaatacatagagggaaggaaacggagctggggtaaggaagggagcgggggaggggcccgggccgcgtgctcatggcatttcagccatgcttcagcttttcccaaaacccgtttttaacacatcatcgaatgtgtgtcagttctccactttccttcacccacgaggggttatgaggatgcctttgatttctgtatacagatttgcaagccagaagcattttttcctagaagggcataacttgaaaatgtgcacaggtgcctaaatccttatctcacaaactttatagcaaagaaagtgtagttttcacatctccatgttggttacaggaaaacggaattgtgtcatcccacagttgtgcatttggctccccatcttccagttttatcgaggaaaaatttaatcacaatctttcaaacagagacgtctttctgacaaagtccagtcacacgggacccctgggaagccagcctcaaccttccaggctgcgaacgtgtgtcggccctttggccaaggagccagtcacagtgaaaacccaagacgtacatttcactcctttcttgtttttatttttttgttttaggttgatcctcccacctcagcctcctgagtcactgggactacaggtgtgcaccaccacacctgggtaatttttttttatttatttttatttatttactttttgggacagagtcttgctctgtcacccaggctagaatgcagtggcgcaatcttggctcactgcagcctccgcctcccaggttcaagcgattctcctgcctcagcctcccaagtagctgggattacaggcatgcaccaccacacccggctaatttttgtgtttttagtagagacggggtttctccatgttggccaggctggtcttgaactcctgacttcaagtgatcagcccacctcggcctcccaaagtgctgggattacaggtgtgagccaccgcacctggccccattttactccttaacagacttaaatttttggcaagaaagggtgaaggtactcaggtctcagtcagaatcaggcccgtggttctgtgctcttcccacgcccctgtgctcttcccgcggccggccgggctttgtgtcatgtcatttgggaagtcgattatgtttcccacagctattctccagtagctatgagaacaggttgaaaatgtctttcaagaacaaaccgaaattgttttaaaagctcgtgtttaaacagagaagtccgtgtaaatgtattctaaactgagcctggcttcactccctgccctggggttcacaggaaatctggctttagcagtaggtacttccaggtgtctcgggcccagtaggtcccctagagctcgacagacgggaactggagtctcctgggaaggagtttaggacaggtgtctagagtgaggaaatgggtaactcaccgatttgcttctcacacagggaagccagcagttgtgggatgccattgccattgttgaaataggagtctcttgtgcttttctgaattaaaaacctttgcagtcttagataacattgtttcagaaaacaatgtttgaaatagtatttcaaaaaatactgagaattatttcctgctgtatcttttttctttttcgttctgtgtgtgtgcgttgtatgtaggcagacactgaaaattgtctggtcaaatatagagaaatctataaatgtgaagtcttgtcacttcctcagagacggtgctgcgttcgtggcaggagggtggtgcttgctgcaaaggatgcctgattccctgtttgttcctgtgcttggaggtgtggtcagccaggaggggctgtgtcttctaaacgcacctgccttttgattttaaccgaaaagatgatcgctcctgaaatgtacatgacaggtcattctagaaactagccagatattgtcctcagaagtcagccagttagtacaggccttagagaaattgggctgtgggaaaaatcaggaatggaataaaaacaaatctgtggcttctgtgggagttggggccacgacagggccacacggctcctccagctccgagggagacggggccgcgcggctcctccagctctgagggagacggggccgcgcggctcctccagctccgagggagatggagccatgcagctctgtgtcttctgtgggtcagggcggggccggggtgcaaggacagaacgctgctgtagtacagtgggagtgttttgtttagtcttccatgatttacgtcagtggggaatgaggcttagagttttagagctgattaggaaatttagaaccaacccattgtctagccaaataattaccaaacttctttgaacttgcacccccattagtaaaaacagtttttaagcataggcctccaatatatgtacactgttgataaatcacgtgtttaaattacatggccacggtcctgactcactctgtactttatgaaacatacataaaatagacattagagggacgttataagaagtaaatacaggccaggcgtggtggttcttatctatgatcccagcactttgagaggccacggcaggaggatcacttaaggctaggagtttgagactgcagttagccacgattgcaccactgcactccagcctgggcgacagagcaagaccctgtctctaaaaaataagttaaaatttatttagaaagaagtaagcacacgcaaagccttaggaattcttgggtccagcacacgcctgctgtgttgcgggcttcagagcctggctgattcacagtggatgaggctggagccgggaggggaagccattcatccagcgcagccgtaggtgcagagctgagactccacctccccgtcaatcagtaaacatgttaagccatagaattttatttgtcttaaaacttggtgttatagaaaagctcaaaaatgcacagaagaggggcaggcagcagagcgactgccagcttcagcgctgaccagcccttggcatgcgtgttctgcctgcctggggccacttttctttttaactttggagggcggggagaacttgggcatgttgtaaagcagataatgcagtgcgccgtcatttccctcacaggtgccgtgtgcatcactaacgcagcttctccaccacatagctcaagtgcctgttcacatttcacaaaataagcacagattccttagctcccagtctgtgttcagttttcccatcaacaagcacgcccttttatggttgacatgccggcaccctacctccagcgcctgggggctctccctgcaagggctctcccatggctgctgcccctcgtgagccgtagactaggagccccgggcgggctctgtcggccctgacactggggccggagcgggagccctgtattagtccattctcatgtcgctaataaagatctaccacagactgggtaatttataaagaaaaagaggcttaatggactcaaagttccacatggctgtgcaggcctcaccatcatggtggaaggcaaaggaggagcaaagtcacgtcttacgtggcggcaggcgagagagtgtgcaggggaactgccctttatactaacatcagatctcgtgagacttaatatcaagagaacagcacgggaaagacccacccccatgattcagttccctcccacagggtccctcccaggatacgtggggattatgggagctacagttcaagatgggattcgggtggggacacgaccaaattgtaccaagctctgacggtgctgccggtctcttccaggacctctacctggagcgcctgctgctgtgtgtgcaggctctggtgtctgtgtgtcatgaggactgtggcgtggccagcctgcagctcttggacgtgctgctgacaatagtggccctcgcaggtgctaccggcctgagggacaaggtaaggctgacagtggtggctgctgcttgacctagcggagctcacagctggaaggcatctctaagtgaggtgaactgtctcctatgcatcccctctgtgcttgaccagcaaagaccagggattgagaaccttgcgggtgagtccccgggcaacggccttcggggcagctctccagctgccagtgtattctggcatcagggagtggagacagctgtttaatgttagggtcttcagcaaagaagcaaacaagaaataagacgtaacctttaaacctgcgcacttgagtagggtttaatagtgcacatgtcgctgggcgtggcatctcacgcctgtaatcccagcactttgggaggccgaggtgggcggatcacctgaggtcaggagtttgagaccagcctgaccaacatggtgaaaccccgtctctactaaaaatacaaaaaattagccaggcgtgttggcatgtgcctgtagtcccagctactcaggaggctgaggcaggaaaattgcttgaaccagggaagcagaggttgcagtgagccaagatcgtgccactgcactccagcctgggctgagcaacagagcgagactccgtccaaaaaaaaaaaaaagtgcatgtgcatgtgtgactgagtcgagagaagataccgtgatttcccgctctcattgcagcacagcgttcagaagtacttctcgcccatgggctccctgtttatgcccaaaaatcatcttttttcttcagtggagtctcgctctgtcacccaggctggagtgcagtggcgcgatctcggctcactgcaacttctgcctcccaggttcaagtgattctcctgcctcagcctcctgagtagccgggattacaggcgcccaccaccatacccggctaatttttatatttttagtagagacaaggttttgccacgttggccaggttggtctcaagctcctgactgcaggtgatccacctgcctcagcctcccaaagggctgggatcataggcatgagccaccgcacctggccattatgcccaaaaatcttttaaccccaaccttctaatgggcttctagggcccctggaggccccagtatctgtctgcctctctggaagctgagacttagttcctcctcccattctgtctctgtggacagcccctctcggcagattctctctctgggagatttacggcctgaatgtactatggggaacctggtgtggaggaggctgctgccctccccttccttcttggggcctctaaaaacaagcttcccaaggggcgtgtgtctcagcagatgctgtcactgttagggcctgaggtaccagcaaaagcaaagtctttgcctgctggtcatgggggacgaagccaggtagccccagattcagactccaggcttggggcaatggccaccggggagcctcagcccttcctctgttcctaagcccccaaggagagcagccagctaaaagtaaaaggtggccaaggttatcatctctgtctgcccagttacttttacctggaggtctggtctgctgggcttaactctttaagccacttgcccgcccctctctgctcctcaccacctcagaggagccctgcctgcccaggcggacaccacgtccgtgtaagccccaggaccacctgtgctgtgtgcatcccagtgtgcacagtgcctgcttcatgattcgctgcagagacggcgttggtgtgaacgggatcagggtctcgccctgcacccgcggctctcgctctcctgcaccctgggcggggctccctgtggcagcctccctcccgattatcctggcaggcccggcctgtgtggttcttacgcgtgagggggatagtgagtcccagcaggcaggcaggcttgagccctgagtgttggaattgtctcagtctctgacttgtaacctccaggcacaggagacgatggactcactggccatggtggagggtgtcagcagctgccaggacctctaccgcaagcacattggtcccctcctggagcgggtgaccgcgtcgcaccttgactggaccgcacactcgccggagctcctgcagttcagtgtcatcgtcgcacagtcaggtgagccgtcccgacagctggcgtgccgtgcctggccccactcaggctacacacctgctcccccaggtgctcagcaggtaccagcgccgaccagctgagctgtggttcactgaagcgtgttgttaaaagtacccaatagtcactcttgcctggggagaagcagcattttaaggagcatcgcattgaagactgtgggacgcagctcttccacttggcccgggcacacgctttcatgtgaaaccttcaaagtgtgcttttccgtggcctgttttgtagcctggcttcttaaatacgtctggattttgttgcagaatctagatgtctagccgcatgggtgctgtgtgtgtgacatgggggccttagccccagcccctctgagaccagcatttctgtggttctctttgagcctgcggatcagccacttttcctgggatggacagtgtggcccagtggggcttcagcgcggggcaagatccactgcagaaccctaaggagacgtccgctcagcagccatagtgccttgggacacacggcccgcgctgctccacgggccgtgaactcgccgcggtagctcttcctcgtttgcctccccggccctcccgctcccgcctgcagctccgagtgcccccgcctcctgttggatgtgtgcaccagggtggtcgtgctctgcatctgaggatgctaagatcgttcttacacaatctctgtgcctggtagggactcaccttttttttcctgagacttggaaaaatacccaaaattgttctttgtcagttgcattcaaaactgtttccaaattagaaaagaaaatactggctgggcgtggtggctcacgcctgtaatcccagcactttgggaggctgaagtgggaggatcacttgagctcaggagttcgagaccagcctggccaacacggcaagagctcatctctacaaaaagatgaaaaaaaccgcacgtgcacctctgaatctaaaatttaaaaataaataaaatacagttagccaggcgtggtggtgtgcgcctgtggccccagctactcaggaagctgaagcgggaggatccctggagcccaggagttcgaagcttcagtgagctgtgactgcactgctgcactccagcctgggcaacagagcaaggccctgtctctaaaaccaaacaaaaaacaaagctggcgattgctgacgtgcactcggggcattaaacactttatgccagacgctgctctgcaagccttagggccgtcagctcatctaccctcacagccggcctgtgtggtgggaactgtgaccccgtttcacagacaaggaggcagagcacagagaactcccgaggcagcgactccagagcctccctcagcccctctcccacgggcctcttggatgggggcccagggtgttgcatttcagatttttactgaatgttactcctaacaacctcttgcaccaaattactccagccttcacctcacagtccagaaaattgggcacacaaaccccgagagacgtggcttgcagtgaagccaggacttgcatttactgcagctctggtggcttctccaccatctgttcttcctctttgcagaagcatttcttatggtgttggcggaactgattggcagcttggaacacacatctctttgggcccacatctcctgtcattcactgaaaggcaggaagactgcagtatgccgttcagtgtcaagagctgggtataaaactgtatgggtttttttgttttttgttttttgagacggtctcacgctgtcacccaggctggagtgcagtggtacgatcacagctcactgtagcctcaaacttccgggatcaagtgatttttctgccttagcctcctgagtagatgggattgtaggcatacgccacctggctacttctgtatgtttttctagaaatggggtcatatatgctgccaggctagtcttgaactcctgggctcaagcgatcctcctgcctcagcctcctgagtagctgggaccacaggcacccactaccacgcctggctaatttttgtattttttgtagacatggggtctctttatgttgcccaggctgacctcaaactcctaggctcgaacagtcttcccacctcaccctcccaaagtgctgggattaacaggcataagccaccatgcctggtttaaaactgcatttcccaatgatgattatgttctctgagccccatctgagcgcacacatgtgtggtgctcttgggagtcgggggcacagcctcaaatataatacaatatttccaacatcgtgtccttggaatacagatgatttttattttcttctttatttttttctatgtttttctaagctttctctaatgagcatgcactactgtaataaacagaagacaaaaggattaaaacaattttttaataggagaaatttttaaatttctcatttacaaaagttctatgggaagataccttttaaattttaattattttaaacatacagaaagggataatttctaaactttgagaggatgggggatctacaaagacattgatttgactatatacatttgaaccaaaataaaaggaacatagacttaggaaaatatttgcaataaggatgacagtgtgagatctttgttacataaagctgacacaaaatgagaacaaaagcattaagagttgggcacggtggctcacgcctataatctcagcactctgagtccataaccgagcagcctgctctgatgatagaggctgaggcaaggaggctcacgtgagctcagaaattgaggcttcagggagctgtgattgtaccactgcactccagcccggacaacagagagagaccatgattccaaaaaacaaaaagcattaactcccaaacaaacaggcaaaatatccacattttataaaaaagaattaatacaactaataagcaaatagagtgggaactatccagcccttctagtgatgaggaaatatgaattaaagactgtagggtcccgctgggcgtggtggctcacgcctgtaatcccagcactttgggaggccgaggcaggcagatcccgatgtcaggagatcgagaccatcctggctaacatgatgaaaccccgtctctactaaaaatacaaaaaattagctgggtgcggtggcgggcgcttgtggtcccagctactcgggaggctgaggcaggacaatggcgtgaacccaggagacggggcttgcagtgagccgagactgtgccactgccctccagcctaggcgacagagcgagactcggtctcaaaaaaaaaaaaaaaaaagactgtagggtcccatttcttcatttatccaattaagtgaaatagctgctgcctagggtggctgagctgggagtgccaaggtgcttttggaaagccgtgggacgctgcgcatctggaattgccaatgtcttcactcctttcatccagcaatcacattcatgagaatctatccttccaattctaattatggaaaaagctatgcacccaaaaatatgcatcggggcataatttaatagaaattgtaagtgacccaaatacctcatacgaagttaaatacataatgatatttccatagaagaaatgctctggcaaccattaaaaacaattatcctaagcctttatagcaaaatgggaagacaggtgtggtgtgatatggagggaaagtgaagccagtgcagaagtgtccgtgctgcaagcaggaactcgcactgggaggggagacacgtgatcagggcggaagtgtccgtgctgcgaggcggagctggcgctgggaggggagacacgtgatccgggcggaagtgtccgtgctgccagcaggagctcccgctgggagggcagacacgtggtccgggtggaagtgtccctgctgcgagcaggagctcacgctgggagggcagacacatggtccggtggaagtgtccctgctgcaagcaggagcgctagtgctgggagggcggacacgtggctccgggcagaagtgtccgccagcaggagcgctcgtgcttggaaggtagacacgtggcccgggcggaagtgtccttgcagcgagcaggagctggcgctgggagggcagacacgtggtccgggcggaagtgtccgtgcagcgagcgggagctcgcgctgggagcggagacaggtgatctgggcggaagtgtccatgctgcgagcgctcgcggctgggagcgcagacacgtggtccaggcggaagtgtccatgctgcagcaggagctcgcactgggaggggagacacgtgatcagggcggaagtgtccgtgctgcgaggaggagctagcgctgggaggggagacacgtggtctgggcggaagtgtccgtgctgcgagcaggagctctcgctgggagggcagacacgtgatcctggcggaagtgtctgtgctgtgagccgcagctcacactgggagggaagacacgtggtccgggcggaagtgtctgtgctgcgagtgggcgctccggctgggagggcagacacgtggtccgggcggaagtgtccgtgcagcgagcaggagctcgcgctgggagggcagacaagtggtccagtggaagtgtccgtgctgcaagcaggagcgctagtgctgggagggcagacacgtggcccaggcggaagtgtccacgcctacctcgagcaggagcgctcatgctgggaaggcagatgggtggcccgggcagaagtgtccgtgctgcaagcaggagcgctcatgctgggaaggcagacacgtggcccaggcgtcaggtttgaacattcttgacagcaagtggctcacccgtcagcgtgcttctttttcccatcccaggagttggacttgacctgtggacatttggctgttttctttttgtttttaagccagaaacactgtcttgtttccagtttaagatgtagagagggtgaaacagtcagaaactgggtcagaagcagcgtggttctcgtggcagggcggcacttggcccaagactcgtgctctggcgggaggctcaagtcaggcgtcccagcagcttcggtgcaacgcctcctgcccggctgcgtggggaggccctccaagacaccagctggtctcaccgcgaggcctgacttcgagccagagcagcgagtacattgcgtctccgtgtggcaagggcaggtgcgggggtctcagtccactaccgagcagcctgctctgatgactggcggcgccagggagaaggctcacatcgcgaggtccccagcaacggctcaaggtgactcacagttgcttggataagccagtggacgctccctctacactggcccggggccagagcgcctccttctgcggccccaacccagtccccaccctgagccttcagctcctgggcctgcaggctgagcctggcaggagacgctgcagggactctcagagctgtccttgccctgtcattcatggagacttacagggaggcggggcggccctactgcagtggggaccccttggggcgtaggatgcacagtgcaggcgcccaagcctcgcgcccaccggagagcagccacggtgcaggagcttggccctgagtgtgggcggggtgagggctgcaacgctgagaagcagatattaaagaagttctttcactgaaacaattgattttggtcgttgtttcaactattgcttgactttaatttttcaaaaaaatttagaaaagtttaagaaaaatggaaggttgttttgtttttgagatggagttttgctcttggtgcccaggctggagtgcaatagtgcgatctcagctcaccgcaacttccgcctcacgggttcaagcagtcaagcagctgggattacaggcgcccaccaccacgcccagctaattttgtatttttagtagagatgggatttttctccatgttggtcaggctggtctcgaactcccgacctcaggtgacctcaggtcacccatcttggctttccaaagtgctggaattataggcgtgagccaccacgtccaggttttgtttttgtttttgtttttttgagacatagtctcactttgtcacccaggctggagtgcagtggcacgatctcggctcactgcaacctccacctcccaggttcaagtgattctcctgcctcagcctcccaagtagatgggactacaggtatatgccaccatgctagggtaatttttgtatttttagtggagatggggtttcaccatgttgaccaggctggtctcaaactctggacctcaggtgatcctccctccttggcctcccaaagtgctgggattataggcatgagccaccatgcctgaccaaataggttttcatatggaaaaacgtgattttggggggttaaaattttctgctgcttttctgtgataatcaccttactgattgagaaagaggaagcggggaggtggtggccgatagtgccctctcccaggtgggagcgcctgagcctgggcctgtgctggatggggcctcctcccgtctcctgagggccgtgcacaggagcctctgttgtgtcttacaggccctgccctgggagaagccctgccacacgtcgtgcccacgctgagggcctgtctgcagccctcccaagacccgcagatgcgcctgaagctgttctccatcctgtccaccgtgctgctcagagccacggacaccatcaactcccaggggtaggtccgggctctgcctctgcacggcccccagctggggcctgggccaggggtccccatctccctccccaacagctcactgagcaagggggttcccacctccttccccaacactgcactgcgcaaggggttccccatctccctcccccacactgagtcaaaggtgggccgggggtccccacctccctcccccacgccgagtctaaggtgggccgggggtccccacctccctcccccacagcactctgggtgagggttccccacaccaagtctgaggtgggcgtgtgcagtgacccctgagcttaactggcctggaagcagctagtccatcctcactgggtaaacacaagctctcggcagggaatgcacagagaagcactaagtcaaagtcatctccgtgtggtcattaaaattccagtgaatgaaaaagttttagggaacattaactgttaatggcttatgtattagctgttctctgttttaaaagcctttgggcacttttcaaacctaacaaacaactgattgaatttctattgatggtcaaagtggtaaaaatacctctttgttatctaagacaacttttaggtggcattaagaccccgagggtctagggcctccaggtgtacggctttgaagtaagggcaagaagcatgggtgccctctaggagcactgggagggacagtggaggaagaggccccgcccgggtgccactgctgaggcagctcttagggccctgccacttactttgctcagagcaaaaggtgccgtcagctgggtcctacccccgcctgtgcggctggatctgggctgcgtcagcaccgggacccgccccagcagcacatctgtcaaagcggaaagcagttcacacaccagagcctcatgtggaaagagtccaggcgctcagacttttctccttcatgaccctcatctctgctctcgggcctcagcccgcctgtcgtactgcaggaaattttgtttcctgcttgtcttcaaagacttcagggcttagaacggaccatagaaagatatgaaccgagagccgtggcagctgtccagcttgcaggctgatatttgtgtagatgccatgcagataacacagcagggtccaggcccttccctctggaactcacactcggctgtattttgggaggaaccgctgggcaggttctgcccaggaacagttaactctgcagagcacagtttccacatctgggctgagttcccaaagaaagtgcgcctaacaacgtcttgtggaaggcggttggcgtcaagagaagtaaagtgttcagatggcagtgattttaatgaacttactagctattttaataggaaagatttttttttttatccgtttggtttttatttttagaatcatgaaatagcaagttggctctgctgaagtagaaatggtgggcggggagtcgccactgaccatcgtctgcgcagagcaccttcctgctgaccgcagctgtgagcgccggctgtacgcaggtccctgctgtgcgggtgcccaagagggctgagggctgcgtctgccatggtgtctccaccttggacaccatgaatcatgagaggttctcagggctgcctcccacaggctttctgtgtcttacctgggacactcgggactagttgtgtttaggttttcttaaaattctgtagtaattgcattgtagagcatccctaatccgaacttcagaaatccaaaatgctccagtgagtatttcatttgagcatcatgtcagtgctcagatatggtcagaccctggagcactttgcattctgaagtgaaggatgctcagcctgcgtctgacagaagctccagagaagtggctgcgagttcagggcaagaggctcctggctttgaggctgcaccgtttctggaagtcaagccccacagtggacctcgagtccctctgtgaataggaatgtgctcgggcagggaacccggagcaccagccgctgggcccctcgttccccggctctgcagcgtcttcgggtcctgtgggtctggctgtgcccagccctgctgcccgtggactatagtgtcttggggtcctgcaggcctggctgtacccggccccagtgcatggtggcaagtgcctgtgatcccagctactcaggaggctgaggcaggagaatcacttgaacctgggaggcagaggttgcagtgagcggagattgcgccatttcactccagcctgggcagcaagagcgagactttgtctcaaaaaaaaggaacgtgcctcattcagtggttcgatggtggttctgatcaatgcccagaagttctgatggagcttctgtcagacacaggctgagtatccttcaccccaaaattaaaaaaaaaaaaaaaaaaatttaaaaaaacctaagcactcctaggtggcgcccgtgtggcacgcctggcccacacttggaccccacaccctgaaggccaggacttccaggccatttcatgtggtgaccatggagcaggcgctgggttcgttcattccagagagccctcttgcaagtcacggtgccgaaaatggcagctctgcttaaaaacgaacccacgccagaaacctcgcggaatgcgtgtaaatcacaccacaccaacgtcactttccacatctgctcatctacctggctggtcccaacatggcccctgccaggagcaagccggtggcgcctccagaagaggaagggacgctgtgcaggcttcacggacgctggagggctgcgggctgtggagctggtcttggagaccagagccacctttgaaacataccgtggtgttgggatgtcactaatgagtgtgtcattttgctttgagtttgtcttggtggcactttgacctgactggtcaccatcaggacgaagtcgccgacagggtgggaactgcccgtctctctgagctgtggcccttgggtccccggaccgcgcctgtggccctcccatcccgcctctgtgaagccgcagcgactgtccttgctggacagagggttctgtggctggagagacttggcctttttctgggggagggatgcagatgggaaaggggctcactgggtgctgccgacaccaccgcacctgccctagcccaggcgtcactcaggcctccttttgaagctaggagcggcgaggggctgaaagtgcaccctcggcccagggcctctggctcgcctctggagaacaggacctacgcgggccgcaggagaggccaggggcacaggcacccctgtctccccggtagggttgggcctggaggaacctcccaattcgcactgagaagcagctcctgagaggaggaggggcctcgtgttttggggtcgagttcgttttcctgtttggctcccccctcagccccattcatccctagtctgaaacgtttcttccgagcacctgtccggtctcctcatccaccctctccgttccggttccaggcagtttcccagctacctcgagacggtgacaaaggacatcctggcccccaatctgcagtggcatgcggggaggacagccgcggccatccgcacggctgccgtgtcctgcctctgggcgctcaccagcagcgaggtcctgtcggcagagcaggtacggggctccctgcgtgctcggtggacaccggccggggactgcgcaggcttcctggcgcccggcagagctcccgcagcaggaacttgggcaggcagcagctgcacctccacctggggcccgtaccccaagaggctctccccacactggcggcggaagggcaggagccggcggccgggctgcggttcagacagcaggcgggagagcgggagccaggccgcgggcccagccagcccggtcgtgctgcgggttttgcagccgctcatgagcgtgcggtttctcggtttccggcccaatgctggctgcaagaccaggagtcgaatcccaggatccaggccagaggacgggcctgggctttccgcatcgtttctatgaacacctccggctggtaccaggtgtcagaaaacagacactgatgcccgcccgcgtcctggtcgccgcccggcgggaaggcgctgccctgggcgcccgtgcagcatcagcgccacctcctggtgcacgcggggtggtgcggtcggtgctccagccgaaagccccacgtccttggggcccaggcgagccattaccctggtttagggttagtgcctcacctaggagttgtgaacagtgtgcgtattttctaaaaatcaagtaagcaagttaaaaattgctcaaaatctaaattttacaatgaagattcaagcctactttttaggtaaagctttcaagccccctaagtccttccaggcaggagtgcacggatggtgagcacccccaccccaccccaggacagatgtgagtcacgtcgtatgtgtttgctgattgcagatacgggacgtgcaggaaacactgatgccccaggtcctgaccaccctggaggaggattcgaagatgacgcgactgatctcatgccgtattatcaacacgttcttaaaaacctcgggcggcatgacggatccagagaaactcatcaggatttatcctggtaggacatttctgttgttcacagcctgtgtatatgcagtcagccctccgtgtccctgggttccgtttgcatccatggagtcacccaaactcagatcaaaactatctcgggctgggtgtggtggttcacacctttaattccagcactttaggcaggagggttgcttgagcccaggaatttgagaccagcctgggcaacatagccataccccgatctcaacaaaaaatttaaaaattagccagggctggtggcacacacctgtagtcccagctactcaggaagctgaggcaggaggatcgcttgagcccagcctgggcaacagaccaaaaccttgtctttaaaagtaggggtgtgtgtgtgtgtgtgtgtgtgtgtgtatggctacatatatacatgtttgtgcatttatacatacaaatacaaatttgtacttacatttgcatatataaatatgtatgtattggggggcagaattccacagttccaaaaagcaaagcttgaatttgttgggcaccaagtacaacgttgaacccgcatgaagaaagcatcatgtacacattgcattcggccttaaaacaacattggaccctcgtgaaggaagcgtcgtgtggacgttgcgttctgccttaaaacaacgttgaacccacgtgaaggaagcgtcgtgtggatgttacatttagcgttaaacgtaatctagagacagtttaaggtgtgccggaagatgtgtgtgggtcatgtgcaaatactatgcctttttttatcagagacttgagcatttgaggattttggtatcctagaggaggaggattcctggaaccaaaccccacagataccaagggacgactgtatttaagtttgatggtggcttgttttatagaaaaaaagcagaaaacgtggccgggcacggtggctcacgcctgtaatcccagcactttgggaggctgaggcaggtggatcacaaagtcaagagatagaaaccatcctggccaaaatggtgaccctgtctctactaaaaataaaaaaattagctggacatggtggtgcgcgcctgtagttccagctactcaggaggctgaggcaagagaatcgcttcaactcaggaggtggaggttgcagtgagccaagatcgcaccattgcactccagcctgggtgacagagccagactccatctcaaaaaaaaaagaaaatagaaaatgctcatctttgacttctgttcaagttggtactatgagaacaaacagcaatgacagatgaaataccacaaattaaacggcacagcaagaagcaaggcagaggtctccaaaccagcactgggtgggggtgacaaggctcagcttccacgcggccgggaagggggacctcagggtggggcggctggagctgcctgtggggagacggggccgggccaccctgcagcaggaccaggggcacagcctcagtgtcgccgcctcctggagcccaaaccccagaccaaccccaggtgagagcaagcactggggaggggaatggggtggttggcttgaagcccccgaaaagcagcagcactgaacagagtcatgaattcagagagcccctcactcagggcagcctgcacacaaacccctcaggacagggcccccgccacccaggccatgggccagtacctgtccgggtcctgttaggaaccagactgcacagcaggaggtgagaggtgggcaagcgaaacttcatctgtgtttacggctgctccccatcttttgcattaccacctgagctctgcctcctgtcagatcggcaacggcattagattctcataggagcacaaatcctattgtgaactgtgcacgcgagggatccaagctgacgctccttatgaaactaatgcctgatgatccgtcactgtctcccatcgtccccacatgggaccgtctagttgcaggaaaacaagctcaggcccccactgattctacaggatgatgagttgtagaattatctcattatatgttacaatgtagtcatagaaataacgtgtacaataaacgtaacgcacgtgactcatcctgaaaccatctcaccccctggtccatggaaaattgtcttccatgaaaccagcccctggtgccaaaaaggttggggactgctacctcagaacaccgaagacccggcgctaagggcagcctcgcacccagcccgggaaggaagtgccgataatagaaccacctcaaagttacctttattgaggcgtgtttaagatcctcaaaaagctaaaagaacaacatccactaaaaaacaagttgagaaacaagaagacaagcaggaataaagaacagatggaaacggaagcgatcgctgggaagtccggagtgacacggaatggtgtgctggcactactttgaggaaaggagttacccagcgagggagaaaggggatggggtgggcgggaagcggccactcaggcgttcctgattagctctacttaatgtgattatctatattttgtgtatttatgccagaaatgtttagcagtttttaaaagatggttcttgctaattcccggaaatgaatggagtcatcggaacttcacactctgtgtactgggtcaactctagactgaatgtggctgaaaacaaagttagtgacgtgaaagccaggaatgtggaattcctcaagatcacgagacagagaggggtgcaaggcctggagtgggcgaaggacacgggacggggagggacgcggggcctggagcgggcagaggacacgggatggagagaggtgccgagtgggccgagaggctcccgggcttttctgaatcccaggagaagagaatggaggagagatggtgcctcagaatcttccagaactggagacagacatgaattttcagattcacagtacacacggcgctgggcagaaaaaccgccgcctgctgaactctgaggtccgggggcctttgtcactcattctctcacctttgcttttctgtttttattctttagtaacaaacatcctgttcccactgactctggaacaagttcagtccatgcgattgttgggaattcactcactttttaaaacaggagctggcggaaaggctgcacgcgtttgggcatctgagcgcatttgggcatctgggccacggccccctgtttattttcactacaaaaggttccttgagaggccccttgcctattagtgccagctctgggcttcccagggtgaagtgttggatgaatcatggcctccttggtggggaaggaaggatgtcctgagttgggagcacagacatccaggcctcccaggacagacagacacaaacatgaacagcagacaggccagcgtgagccgattctgcctggcttagtcgtgcatgaaaggaaccctaaactggtacaaaagtggacctgcaggccatccagggagtgaccatcgtaaaaacacaatagccagtgccactctgtgtacttccatagtcgaccgcgccagcaggaggcctcggaggatcctgtccgggcccatagatgtttgctagcgggacaagcttgggtgagttgagcatctgactccgtccttcctcctgagacacgtgcagcgagggcacccactgtgcagcgagggctcccgccgtgcagtgagcataccccctgtgcagtgagggcacctgccgtgcagtgagcataccccccatgcagcaaaagcaccccccatgcagcgagggctcccgctgtgcagtgagcatacccgctgtgcagtgagggcacctgccgtgcagggctgcttcagggtttggcaccataatgcctggatgtgctccgtggcttcctccttggtgcctgtgtttggtggctggaaggcccagcaccctcagggcccagaaccctcagggaagtgcctgggcatctgccaggaattaacccactgggtcccacttgtctcaaagcctggcttggtaggatggcctgaactttggatgtttttcatgcctttcgttacataggatcctcttgctgagggtggatcatgccctccacattgcaaaagcatcagagacccagcccaccctcgcgtctgcagcgggaagatgggcctggtgccaggcgcgggcagccgcccctcccagcgtcgggaagatgggcctcatgccaggcatgggcagctgcccctcccagcgtcgggaagatgggcctccgggtggttttgcgactcagtcatctgcgaatttccggatgctgcacagaagggggtgccaaagtttttttaagatgatgtaaaaaaagcataaatttgataaaaattatgtccattaacctcataagtttctacccatcgggaaggatcatccttctgttttcagcagcagaaaactgaccacagtagggggttgtctgtcactgagtcctcagctctggtgggagggcagggtcagagctgggcagggtggccagctcggggatctgagcatctgggagcaggaggtggagggccaggtgagcacacagctgcgaggaggtggaggaccaggtgagcacacagctacagctacagggaggctctgcgcctgcaggacaggttattacaggggccgcagcagggcctgggccgcctccactctgttggctggggttcaggggtcccaggtcgccaggagcaccttgcatgtggctcgggatgcacggagtctcccgtgaggtgtgggtttcttaggaccccagggcaggtgtcccatgggagtatgaactaaatgcctttgtggacgtttagacgtgaaatgtctgctctagactcacacacctgtctcgctccctccttccagaactcttaaaacgcctagatgacgtgtccaacgatgtgaggatggcagccgcctccaccttggtcacctggctgcagtgtgtcaagggtgccaacgcaaaatcctactatcagagcagtgtccagtacctgtaccgagagttgctggttcaccttgacgatccagagagggccatccaggatgcaattttaggtgagactccgacggcttggccttcgttccgatgcctgctttcggcgcctgccacgggcatctgtagctgagccgtgtgaccggccacagggccctggggcacaggaggggcctcagctccggcctggcacactcttgagttcttggcaaaccctgagagcggctgtctttgtggtgatagctgctgacatttcctctaacagaaatcaaaactgagagtattctagaatacttgttagttgtttaaaataacaatagtaagcccagtatatattgacacagatggcttgtgtttttgaaaaatactttccaaaacaaaatcatctgcaagaacgatttttgcaaatgtcttaaatgtgtagcttgatggaagacactggactttcacatcttccatacagtcagtcatgatgtgtatggctctggctgaaatacgtggaaaataatctggcctcgcctgtggcttcaagtgtagttggacaaaagaagagtattttagtagccttttcagataggcgtgggacttcttcaataccacgccaacagcgacacaggccgtcccttgaaggtcactcacagcacagggcctgaggccacacaccacagagccttccacgctcagtgcattaaaatccgctggtccatctcacacttggaatgtaacgatttgcttttttttttcttttttttttttttgttttgttttgttgttggtgaatataatgacgttgttcttttttttaataaaatttgtatttttaatttttgtgggtacacataggtgtatataaggcatgtgtgatactgtgatacaggcatgcagtgtgtgtaaatcacattggggaaatggggtccccgtcacttcaaacacttacactttctttgtgttacaaataattcagtgatacttttcgttatgtttaaatgtgtgataaattattgttgaccatagtcaccctgttgtgctatcaaatactaaatcttactcattctgtttttgtactcattaaccatccccacctcttcccccggccccattcctcttccgagcctctgggagccatccttctgctctatctccatgagttgaattatttttatttttagttcccacaaatgagaatgtgcggaatttgcccttctgtgcctgacttatttcacttaacatagcgacctccacttccctccatgttgatccaatgactggatctcatttcttttgtggccggataatattccactgcgtgcgctccacgttttccttctcccttcatctgtccgtggacaccccggttgcttccacaccttggctgtcggaacagtggggcattcggcgtgcgcgtgcagctctcccccatagctgaattcctctcttttgggtatttgcccagaagtgggattgccgggctgtatggggctctatttttagttttggagggacctccagactgttctcccagcggtgctcatttacattcccaccagcagcgtgagggttcccttgtctccacatccgcgccgggacttgtttccgcagccattttaactggggtcagaggatgtctcacttgtttctatgtgcatttctctgaggagcggtggtggtgggcaccttttcagacgcctgtttgtcatttccatgctgtcttttgagagctgtctgttcaggtcttttacccatttttaattggattattagattgtctgctattgagcctgagctcctcatatattccagtgattaatccttgtcaggcggcggttctaagatacagtctcccatcccgtacccgcgggctgtccctgcggctgtactctgctcattcttccctttgctgtgtggaagctttgggcctggatgtgctgactttgccttttgcctcctttggaaaatacttagaccttccccgcgcagctgcgtccggtttcccggcgtggctacatccggttatgcgatgtcggatcttcctggtgtggccgcctcccgtcgcgcagcgtcagaaactcggatcttcgcggcgtggccgcctcccgacacgcggcgtcagaaactcggatcttcctggcgtggccgcctcccgtcgcgcggcgtcagaaactcggatcttcgcggcgtggccacctcccgacacgcggcatcagaaactcggatcttcctggcgtggccgcctcccgtcacgcggcgtcagaaactcggctcttcgcggcgtggccgcctcccgtcacgcggcgtcagaaactcgcatcttcccggcgtggccgcctcccctcacgcggcgtcagaaactcgcatcttcctggtgtggccgcctcccgtcacgcggcgtcagaaactcggatcttcccggcgtggccgcgtcccgtcacgcggcgtcagaaactcgcatcttcctggtgtggccgcctcccgtcacgcggcgtcagaaactcggatcttcccggcgtggccgcgtcccgttacgcagcgtcagaaactcgatattcctggcgtggccgcctcccgtcacgcagcgtcagaaactcgatcttcctggcgtggccgcctcccgtcacgcagcgtcagaaactcgatcttcctggcgtggccgcctcccgtcacgcagcgtcagaaactcgatcttcctggcgtggccgcctcccgtcacgcagcgtcagaaactcggtcttcctgccatggccacctcccatccggcggcatcagaaactcggaccttcctggcgtggccgcgtcccctcacacaacgtcagaaactcgatcttcctggcgtggccacctcccctccggcggcatcagaaactcggatcgtcctggggtggctgctcttgttacgcaacgtcagaaactctcctgcgtgggcaccaggctcagaagagtccggcttgtggtggcagggccaagctttggctcattgtgattttttgtgtgagagcttgacttgtatcctcggccacaaaccctgtcggttgttctgggagtgagggacttgggccgttcactttcacgccgtgctctgccagatcccgcgtccgcacagccagggtgggtgcactgctcgtccgtccgccattcttcctgggaaaagcagctctgctgcacgaccctggtcctccgtgtgaagcggtgcacctggtgcccactcgcgggtgtaagccgtgtgcgtgagggtgagtgtggcaggtgaagccgtgtgctcgagggtgagtgtggcagggggcgtgggcctcagctgctcccgcatctgcgcaggtgtgagcacagtgacgggcaggccgggcatgctctgcgtgcgaccacatgcctggctttgactcacagaccctctgaagggtcctggggaccccgagggccttggagcccatgtcgggagcccctgccttgagtcgtggaatcaggttgtcagccagtgagggagccccagagcccattgatccacggcggggcccgtggtctctccaggtcacggaaagaagctgcgaattggagaccaattggaaattgtttaaaaggaggacagcagctcacgtgcaggcctcgctgggacagcccatcctgccagatccacgcaacgcccccagctccccacactccctggcaaatcccagccctgcctgcgccctcccagctctcctgtcctgcactacacaccatcaacccgagttctgagcttctcctactctcagcctcagcctcactcgtcctcaggaccttgctctaggccgaggagaccagtgcccctgtgcaccagctcagcctgcagccccggccctctcgcctccccaggactgcacagggcatctcccttccccactgcacggtacaggccattctttctcctgtctttaaaaaaacaaaacacagatgccctgtacgccgcccccacctcccccacctcccccaccgcacatccgcctggcagcaggctccctggaagcagcccgccttacccctcctcgaggccctgggcccatggcaggcatctgcagccgtccacctgcctgcacctctgagcagcgccaggcacagctggcggccacgcaccctcctctggctgcgggacgcccgtgctcagtctcttggtctttccctcgcccatgtgggcccctcactgctcctctgctgtgtctgcaccgctccctcagagctcttctcctggcctcagctccacacacaagtgcagctgcctggtgccgaaccctgggccgctacccccctccctgactgcctgccgggttccgccaccctcagtggctcagtggccatctgtcctcaagactgaaggcggagaccttgaggtcctcctggaccccctcttaactcccagcagaatctgatagactccccagccactgcagcaacctccccatcctcttcctgcctcagctagacacgcccaaccctttctggcccccacccctgcagctcccactgcccccatcacacacaccaccacgagcccctgacacgtttgccttcctgattttcatcatcggccactgcttcccgatgaaccctccgtaagcatgggttcatttccggctgtgtcggtgatgcctggcccgtgggaggtttgcagtcactgcggcaggtgaattggcatccgcaaattggataagaaagtcgcctgtttttctgagcctatttgctcctgtgaaacctgtttctaagcccaaaaatgccacctgaagactctgcaggacatcatttcatggtctgcccacaactgccaggaggcgattttcagttctttgaatgcacgttgtgactgccgtgcacccacccagcagcatcaggttcctcatattcacatagtgaccatgcagcatcaggtcacttgtccacgttgtgactcaggtcattcgtatccacattctgactgccgtccacccgtccagagtgtcagcttacttatatccacgttatgactactgtgcacccatccgctgcatcaggtcgctcgtgtccacactgggactgccgtgcacgtggccagcagcatcaggtcacttgtatccacattatgatcgctggacacccatccagcaggatcaggtcattcgtatccacattgtgactactgggtccccatccagcagcgtcaggtcattcgtccccagattgtgagtcgggtcactcgtatccacattgtgactactgtgtccccatccagcagcgtcaggtcattcgtccccacattgtgagtcggatcactcgtatccgcattgtgactactgtatgtccacccagcagcgtcaggttatttgcagatgcttttacagatgcttgaacttcactacaaagccaatttgcacgagaggtaagattggtttcatgtttgtttctggcatgttcaaggtgtttttctgttttacagaggtcctcaaagagggcagcgggctgttcccagatctcctggtgagggagacggaggccgtcatccacaagcaccgctcggccacctactgcgagcagctcctgcagcatgtgcaggccgtgccagccacacagtgaccacgctggtttcagccacggcacacccttgtccccacctgagccagagtttgtggcctttaaatctcataaacaaggcacctctgtgccagcagtgagactgtgacagcaagaatgtactcctcaggacacctgcccactctttccctggaataacagcctctgagtggattctgcatgttatgtgatttgttctgttcatcgagagggctcccaaacatctgcagctgatttgaaattaaaagtaagtcgcagccgctcctcccgcagccacttcagcagcatcttagattttaagcctcacgtgcgcagctggttcatgaactattggctgcatcctgcttaggtgcccaccaagaaggtttttacctacttaacaaaaaagaaagaagccaaagtgattagaaagaaatgaaatctctttttgggttctgtctactgaaatttaatatctcagtgaacagactaaaaggaatttagaatcctaacaacttatcagatttctcctgttttaaatatactgggactttaaaggttatatgtccggtcaccgtatgttttaagtcggtgttaatgctaacagtgttgaaaacaatatttcatgagatctaattgtggttgcccctataggtagcaggaaagtaaagttgcatttccctctcgcacattctacacccaagtgcctaaaagatctcattgtaagtgggtagtgttaccggaagccattgtgttcacacgggggaaatgccgtatatatttttcaacaaatattaacgtttatactttcatgtttgaaaatttaattaaaaatgtttgtttt

SEQ ID NO: 38377 - DNA, 165711 bp, Homo sapiens
gatttggcccggagaacgagatcaccctctcaatgaaaggcagatgtccctttaaggtttgcttctacagcccgtggactttagcctaaacacggacccgcgaagctggctttatttgtccatgtctcggacagagcctgggaagctgccagtgagatttcagagaccaagagcgcgaaggggcgggcgatgtggcaatccgtctgggatgtgaaaagcgtggagcgcatttagaggaattcgacgaaaacacaggaaatcactcctctcccgctcctgggcgccgctgccactggggcagaggactgggaaccgcggcagcgggataagtggcccagccagagagcgcagctcccgcgcccggtcctgccctgcgaaccagcgcggccccctggcgctgaggctgctccggccatggcccctcggccccgcgcccgcccaggggtcgctgtcgcctgctgctggctcctcactggtgagcgactcgcttttctctgagcatctcctgctcgcgggcttggggcttggagcggggagggaggtcctcagagccatgggccagataggaagagagagcgcccatccactttcgggcattccaggtactcaggccaggctacggggcaggcaggagtttcgcgttctggttttgatatgaattagttttcgtgtctctccaaagtccttcaccctaggagtaggagtgaggcagcactgaaaaccttagaaggtagaattcacttttaaaattaaagttgtttttacaatacacattgtatattaggactttgctgaatatttcctcccctccacccttttttatggcatgggatgggagggtgatgcttatagggcgcctgatacatatgcaaaattcctaccctcgggttgttccagagtggacattattgaattttcttgctgtctactatttaggcttttttcccatgcagaacaagaaaaggcagggatgcaagacgaaactgccacttgttccaaaatgatgtttctatgtcagcacccaagaggagggatattttgaaacgtagaaaggaatggtgaacattttctctgtaaatatcacagggcagtctacttttaagatgcaaaatatagtattgttatttgtacataaatgtgtatttttaaggaggggacttaaaaacatagtggaaatgcaaagttgtatccaatttagaaaaagcttgaaatatagcattttgtaagattttcccaataatgaactcatggtcagatcttttttaccagttactgattggggtgggggaaagttgaaatggtgaaaaatggaagaaggtggggggaaagtgtatcgatagaatctctgtgtgaaagaaaatcaccttattaatgggttaattaacagctggctttaacatatcattgatattcaattgttcagtgtttttactgctggcatggttattagtactagttaatttagcatttttaccactaaaaacagggtagagccagctagtttagacctgccttagatggccaagcattgttaagttttatgaagatgatttagaagttgattatcagcaagcagagcttttttcagaagggaggtaatgtaaagagagttaataattagctactggcttttcatccaaacatttcccactactcaggaaatgtccaataatccaaacagtggtaactgctgaacagcattatagccggtgagtggtttaacttaccagctactgccactactttttacacatatttgacctatgattcttctccaactcaaatttttttagattgtattttgttgtttttgtgcaaaatctgaatacagtagtttactatccaagttgtactttttcattctaccaaataagcagtctctagagtagaaatgatgaaatgaggtttgcgtatcctctaaaaagacaagagtgaaacttgaagtaacagagaagtttaacaagttacaatttcatatatatgttggtgaaatatacattggtgaatccaggaagagacttaaaatatttagaaaccttgtgtgcactatatttatgcccatttcgcaacacatgagggatctgaaattggactgctttcccatcagtcattatattctgtaggctcttctttagcaatctctttcagatttggaaacttctcatcaattcagagtccgtttgtaacctggggactcatcaccatacttatccatgcacactactgtagagcttatctttctgtcttcaatttgaacccaacttccagtctaccctcctaatacatcatttttactatatctgtttttagtcaaaaatctttggtggttctttgttgcctttaagataaaatccaaaattctcaactgactgccctaatccaacaccctctctctatctcctactactcctatgtcagtttcttattgctgttgtaacaacttgccatagatcaccagcttaaaacaacataaatttactattgtacagttctgtaggtcagaagtatcactgggctagaatcaagatgtcaccagggctgcatttcttctggaggttctaggggaaaatcagtttccctgttttcaccagcctctggccaccacctgcattcttggcctgtggcccctttctccatcttcaaccgagcagggtagaatcttcagatcttcccccatgactctgctttatcatcacatctccttctcagactctgaccctactaccttcctaaggatccttgtaattacaatgtgcctaccagaataatctcctcatctcaagatctttaatttaattacatcttccaagtcccttttaccatctaagataacatattcacaggttccaggcattaggtcatggatatctttgggagaccattattctgcctaccacaacccataagcataaactgtccattatagccaatcacttttctttactttctccataatcctcatgttcattttgccactgaagatatgaccttgttttatacatcgagaaaagaattccacctttccatcctaccaccctctgacatctaaataaactctctacagccttccaaactgggtttacatcagaacaacaagccaccagcatcccaataaacttcctatttgatttagactgtcttatattagctccttacaacgtttactaaaatgattcatcaaaaagatgtccttatgtccaaaggattgttattttatgtatgtcaaagtctcagcataaactgatgtcacatataaaggatttaactgaagacagtttcataaagtgacagtttagagaggccttaaaggaacaagaaaagagggtggagcatctagcgcaagcaacagtagggaaaaaagaacctgaagcaaggtgagaagaaaaaccatgaccattcctaggcctgaggaggtggcagtgttagtttgattatgaactctagttatgggagggtggccattagactggagttgtggtcataaaaaggaatgcagctagtgacaaaattgaagcccagcagagaaggagtaaggaaaataaatatacctcctttcctcccaccctctgatgtcttgctcagccttcccattggccatccccaaatggcaagatccaaccttccagagaacaaagggcaagacaatcaataacagaatagctagcacaacttaaccccgaaatgtattatgtgcaaggcactgtgccaagggctttgcatgtattatttcattttaatctaaaaaattaagtttactaattgatcacaagcagtcacagatttctttgttcttttttcactccctcagcttgttgattagccttgaaaaaaagaaaagaaaaaattaaaactttataactattatcaatattttagagatgaggaaatcaaaatatagtattaagaagttaatttcatttgtccaaagttgaagaactaatgacaaatctactcaattcatatctctgacctcaaattaaatgctctaaaataatatgctatattggctgcctaaagataagttcattctctcttgctcactcctctaaatgtgaaatccaaacatagttgtctaaaatacttggataaagacctaattaatgatacaagtcaatcttttatttccatgatttttaggtgtacagcattaagtgtaactcaagtaagactactatttctcgttattaagaatataaatatagaattagccctaattaaactatatgtctctcttccctagaaacattttggttggcctagaagcaagggtcttcttttcacaggcaagatttcctattcaaaatgaaatccagtgaggagatgggagatggctgaatatggggaggaagtcagccacttattcaaaacaaagaatgactcccaatggcagacaatgtattgtcaggaattgctgaagatggtgaaaattgtcttactcattgtgatgtttgtaaaggcagcaatgaattcacgggatttttgtttgtttagtaaacaggcaatgagagtaaccatgagacacatatatatgctatactagtttaactatttctcttccctcctgtcataacacttacccagctattttgaagcatgagctcttgggccacagcttatcactgatgttctgacttcagtagatagatgctcctctaacatgttcctccacttccaacccaataaacttcccactagatttagaacttgctgaatttccacatcttaacatattttagtagaataaagtagctcatgtttaaaatatatttagaaaagttggggactaaaatgctattctttacctacacttctcttctgttgtgtgaaatacaaaatagtgtactcaaattcatgttaagaaactgagatgaaagatattttgaaactgttgccacagtgctaaagtcagaatagattgcctattcagagcagtctgtgactggagaattgtattcgccctcaaagcaagtacagtagagtatcaagagatgcaaatgactgcatatatttctatcttcaagattattgagcttctttcagctcctttattatgccagctactctaaagtctccttggggactttgcataagtagttactcccactgctactgatctcaatccctgaataaacgtcatttccaagagataccctgaagtagattggaccctaccttaggacatgtgtatcccagcacctttgcttctattatataatgcaccacggtattataattaactatctaattgcctgtctttccagcttgctgtatgctctgtgagggtaggatctttaaccataacacctagaaataataggcactttttaattgaatgaatcgcaaaagaattgactattgacaaactcagaaaatacttaagggatcagattgtccctttattatatacctctgccttattttattatacctctgcctgaaatatttctgtctatccaaatttataaataatggaatggaagacaccatcagttgaaagatgcaccattattttatgtaccactaaaaaagacaagccactcccaatccaattataattgctagattgttagatagttcctagtttcagagatgtcaaaattgggaaaatgtgcgtctgaaaattacaatcaataatatacagtgtatggtactttttaccatggtacttttctatttgtttggacacttaaaaattgtgtcataagattttgaagaggctagtatgtgaaccccatctagatacagagatataacattgttcctctcagttctcttcaagtgccaagtttatatctgatttaggggataattgctcctctggcaccaacagcctcaccagatcccaaaaacagagctccctccaaatgctctatctttagaagagagcttcaggagaaaggtgacaataaagtaatcatataatgttccagttgcacaggattaatgactctagctttggcaaactcttaactttttgtcatgttggtggtaagctccagggttgtgtatataggaagaagactaattttaatcaaaactttcctatgatttaaaaggaagataaaaaagtcaactaagttttaaaaggaaattaaaatgcatatgctggttggtgttaggaattcactttatgtgttaaaaaaaatcaattttatccaaacaggagatccctattaacaagataagtaagagatctgaaatgagaaatcattgtaattcaaatatgcaaaggagtggatacacatactctttttgtatgaattatatgagatctcctaaaataaatgcaaattcttaaatttaaatatagcacctaagtcactttaaaacatcaatagttaagatggtttatatattttgttacaaatcatatatccttactacaaattaaatgtactttcaaaattattttattaattagacttttattttaccaaatactaaagtctagaaatacatgggtactggccaatccttaaaaatatctgtgtaacacattttacttataatatttttggtgaaatgatcttatgccgtataagaatacatgcaaatagaaatacacacacacacacacacacacacacacacacacacttctgttcataggattttgtttatttggtaggaggttttgtattattttgtgacaactgcaagtaagcactttccatcatgagaaatttagatagtgagtgagtacaagttccttaaaaaaaaaaacaaataaaacaaacaaaaaaaaccactttcccttttacccttttgtctatattagctaactaatcctcccagtcatccacttagctttgctggtggaggtcacatgggaacctttgcacaatctgaggtttgcacattctctctaaataaacaattgcgtttatcactagatattcataattggagctctggcttcttattttgtaaagttcactttccaaaccatgtataataaaactaattgccattatgtgttattctaaaatattttaagaacttttcctggggaagatgtattttaaattaccattttcttacctaagcacggctatctcaaatattgaaataggcttatacaaacttaccttaagagtaaccttctttttaagtttttagtaacattataaaacagaatgtgatttcctaattttagaatgtcagttacagacaagttaaaaactctgaattaaagaaaaattaataaccattaatttttgcatactaaaaatatgagtatgtgccacttgttatgctgtgttccaggagaacaaagacaaataaaaggtagtaagtctctgcctttactggtggaagaggtagtagacatggaaagacacaatggtgggagaggctcccaaggtgctttataaggaataacaaaaagattaggtttgtgttgcaggaaagtaagccttccaaaataaaatacaagatgaaaacaagaaaatttatacagccccgactgtttaagggtcacaagctaagcagagggtattaaaacaagatttccatctttcaggagcccataattccatttcatgtcatacaaaccatttcttttatattattataataggaaagatagtaattcaactcaccaatgaggtccatgaaccattttattcagtagagctgaataacataaataacataaataaatgtaccccaaagattatccatcagtcaactctaccaaaccagttatttttccaaggctgaataattatgatcatgttaaaatgagctcttgtcccttgttttgtctgatccagttttctagcttcaagccaggcatttttagagctctataatttattaatatcaagtatcataatatcactaggacctcataaggatggtcaaatgagagagcaggacaaataatcttatttatcatttagaatgaaaaataattagctttattgcggtctgggacttatttcaagttggtagaatccatccaggaaagaccatatttgaggtctgccaattcttggtccacaaacaagaaactttgaatcagtctttcacctctgaaatgggtcttagaaaaatcagatttgaaagatagcacgcaaaattgaaaacaaatatgttaggatgagattataggtgttgtttaaacacttaaaaaatattactgcagcataatttttagttagaaatttaattattgaattcaattccctcaattcttcagtgaaataaattgggttccagagagactgagtactgccaaaagttacagtaaaaacaattgaagagtaagagctacaatccaggatgcttgacttctagcccagttctcttcttgagacactggaagtgtctcaagagcaacaaattaaaaacttttggaggtaacaatacttttttccccttctggagagattaatataaataagacattgtagggaaaatagatataattaaagttactgatataaagatttatactgatataaagttactgatataaagttttctattttaaacagccaatacataagtataaaattagtatttaaagcaaaagagctaaaagccctggtatttttctcaatactttgctcatttggaaaaaaatgaaaataaatatataactacagcagtttctgaactaccattattaagtgaaatacagtcaataacaatataagtaagtgccttaagaaatgtcttgaaatgtctgtaataatgttaaaatagctgccatactttacatttgactcacctagcttatcattaatatatgagtgcctactatgtgcaaaggacctttaaaaggacaaaggagtataaagataaatccttccagagttcaacaaaaaagatacatgtttaaattaacatggattcaagtttacatggtttcaagtttgagataacatttaagctggactttaaagataggcagcactaaaggaagcagggatgaaaggaagtgacattttaaacagagaagttagtatgagttaaggtagcaaacgagaaagttcctagcatatgtagggaacaaaggttactttcaaggtggaatatagggtgccctgaggggaaaagtgggaagtaaatttgtaaggccagtgcaaattgggattgtagacgttaattcatagggaatgggaatccaaaatgaatcaaaataaaaatataatgattggtctagaaatactaagccataaacaaaatctgggtgaaaacatctaatagtcaactacaggcttaaattactaaggaaaaaaaaaagttcccaactattgcagttgtttcacatacaacagtaattctatgaaagattttatagtatactgaattatggaggcacactgatattttttaaaatggcccaaagtggtttgcctcataacttaaaaaaaaatttttttaaccatggatttaagagtcaataagggtttttcacaggtttctaatgtacagataaatatatgtatatttttctaaagtagaacattagatctttctctaagagtatgatgatgacctaggctggacagaaggaaaaaaaaaaactatgtagaagagaaaagtataataattttaagaggtgataaaagagcaggaaagggactagtgcctttcaaatcctctaggttggttcccaagctgtgagtttttgtttagctggtaaaggtgacagttgaggggaagtgacagtggataatagcacataatttgcagtgaaggagatgattacaaacattcataatataggatggtggtagtagaaagagagggtatggagttatgcaggcctgaatttcaatgctagtcatgtgatcttgaaaacatttcttaacttccccatagttgattttcttctataaaattaggataacaaatatttaccttacaggggagaattagagcataggaaagaacttgataaacattcaatacgtgatagctcttcaataaaaaccttttgttaagatcccactgtgtgcttaccactgtgattctgtggcttttaatctttggcagactatgggaaagataaattgtacttagaaagatgatcaaggagcacttcaaagccccagttcaaaattatctcctcattctctctctctttctctctcacaaatacacacacaagcacactttcaccctaccaattaggaattttaagttaacaagatactttttttaaaatacagtgtcctttggataggcaaatcaccttcacacttgagtgtgattagttctttgcttagtgaaaagttgctgggttctcctggaattggaagaaggcaatgtgaattaggaacttcttgagggtactcagtatgataggaaggtgggaagaaggaggaagtaaggggagacatagagagcgagaaacaaagagaaaagaggccacaaatattaataagtagtggttcttatttggactttccccttggaggggacctttccgtcccctgataatctcttaggaagataatgacacttaagtttaaattgtgaagcctgtcagttgagaaaaatgttgagacaagtctcaatcattttaggacgtttatttgccaaaattaaggacgtgcgcggggaagacaggtctatgcctttctgggaagatgattttgagggctccaaatttaaaggggaaagggtgggatactgagaaatacagttttcatgtgagagggtagcagggggaaaatagtcattcatgcctctgtctggcttagtcaatctgaatctgcatttttacgtaagataacatagacaaatggggcaggggaacaatcagatatgcatttgtgtcaggagggcagaggggtgactgtacctgaaaacagaagctatctatttacattgccatggtaaattttcatagaaacactttatggtaaagatcttggcgctcactgagaatttccttgtgggcaaaatatgagcgaggtgtgtagcttttcatctggtagccatctcatttaaaaaccaagaggcaaggcagttttgcgtgacccagttcccagcttaacttttccctttggcttaatgagtttggggatccgagatttattttccttccacacgcctatgccaaactcagattccttcctttcatccctgtttcatctgttcaggctggttagttcccctttccaatccacacagagaaagacagaaaagacagtgagaagctatgtgtgcaggacttctctgccctccactccatctaagctctcaagaaacttttagattcttttgttttttctattcatcggtctcttaaagaggcaatcccacttctccatttccacttcctaataaagaatgctaagtaacttaaggattttctttaaattatgtagctattcaatcagggtcagtcctagttaatagtttttccccacttcccatagcctcggcttttagcttagctttggcagtgaagatctggccctaagctcttgcgacccaacccccaacctaaacatttcacaggctactgggctgcggaaagctgaggctgccaactttggagcctaggattcccaggacatcaggtcaagcaactgagaggtccacccaggggtaaattccacacatagtttcttctctcttgggaccagcgctttaacatctgggtgaatcagatcgtgcagacacggtaactaggcgcagaaaacagctggacacgttgctgggagcccagacagaacgtgaccagtagttctcagaaaccgcttctaaataccagctccaacaggcttgtagcgtccgagtgcggataaggcaagagcaaaaacgagcatagtttgggccgttggggccaaatctgcacttctgagagctacttttactgctaagctttgaaattggatttacccagagggaagcgttgcagtggcagccgcaggcaggtaaaactagtatttgcactcacacactccccggattcttcacagacagggatggaagagaaaacttaggaagttgaagtttggcattaaaataaaggactcgccaccactctgtgcaccttcttgagggagttcattcgtccggagcgcctcacagcttagtgcgcctgcgcacgcgcgaactgcggccccgcctctcctttggggacgggagacgtgcgtcgggtcgcgggacgggggctgcgcatgcgccttcatttcgtcagcccgctgttgcgtgctgccagcgggaactgtgtaggggtagattttcgctgcagtgttccccgagcctgttagacgcagcgcgccgggagactgagagaggaaaggatagaggaagtgctgccctaggctgcatgagtcgaagcaagcgtgtttccttcccgccaggcaagtgcccttagaaaccgggccccgcccccttcctggcctgcattcccatcccctctcccggggcggaggtgaggacctccttggttcctttggttctgtcagtgagccccttccttggccatgaagctcgtgaggaagaacatcgagaaggacaatgcgggccaggtgaccctggtccccgaggagcctgaggacatgtggcacacttacaacctcgtgcaggtgggcgacagcctgcgcgcctccaccatccgcaaggtacagacagagtcctccacgggcagcgtgggcagcaaccgggtccgcactaccctcactctctgcgtggaggccatcgacttcgactctcaagcctgccagctgcgggttaaggggaccaacatccaagagaatgagtatgtcaagatgggggcttaccacaccatcgagctggagcccaaccgccagttcaccctggccaagaagcagtgggatagtgtggtactggagcgcatcgagcaggcctgtgacccagcctggagcgctgatgtggcggctgtggtcatgcaggaaggcctcgcccatatctgcttagtcactcccagcatgaccctcactcgggccaaggtggaggtgaacatccctaggaaaaggaaaggcaattgctctcagcatgaccgggccttggagcggttctatgaacaggtggtccaggctatccagcgccacatacactttgatgttgtaaagtgcatcctggtggccagcccaggatttgtgagggagcagttctgcgactacctgtttcaacaagcagtgaagaccgacaacaaactgctcctggaaaaccggtccaaatttcttcaggtaaaacaatcttacccagggataattaagaatgggcagagggattggtataaactactcctaaagttttagaactgggaaaaataagaagagaaagtctttacttagctgggattttcatgagataatgaaataaaaagagaatgttaaatgtctagcaaatttatggagtaaacttcgctgaaacatatgaagccttactagcgcttttggctttaagcctttgtgagctgattaatgggtgttctaggagattattttgcctaacttttgtaattgtgattctaggtacatgcctcctccggacacaagtactccctgaaagaggccctttgtgaccctactgtggctagccgcctttcagacactaaagctgctggggaagtcaaagccttggatgacttctataaaatgttacagcatgaaccggatcgagctttctatggactcaagcaggtggagaaggccaatgaagccatggcaattgacacattgctcatcagcgatgagctcttcaggcatcaggatgtagccacacggagccggtatgtgaggctggtggacagtgtgaaagagaatgcaggcaccgttaggatattctctagtcttcacgtttctggggaacagctcagccagttgactggggtagctgccattctccgcttccctgttcccgaactttctgaccaagagggtgattccagttctgaagaggattaatgattgaaacttaaaattgagacaatcttgtgtttcctaaactgttacagtacatttctcagcatccttgtgacagaaagctgcaagaatggcactttttgattcatacagggatttcttatgtctttggctacactagatattttgtgattggcaagacatgtatttaaacaataaactaaaaggaaataatctccacgtactaccatcttgattaaattgtgtaattttttataggaattatgagttatctgtagtacttggaaacagaaaatgtgtgtatttaaagacgatgcctatgcagtatattgtttgggatagattgcaaaatttcacactgcatgctttgaaacagttttccttagaaaaagcttttgctatcttatcctgtttacattatttctttattttaattctgcttggtgttcttgcattgcatttaatgatcccttttctccccacctccacacactacattttttttagatttaaatagttttactattttaaatgattgccgtacaattagtagacttgaagacaagttttaaatatttttcttcaaaggcttgttaaaccaatcatgttaaaaggaaattcttggttttggtttgttgttgttagcattagtcatatttgatttagagggtaacttaaatcagttatttttagctttttagaactttgatctgctagggattgtcaaaataatctccttgaggcatctttatttttaaaatgagattaaagtatgtgatttgcttgttatgtggctaattagtggcaaagctggaagtcattcccagtctggactttagttctttgcgccaaaacatgctatattatttatttatttttttgcttgtcaaagttatacttaattctgttttatatttgtatgtggcattaatttgggtttgcacatttttattggactattttagttgtgaagaagcctgttctaaagtttaagtcacatgactagtatgtggcagttgacttaaactccaatactctttactatcattgacttaaactctgatactctttactataattatggaattgtgcaaatacctctgagtttaaaatattatttttattatttttggtgcacattcctaaaagttaaggaaggagcctcagtaatggaattgcttcttgaccttttgcaaacctcaatttagcaaaataattaggaacgatctaatagtgatgatacagtttttaactgctggatcagcgacgcctatttcaagtagtgatactaactaaactttcgccggtctttcctgtgtctgtgggccttcctcctggtgtgacagacttggggatttcttgtaaacttcctaactagtctgaacctttttatttcttattgggaactgacacttccctatactttaaaactcacatatgtatatttttgtacatctatctcctaattcaaaagtaattgagattgtcatttcattataattccgtgagtatctttaaattactatcaaatatgttactaaataatttaataagaatatagaaatgaagccactgagatccttaaagttgaaacctgattgttattatattttcagtaaggatttggagatttttggacatttttactctcataatctatgcagtactgaaatgaggtctaataaatataaccaatacatgttaggccataggttcttaaatttagctacctgttcacctcaacttgagagctcttaaaaccctcagtgtccaggttgcagctcagactagttaaataacgttttatccctagaaatgttttttttaaagctacccagatgattccaataggcgtcaaggctaatagccactgattcaggccttgctattcaaaagtatggtccgtaaaccagcagcatccctgagagcttgttggaaactagaattcagggatcttttgtagacctactgagacaggcgctacctgtaccaacatctctagatgattcctgtgcataataaaatctgataaacaaaggcaataggttattcttcctgtgctggtaaatctctggcaggggtccccagtcaggaaaaagatttgagtattaaggtctttcaaaaaagttaactggccatactcaactgtctataaaacctctataaatttctgtttttatgtctatgaattattaaataaaatttaactcatttttaagaaattacattttctgttatcaagaatacaattcttactagatcataggtgaaaatgtcaataatgataggagcaaattaaaaattcagataattatttttgacttttctagaagacataattatctctggaaagcatatacagtagtctaattccaactgctactcattaagtattggatatgtgataaaaactctatcgataactccaatgtaccttctctaatgtactgtaaatttccatttcctatcatgtgcttgcaaacaaagatttcctatgccactaaactcaataagtgagaagcttgcacattatttcattttgctatagctacgatacatatcaaatgacagctactcctggtccctcatttgtatgttaaattccttgttaattttatgacaagattgttgatcttggatttcactttcattaccgtcttagaaacaaattggatttttctgctcccagatgccactagagtagctttgtaaagctcatttttcttatctttacttagtttctgtctctaactttagtttcctttttcagcttccctgactaattctcttaacctccaattatctttaacagaagttactaattctgcaattcatatattctggaactggaattatctttgttcctaagcaaccaagtatacatatgaaacggtctgtacattaatgcctcataatagcagctcttatttgggaaagggttatagtacatttaaaccatgtggttttccaagcaagttaagactggctatttgtgtttagtgtcagaatatgttgaattagaagttgaagagtttctaaagtgattttaagggcttgaggagagatgaacccttttgcttagagccagaacttagatatggggtgtaaatatttatattacactaatcattaagagtaatatatttaattttatccatttttttagtgccttttttgaaccaatcactgggctagatgtggggaggacaaacatgtaagcaaatcactgttagaagtaacttgtacaaagtgtgtaaaaggacacagtggtgaaaggggtgacttttaggagaaactttatagagcaaggaccagtaagtttacctaaaaggggaagaagaaatatggagaaattaagtgggaagatggggaggggaagtgtgctaatcacctaagaacctccgtgctacaagaaggagtttgggtttgaccattaggagaaacaattacaaagctgaagcagcatgctaaactgcatttcacaaataccactttggcagcatcaaggatcgattggaggaggcaagactggaggcaggaagactggttaaaaaaatgcatattaggaagatatgagagaaaaatgataatggccttatcaaaggcagcaataatgttccttgcaataggaatgaacagaagtcaacaggaaatattaagagatgggatcaaaaggacatgactgcagattgctgtttagagttatggaaaaaagtagaatccaaaggtaaatctcagatttcttgagtggtgggagagatgatgacacaaaatgtaactttaaaaatggtaattaaaaaaaaatgttttatgcagtggtggttaaatttactaaaagattttttcaggattcccatagtgcaggaattagcaagctatatctcattcaggccaatcagttactgctagcggaccccatggccttgtgctccccatcttaacatagtatctctgatttgtctcaccagacaaatcagagatacacttccccttttattccgtgaggaaccacaagagtctgaactgtggcatcaattttgcagttggatttacatctttcttaatgatttgaaaataatttgtttcaaaaattgattttgaccagcacacaattttgctggtatatcatgtttaagtaaatgaattctccagcagtgaagcacaactaaagtgaagagctgaagagcaacttaagaaagaacaattaattccaataaagttggtaaaatgctcagtaaaataattttcttccaatggatgtcagcatatttaaactttgtggtgtgattcagtttatatactctaagagattcagtattttagaaaagtgctcttcaagattttcctaatgtattatatgtatctctcatgaattgaattgatttagaaatttagtgtaaaagtgttacacacagccaacatgatttataaaggatctaggatgcaattataatatttttgtgaatcaattatgcctttttaggaaaagatttagaagttaaaaatgcagctaatgaagctgttagaaaataaaacctgtattagtagtcttggatttaacaaggagaacaatcaggagttgctaaatatggtcatcaagtagtaaacttcacgtagaaataaaaaaattgaccaagttcagtaaagagatatttatttaggttaaaaataccattcaaaaacattgggagaaggtatttattaatggagataccttcttcagtggcgatgataaagtctcattcattgtttttctttatatagtaagaattagtcctttttaggaagtgtgtgatatatatcaccatctgtattctcatccacatgttacactattatttctaaatttccaagaataatctgtaaaataactattttgcagtatttaatatctctattttcagtaacatgttattatattgtgttgagataaataacactgattaataaattggaatattatgaatgttttaatttaaattgagaaatgaatgagtttctgtaaggacaaacacctttgtgtgtagtattatagttgcatacaaatttgaggctacagtgtttgctttttacaatgaatattttaactctataataattgacattgatatgggaaggtcttaaattttcagatttcagtgctaaggatgataacatttatgataaattgtggagacttggatatcagtcttcttttaaatttcctttctttatttcctaaaattgcctacattaaaaccccattctttagaatgttagttcaatggaagtgcctgttttctataatgtcagagatttaaggaatttaaagcttatttctatttgggtgccacatttgttttcaaaacacccaatactgaggcaagagcagtatttgccaagtagcaaattcaagagcaaaatgttttggcagtcatattgcctggctttgcccagggttggtaccactgtccccactccaggaatggacaacctgttataacaaaagtaactgtgtgcttattaagtgtcaggtcttatggtaagtgctttaaaatgcattagtctttcaagaacccagtcagaagggttttgtcattactattttctgatgcaaaaaaaatgaaattaaagaagattaaataatttatccaaaataacagttagtgggtgtgatgaggtgctccctcagctatcaccctaaaaaatctaagaatgccagttcttctcagctttcagtttggagtaggcaaacatgtatctaaaaataaaaataaattatttgatgacactaaattttatataatcagccaaagtttatgcaatcatttttaatgtttttattctattattttgtcatcttatgaaaaatcaggaactcaattctgtggtcctctaatctacctggatcatagtggagaattagaaagcagagaaaatgtggcaaatctatgtattaaagcaatcccctcaagcactatccagcattcatttattgttatttcacacctagtttcagcaagctttttttgttgcttaattttaaacctacaattaagtcatgcactattacaataaacttttttttaatgactcaccttaagtagctagaactatgctacccctgggtatgcaaggatgaattaagacagttttccctgcctttaatctagaaattagatatcagcaggagatgaccacaagtggccaagttgacagaattgacagcagttaaaagtgacagctgatagtgggagtggattctgaaacactgtcaaaagaaaaaaagcctagagtattatagagtatttcactgggacttgaggatgttactgaggacaataccagtacctggtattcacactgaggaaaagattaaattacattcagtgtattctgttaaagaagtcaaataaatgtaatgtctttcaatgattttcatccaaaaatagtggtactttaaaaaatctttagctgtcatacctagaatgactgttccagataaccagagttttactatgccttaatagtctcagtaataaaactcaaataattgttgaaggatgaatttttgttaaggaaaaaaatcccaatagattttagttgtacaatttattcagagataggaggtccttctgagttcaagtctacgttccagaagttttatgtctggaatttttcatcaagtcctagtgtaaacattgactagaactttttgtttgacaccattgtgaaaaattgctctgtggatagaaaacattttaatcttgtgtttcagctcatttgatctgatgaccataatttatagtttatttttcctccccaagtgtgttgttgactatggtataattctttttttctttttctttctttctttctttttttttttttttttttttgtttgatgagtttgaagaggaagcttaaaatacatttcagtacatggctctgaatcacttaaaatcataagaggttaaagctgtaaggaactttatatatcatcggacctagttccttcatgttacagatttaagccagcccagagagggttggtaacttgctcaaacacaataggagtttttcacagggtccacattcctgtttgatatatctgattccaatgtcacctactttttgtcacctattcatattgagtcatttggggtagaggaacaaggaacaatgcaggattcaaaaatgccttaaaccctccttatttatcaaattatcatcttgtggcaaggcagtttttctctgagcagcattgctgagactcaaactcagttttgaagtcttgttcattccttggaggagtatttatatttccctatagggaactcttcctgcctttcttcttctgagaaccatttcatttttctgaaaatcatgtactaagtacctactatgtgacagggactctaatagcccccagtgatcagaagtaaagaaagatcacagtctcttccttgcaaaaaaacacagtctacaatggggaacgaatggtaaagcagtagtaatagcagtgcaatctggcacaggaacatgggagctcagagggctaactcagcctggctttagtgaggaggtattcccagagtttaaactggcaagttccagaagcccacactgatcttccattagtttctagagagatcaggtgaagggacctgagattattcctcttttaaggcctctcaactttactttttttttttttttttttggagacaagagtcttgctctataccccaggctggagtgcagtggcctgatcttggctcactgcccctctgcctcctgggttcaagcaattctcgtgcctcaccctccccagtagctggggattacaggtgcgtgccaccacacccagctaattgtcatatttttagtagagacggggtttcaccatgttggccaggttggtctcaaactcctgacctcaagtgatctgcccatcttgtcctccccaagtgggattacaggcgtgagtcactgcacctggcctcaacttcactttggtaatatttttcttctacagagtggtctctgtaatccctgatctctctaaatgttaaatatttactgtggagtcaacaaacctgagaggagacatcatggagaaggagattccattacctcctaccctcataagaaaatgaaaatcaaatacagaccagggaccatgactgaaaggactctgaaagattgtggaacctttgtataatagtatccatgtttttgttgtctcctctgcatttcttacatgactaagcactgactggttaaaccagaaaaggaagcttagcttctttcgtttttaggacagcaaagatggggatggtgacaggggagtttgagacattctgtccctttccatagccattcctggaagaaagaatgtccaggattaactggttggtggcacagccacctcagggaaagggaaactgacccctggggactgaagtcaggaataaagaagtgacaaggagctagctggggcctggggaaggccctggggctggacactagaaagacccaccggggtcttttctatttttatattcaacattttatctttcgttgtaaaactcaggaaaacacctttaacaaacaaaaataacttctctcttaagttgttcattttactaaatggccaacatggattggatatggtagaaggaaagaacattttctgcagaagggagaaaaaaaccacaatctattttatgaggaggaatgaactctgggaatagttctctgaccctttgtgtgtcagtgtgttctcagcctgaactggaagaaaatgggatagcatgtggaatgtgggaaagtgcgaagactgatgcaaaattcactatctgcctcattaaatacactagtaggttttcaagagaatgagtctgttatcaccacagtaaatttctcactctgggcctaactccttatctaaaacttaatagagcttaataagttcaaatttttcctgtctttctgggaatcattttcacctttatctctgatcctgtactttccctaggtcagagtaaaatataatgggaaacgggcaagtaggtaggaaatgtggagaaggtcaaggcctttttataatggttcattgtaaatttaaaattcttagatatgtatttcatacagattcacatatgttcttctggatgaattagaaattttaattgtgaggatcaataaagtagcgcaaccagctttcacatctgtatgaaatttaggactttgcaaaggatgttgcacaccaaaaattacaaaataattcaacgattatttgctacagttaccaaagattataatattaacatttgcaagaacattgcatttgtgaataaccaagtatgatacaaggaagaaatcatccatgtcattctcagaggatatggtgtaagaactggcccatgactcatgacaccaggccctgccactaggttgtgtgacttgaggaaataatttcatctttttgagagttggtttcttcatctgcagaatgagcaaagaagggtggctcttgacttcataatctctcttgcagatatctgattctacttggtgcagtaacaataattgcttgttatttttgcgatcatgtctttccagtaaaataaatctttagtgactctcaggtttaaaaagaatcttttttgcaccctattttaaaagctgccagatttggggtttggctgactactaaggagagcagcctgctagaaggagcaaattccagagctgagggtcatttatttggaatgctttgccaaacactcccctatttttaaagttgttgggggactttaaacttgaatatagggtggtaggacaattgtttgaaccactctgtaaatacgtgcatgaaaatcttgaggtttacaaatattttttaatagtttgccacatttcaatggcatgtcaagttgcagggtcctgccacttttcttcttgttattttcctcttctatcaactttgctcactctcccaaagaaataggcaatgagaaaaaacaggtcttaatttttactggaatgctctttccatttggctagaggtttctcaaaccaggcggcaccaatcacctagggagttttaaaatcatggtgatgcctgagccctacctcaactaagtcagaatatttgggaaaggagcccaggcatctgtacattttaaaagctcctcaggtgcttcttatctgcagccaggttaaaccaggagtgtcatcactgagtaggactattagctttaatgtgtcctgtgaccacaataccaatcagctctctggttaagaaaagagatgaacatagacattctgaaaaggcaactttataaagttgaggggaatgtatttctttagctttaatgcctcactgtgggatttgtctatacatttatgtatttttaaattactatcataaattcacaattagtaccaaaaccgatcaatttgtgaatatttattgatgccatttacatgcatatgtgttgctaaatacaatgggagggggcctacagaaaggtagagaacccagatcccacccacttcttgaagcttataatcattttggggtgcaaggattgtgtaaaacaagacacaaaaatcacacatgttacagaaattaaaagctaatatcactgagaacaggaagacattacaattggctagaatcacctcaggagatggtacttggatctgggcaccctttgaatgtttttcacttatccggtaggtaaggacattagctctggactagaaaatcttggatctcccacaggtgagctctgtgaccttgagcaagtaatgttacctttatgattctcaaacttagctttgtgagcttcaatttgtaaaatggaaaaaatgataaaactgctctcatagagttgcaaggaataaatgatatgatgtaagcaaaatatctgaaaattcctaagagcgcaatttaagttcattttgttccttcttatcgcttttttttttttttttttttttttttttgccaaatacaccacttgggcaacagatcagccatggaaatatgatgcagaagatctgcctcatgcctgttcctaacataaatctctctctaccaaagctgtctgtcagagattgtgttcaaaccagaacaagtggacccactcagtccagagttaccctcaacatgagacaggctacccagctggttctctgtctttataatatttttatttctttaaatttgatgaaagacccacttttgtgagttttacacacaaatgaagaggagtacagaagagcacatttcaattgtaatgttcatgccaggaatagtaacctcttcaaggataccactgagtgcacacagaatgctgggaggtcctgactctgcttatggaaaccacagaaactcatccctgaaactggttctatagcagccatgaccctcattaaacttccaatcaagtaaaattaatattagctattaggttagatgttaggtattgtctttgcctccatttaatcatcttacttcctatggtacctgttaattatgatttgaatctccttaactgctcagcctgggtgtttcagccatatataagtcataaacagactacaattatcttactatttctcagttacttgcaaacaacaggaaccaagtctgataatacaagaaatgaagaaattttctggaagaaggcaaagaggctcagataggaacaaagaggggaggcacagtcagaaccctgctatagaaatcacctgtgtaaggcaatgcagctgatggaatagccacccccagacaaccatcaccaatacactggggcttctgagagactcaaccagagcttctgagaataatctctgagtgtgaaaatcagattggctattgaaaggtcacatgcccacattctatgaaccaggagcaggataacggactattctatatgcctacatctcctcctctcattcacatctcctatgtaccttccccaaccaggaggaatttgtggattctaggtagccaaaacaaaagaaaatattcactaaccattttaaagaagttgaagtaagagaactaacatttaccaaataccttgcaaagccagccattgcattggtattaggggaactggtagactgtgctgttattagtaccttgcagtcagactggcattgttcaaatcccagctcagccacttgctggaagaaacaatggtcatgctgagcctggactggcaggactccagatcctgatgacatatcactgttttatgtagccctgttggactgatttcacttctttttagtctcaggatttaattcacaatgagttgttttttggtttgtttgtttgattttgagacagagtctcgctctgtcacccaggctggagtgcagtggcgcgatctcagctcactgcaacctcagcatcctgggttcaagcgattcttgttccttagcctcccaagtggctgggaccacaggcatgcaacccctcacccagctaatttttgtataggcgggttttcgccatgttgaccaggctggtctcaaacttctaacctcaggtgatctgcctaccccaggctcccaaagtgctgggattacaggtgtgagcactgtgcgagcccacaatgagtttttaacacttactgttcctcatcagagatgccaatttgttaggaaaacaaagtgcatccctttcaggcttcatatctgcttagaaaaaagcacaatcctataaattacgtaatcatataaattagttgagtaatacaaaattatttttccttttatctgacttttttttctgaataaattaccttaaacctggcttcagtttgctcataagctcctgatatttgaacaggtatctgcccaacaatcagagagaattagtcctctgcaccttctgagaggtattaaaaaaaaagggggggaaagaaaaagaatcagtccaattggtagattttaaatggctcatttaaatactacaagtttatcagtctctaaattttcagcctaggaaaatttcagccaggaatttgatattagtcctgatgcatcacgaaagtacggaaactcagtttctacagacccagggcttcctggggttacctcaggccacttatatctcttatctgtgcttttccttagctgacatttggttctagaatgaaatggaagtcaggaaagaggaaaatgatgatgtacttccccactcccaacacacacttgtctttagcctaaacattgttttccaatccagctgtcaaacttcaagtatggaagaggaggagaaaaatcagctagcaaatatatccagatttcctgctgggcaccaaatgctaagcagggtaggccaaaaacatttaatcaaaaaaacaagatccaccacggtttttactctcctaaagtaaaatataaatttggaggtgagccaaagttaaaaatataaaaatatagccagtgtttctctcctactttcctagggttgctaggttttgggagcctgggatgggggaaaacagtagaggagacatacttattataaaacattcaaaatagtgaatgggacatacttattctaaaaatttacttgctgtttatctgaaattcaaatgtaactgagtatctagcaaccctacatcctgatattcaactttcctactcccctggtcatgactggcttgggcaggagagatctttgcctgggtagatgttgggaggagcctggtgaatgtattccttcccaggattggtcttggctctagttctggagcctctgttggaagaatggagaagggctccattccaaaaaatggaatagggatctccttccctatgtttggaaaacactggtctaaggctttcaacaatagccttgaatatcaatgaatgtctacttagcaatcatcttttccagatgattcttatgtcttaaaataatgttacttcaagaaggtgcctaattgtaagacatacttacagtaatagtagttgggttgtgatgcaatttgataatgtgagattctcttagaaaataaaattagtaataaataactacagctgagtttataatcttaataaattaaggtagcttaatttaaaatgtataactaaacaaaaactaagtcacaaaaactccttgatgacatgaataacatacagcagggagacagtagtaagtagtggctaaggggaaaggctgtggaattacaccacctgagtctaatatctaacactgattattgaggtgacttactgaagtttcctcacctgcaaactaagttacaacctattgtgtttttttaattgattgagattattaacactttttataatgcctggtccagagtaatgctccaaacattttacctattttatatgctaaatttaaacttaatctttttgggacttaatatatatccatgcacatcgagcatattttaaattcagaaaggaaaccaatatgccagcagaaataaaacaaatattcttgttttcaaataaagatcatttctttatgagaaagatgaaaattaacgatcttttagagatagttcaatgttagccactcacagtcacaggtttaaaccgtgaagttagtgtttatttttatgaatctaaaaacaattgttcccagccatggcatgaagtcttcctattgccccaacccacataaacacactagaaattttcattcttagggagggatagggaggctgggggctactgaatggacattttgttagttaagagctcactcacaggctgaaggagtgtggaataggtccaccattagctattctggccatacctctcttagagattggggtcctggttaccaacgaaggaccatgtggccatatccagagggttggagcaggtctcagggcccattgcctggcacacctcctcccagaattcctgaggtataaccttctcaggaagatagcagagctcttttctaacactccgctatttctggagagtagtgagtatattcccctccaggccttttcacttttattcagaaacacagggaaaataataaaagtctgtctgtattatgactagctacaacaggtgggggttttctttgcagtaatattttcaagtggtatcacctagcagctggattcctttgccttaacagaattggcaccctaaaagcaaaagagatggaagcactgggagtgataaactttgtcagtttagaatcaatttagatcagtttaaaaccattcaaacttgacacattcaaaagctttcaatgctatccactaagaaatcatatttgaggaatttttttccattaaacatttagtctggcttaaatatagtaagatgctaatcttttcgaaacttgtttttctttctttttgtaaaagtcagttgagtttaatataacaaaagggctgaataccagaggtagagaaggaagtgtcccaggcttggtttcaagacaactaggtcctggattctacaactaagtgattttgtgaccttgagcattactagccattgtgagcctcatttataaaggagggataaagattaaaattatgaaatctttctgtaagtaattggcacacagaatagacgttcaataaatgttaactctgtagcctaggagtgatctggttacaagctttgttaaaactccttctttaaggaaatgtaaaaataaattggtactgtcaaagcttttatgcccaggccatgtagagattatcttccttccaaagaaactaaaatggattgagaagacaaatatcattccaaggaaaggctagaagtctgcaaaattatacaattgtactttagtgcaccaaagattaaaaataatgcagtcagaataacatttatttcatctaccagaatgttaccctatttcttgcctttgattagtttaagaataggaaactaagatagtacagacttataaagatataacgtatttataaatatgtatctttgcatatgcaaattataatatacatattttaaaagtttgcttcagtgaaatttagagcatgagcagacaacctatttttggtgaagagtcagagataataaagtttttagcttttgctggccacacaagctctgtagtgactacttgactctatcatggtatggcaaaagcaggtctcagggccacagacaatagtaaataataggatatgattgcgttcccataaaactttatttacataagcaggtagtgggcaggatttggtctgtaggacacagtttgttgaaccctggcctagagcatgatatagagtatgcttacaaactgggcataattaagataactattctagaggaaaaagaatgtatatgcttagattaactcagcaattacataaacacaactgtagtacatacatctattcttttagcatcaaggcttgctgagttgaaaaaaaaatggtatggttctctaactatattctgttgagttgctggtgtgtaaatcacattgtaactggccactattactttttggagttctaacatatgcttatttgcacattagggtttactgtttttctgtgatagacaaatactgaaatttgattcagatccattacacaaatggccaagacaggatattctgtgaatttcctgggaagtatattcaagtatcacttacctgacagcatctgagccattgtgttataaggaatttcctgcagggattgaattagttaggcttagccctcagtggttttgtaactatttcccgcattcaccttaaacaatgccttttagaagtggtttttgggtgattctttttctccaggaagagattataaataatgaaatgattagaccattagagaatttaaatcagtagagaatgctaatttctttttttgtcatagtaacagagcaagccaacttaatcagtgccctgacaaagcatccagcaccaacacatacattagaaaggtatctaattcctcaccattttggtattctaattttataaattttaattctattccattttgagagtatctagggatcagaacctttatggaagactaataactaggtaaacactattacctagcttaagagaccctaaaatgtcagtgacttcataccacaatggtttattttgctcatgtatctcattcctgtgtgagttagatgaccccaatccctcctgtactatgcccttgggaacacacatctctatggttacagtcaaaggagagagttgtagatagaaaacggcacacttccaagtctttgctattgtgaatagtgccgcaataaacacacgtgtgcatgtgtctttatagcagcatgatttataatcctttgggtatatacccagtaatgggatggtggggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgatcgccattctaactggtgtcagatggtatctcattgtggttttgatttgcatttctctgatggccagtgatgatgagcattttttcatgtgtcttttggctgcataaatgtcttcttttgagaagtgtctgttcatatcctctgcccactttttgatggagttgtttgcttttttcttgtaaatttgtttgtgttcattatagattctggatattagccctttgtcagatgagtagattgcaaatattttctcccattctgtaggttgcctattcactctgatggtagtttcttttgctgtgcagaagttctttagtttaattagatcccatttgtcaatgttggcttttgttgccattgctttcggtgttttagacatgaagtccttgcccatgcctatgtcctgaatggtattgcctaggttttcttctagggtttttatggttttagatctgacatttaagtctttaatccatcttgaattaatttttgtataaggtgtaaggaagggatccggtttcagctttctacatatggctagccagttttcccagcaccatttattaaatagggaatcctttccccattgcttgtttttctcaggtttgtcaaagatcagatggttagatatgtggcattatttctgaggcctctgttctgttccattggtctatatctctgttttggtaccagtaccatgctgttttggttactgtagccttgtagtataatttgaagtcaggtagcatgatgcctccagctttgttcttttggcttaggattgacttggcaatgcaggctcatttttggttccatatgaactttaatgtggcacatatacaccatggaatactatgcagtcataaaaaatgatgagttcatgtcctttgtagggacatggatgaagctggaaaccatcattctcagcaaactatcgcaaggacaaaaaaccaaacaccacatgttctcactcataggtgggaattaaacaatgagaacacttggacacaggaaggggaacatcacacatcagggcctgttgtgggtggggggaggggggagggatagcattaggagatacacctaatgctaaatgacgagttaatgggtgcagcacaccaacatggcacatgtatacatatgtaacaaacctgcacgttgtgcacatgtaccctaaaacttaaagtataataaaaaaaaaaaagaaaaagaaaatggcacacttgctcttgactcccttggccggaggtggaggtaatacattgttagttctgatccttgttcattgatgagaaccagcccacatggcttccacctactgctagggactctgggacatacagacaagcacataattatttggtgatatttggtgagccctaactgccgcagaaaaacttttgaagcatttagttctctcccgagaccagaaatcaatcaggtaaacatgaataagaaatttatagtattatctcagtttttttttattggctttaacaagagcatatgctgggaggatatttgctatattctgctagtttccccaatttaaggttgtctgttttgattaaaaccccttagcccagtggaaagatgaaactctcatctatttagtccttaatatctctatcactaaatggataggtttcatgtactcttcagtattgatagcctactttctaagtgtgtgtgtgtatgtgcatgtgtttctgccattacagtcattgtatgaaacaattatgtattctgacaacagctagcacagatttatctatttaataaatgttggttgattaatagataaaggcacgtttatatataccagcaaatacgaagacttggattcagtaaagtttgataccattcaatagcattaagattaaggatgactgtgacggcctttagtttgcatttttagactgcttaatttgggtcaatgtttctcaaagttatctccagtggtctaaactgttaaatctgttccgaagtctaggaacctatgtcagtcaaaaaagtatgtttttagacagctctcctcaccccattccgtgtgaagatggccccactgatattcataaaaaataagaatattccctcccaatgaatgttgctataaggaaatttgctcatacagaattggtaaatggaaaaatgatgtcactataatacataagtcactataattcagttttccctagcaccttaatgtttatactaccaatgccaccacttgaatgccaaatacactaagagttggacacagtaagcatatactcatacagtattgtaaggaattcccattctccttgtattcttcctctttgcctagttttgctgtgtgtgatttcttggaagggcttatataattggccccaaacttagttcattttgcccttgtccccacaactattcagccttaacattttcttacttcattccactgtaatcatttatttagtatagaatttattaggaatctaaatgcctttaaaattatgctagtatttttatttgagttgtttcgactttatgttttagctaaaaaggtgtatggactttgagttgactgccccaactctgtttttatcataagctgtatgatttttatgtgtgattttgtagaaaacacaagattgcttttaggaatgaatatatcacattataatagaaatatctgttttcttgcaacttaaattgcatatattttatgaatggaagaatgtcaacaacaaaattggcaatgggactatttgagaatttgccatgtggaggccgtttcctgaccttttatcctttatatgctagagtgctttagagtttccaaatggtgttcatatgtggaattttatgtcaatccttgaacaatactacaaggatcattattaacatttctacttgatagacttggaaatcaaggctcagaggagacaaatgttttgcctacagtagattggtgacaacattctggctataattagttactctattcaaataaacatatttgagcttcgattttacttagggcactggggatacaaagataattaaaatgaaactcagtcctcatccaaccagttgcctctcttcttcctcccactgattcagggacacttccgtttggactgggcagagctagacaatctcaaactcatagaggcatctgcattgctagtttcctagaagagctggaggctgagtatccggactgctctgcataggggatatgggacacttaggtggctcctggccaagtggcccaagcctgttgctgactggaagtctgtcacttggctctcctccctcgccagttcgtattgtagcctctacccttgacactgtctcacccagtggaaacacagctgcaagagctgcagaaggcctattacttctaatctttctgcttcgtatgatcggtaattacaccccagggacacataatgaagatggttcatcactgctttttatgtgcttcatagtgtgagatagtggactgggaacttgaatcagagcaagaaaattgttttctgctctaggtttggtcacttaaactagccacagtatattaggcaaaatatttcaactgcttgggcatcagtgttctcatcatttgaggacactgtctcattagatggtcgaatagggacttttccagctatagccttctgagattcctcaaggacacatcgagtttgtattgcatggtcaaaagagggctccaaggaaccaggtctaacaagctttaaggtgagtgagttctctcaatggtgccccgactttcctgacatccttctgaatcttagacaagcctcggagagagatactcatggaatgaccaaaatggtagcaccagatctgtatgaggtatttaatcattttattttattttaatttttagacagagttttgctctgttgcccaggctggagtgcagtggtacgatattggctcactgcaacctccgcctcccgggttcaagcaattctcctgcctcagcctcccgagtagctgggattataggcttgcgccaccatgcccagctaatttttgtattttttagtagagatggggttttgctctgttgaccaggctggtctcaaactcctggccttaagtgatccacccacctcagtctcccaaagtgctgggattgcaggtgtgagccatggcacctatccaaatcattttaaatggtgatgattatgtccaataagtccatcttattctcttgggcatctcaaccttttcctgccttaggaaaatggaggtcctctaactcctaagatcttgtcacatgatcctgctgtaggcagaacccacaccagttaaatgtttatttacttgatcaatgtttagcctgtggttggcttttaaatatcccaacggagactgagaaagcagtgcagagagtgctaaaatacagacaaaggaaaagaaagaattggaaactaggagaaaacaaggaaaaaagaaggggaaagtgctttcagcatttcttttcaacttcctctacatgcttagaaaacagaattgacttttgtatgtctgtggtagctttacaaataaattaaacatattatcaacgtttgccaatttattttacaagtatacggaatatcattagcacattctggtgatagtatgtcagatatttaaagagctctagcttgaagaaaatgggccttactttaagagtgctatatttgttttatgttctcatacttaatgatctgggacctaattttcttcagccctgattatgctttgtttcatgacctttaatatatatatatagtaatcattaaatcaaataattataagtcacttaccaaaggaattaaatatggaaaatgcatttgaatatgtacatgattcatccacattttaatatctatccttacttctgtttccttttgtctcccattaatgataaaatagctgagaagattgttctctcttttctttctttttttttttttttttagacggaatcttgctctgttgcccaggctggagcggaatggcatgatcccagcctatggtgacctctgcctcccgagttcaagagattctcctgcctcagggtcccgagtagctaggattaaaagcatgtgccaccacgccctgctaatttttgtatttttagtagagatggggtttcacatgttgctcaggctggtcttgaacttctgacctaaagtgatccgcctgccttggcctcccaaagtgctaggattacaagcatgagccactgtgcccggccagattgttctctcttaatgggctgataagtaaccaagtaaaacatattgtacttttaccccatgctagaggcagcaagcccaagctgcagaatgcccaattacacaatcctctattagccaccaaagagaagatacttttaaatttgtattacattatttaaatagaaaaaataaagacagaagatcctttaaaaagcaaactggataaatagtacttcagaattctatatattatttgttacaactgcatgtaaacctataattacctcaaaatgaaaagtttagtttttaaacaaagcctattattgtatgattaaggtggataattgagctgcttcttatttttattatagtaaaatatacataaaataaaatgtattattttaactgctttaaaattgtaattcagtggcattaagtacatttacaaggttgtgcaatattgtgaaccactgtctgtttcagaacttttgttactacatccagtggaaattctgtatctgttactcttattcctcccttccctctgctcctgggaactacagatctgttttctgttcctattaacatgccgctttaaataatatttcatataaatgaaatcagacaataaaaaggtattttgtgtctggcttctttcacttagtgtgatgttttcaagattcattcatgtcatagtatgtatcagtataggcccatcttgttttaatgcacttcactttattgtgcttcatagatactgcgtttttcacagattgaaggtttgtggcccactcttcacttgaacaagtaacagcaagtgctcattttgtgtctctatgtcacattttggtaattctcgcaatttcaaaatttttccttattattatatctgttatggggccttgtgatcagtggtgccaggaactgtgcctatataagatggaaattttgataagtgtgtgtgttctgacagctccactgaccagctgtttccttctctctctcccttttcttgggcctctctattgcctgaggcacaaaagtattgaaattagtctaaaataggcagggcacagtggctcatgcccgtaatcccagcactttggaaggccaacacaggcagatcacaaggtcaggagatcgagaccattctggtcaacatggtgaaaccccgtctctactgaaaatgcaaaaattagctgggcgtggtggcgcctgcctgtaatcccagctacttgggaggctgaggcaggagaatcgcttgaaccagggagtcagaggttgcagtcagctgagatcatgctactgcactccagcctgggtaacagagtgagactctgtcaaagaaaaaaaaaaaaaaaaggaaagaagttagtctaaaataaccttacagtggcctctaagtgttcaagtgaaaggaagtcacacatctctcactttaaatgaaaagctagaaatgactgcgcttagtgaggaaagcatattgaaagccaagataggccaaagctaggcctcttggtccagttagctgagtcatgaatgtaaaggagaagttcttgaagaaaattaagtgctactccagtgaacacatgaatgataagaaagcaaagcagccttattgctgatatatagaaagttgagtggtctgggaaggtcaaactagccacaacagtcacttaagccaaagcctaatccaaagcaagatcctaactctcttcagttctatgaaggctgagagaggggtggaagctgcagaagaaaagttggaagctagcagaggttggttcatgaggtttaaggaaataaaccatctgcataacataaaagtgcaaggtgaagcagcaagtgctgatgtagaagctgcagcaagttatccagaagatctagctaagataatttggtaaaagtagctacactgaacaacagatttttagtgtaaatgaaacagccttctagtgcaagaaggtgccatctaggactttcatagctagagagaagtcagtctggattcaaagcttcaaaggacaggctaactcttcttaggggctaatgtagctggtaactttaaggtgaagccaaagcttattccaaaaatcctagggcccttaagcactatgctaaatctacctacactctataaatggaacaacaaaacctgaatgacagcatatctgtttacagcatagttaactgcatattttaagcccattgttgagatttactgctgagaaaaagagattcctttcaaaatattactgctcattggtgatatacccagtcacccaagagctccagtggagatgtacagagataaatgttgtttcaatgacttctgatacaagattcattctgtacccatctatcaaaaagtaattttgactttcacgtctcattatttaagaaatacatttcataagactatagctgtcatagatagtgattcctctgatggatctaggaaaagtaaattgaaaacctcctggaaaggatttaccattatagatgccattaagaacttttttttttttttttttttggtttatgggaggaggtcaaaagatcaacattaacaggagtttagtagaaactgatttccaaccctcatggatgactttaaggaattcaagacttcagtggagatagtaactgcagatacggtgggaatagcaagagaactggaattagaaatagagcctgaaaatgtgactgaattgctgtgatctcatgataaaactttagtggatgagttgtttctcatgggtgagtagagaaagtggtgtcttgagatgaaatcaattcctgaaatcaactcctggtgaagatgctgtcaacattgttaaaatgacaacaaagaatttagaatattccataaacttagacgataaagcaatgtcaggatttgaggattgactctaattttgaaagaagtttttctgtgggtaaagtgtgatacaaaagatgctcaacagcattaatcattagatattcaaccgtgggtaaaattgcatgctacagagaaatattttgtaaaatgaagagtcaattgatgtggcaaacttcatggttttattctattctgagaaattgccagagccactgcagccttcagcaaccaccaccctgcccagtcagcaaccatcaccattgaggcaaaccctccacctgcaaaaagattatgactcactgaaggctcagatgattgttagcgtttttaatcaataaattattttaagactaaggtatgcatattgtttttgtagaaataatgctttgtgtacttaatagattacattgtagttcaaacacaacttttatatgcactggaagaccaaaaaatttgcatcacttgctttattgcagtggtctggaaccaaacccgcagtatctctgtgatgtgcctgtacttcattcctttttcatagctgaataatattctattgtatggatataccacatttcatgtatctatttagcagttgatggacatttgagtcatttccacctttttggctattgtgaatattactgctatgaacaattgtgaacaagttttctctgaacatatgttttcaattctttgggggtgatatacctaggaatagaattgttgacttgtagggcaactctatgtgtaactttttgaagaactgccaaactgttttccatagcaacattaccactttacattcccaccaacaatatatgagagttccaattactacacatccttgtcaatccttattttctgtttttgtgttttttttattatggccattctactggctgtgaagtgatatcccattggggttttaatttacctttccctaataattaatgctgttgagcatcttattatgtgcttattggccatttgtgtaacttatttggagaaatctctattaatatttactcattttttaattgggttgcttgcctttttgttgttgagttgcttcttattttaaaagaaatcagactcaagaggactttagttgcatgggaaatattctaggtctgggtgatggtttcatggatgtgttcactttgtgataatttgtgcacttatatatttctcaaaaatgagcatgtgtttcctttcttgaatgtattagtttcctagagctactgtaccaaattagtacaaacattagtggcttaaaacaatatattgtctcacatttctggaggccagaagtccaaaaccaagatgttggcagagccatactccttctgaagcctctatgggagaatcattccctgccttttccagtttctgatggttcctggcaatccttagcattgcatggcttcttgacacttgatactaatctctaactttgtcttcacatggtcttctttctccctcatgtttctgtttttgtatataggtatcttaaatactcctctcctttctcttataagattaccagtcattgaattttggccccaccataaaaaacaggatgatctcatttagacatccttaacttaaatacttctgtaaagaacctatttccaaataaggtcacatttacagataccgataccggggattaggacttagacaaatttgtgtgggggaacacaattcagcccactataatgaacatatattaggcttcagtttttaaaagatggctttaaaaaacaaaatggaaaacaattttactggtcagatgtggtggctcatgcctataatcccagcactttgggaggccgaggtgggtagatcactttaggccaggagttcaagatgagtttggtcaacatagtgaaacctgtctttaccaaaaaaaagtaataatgataataaacatttaacaaaaagaaaaaagaaaactactttagaaaaatgtggtagtctaggtttctgagtcaaaatatctgtaggttaaggaggaaaaaaaattcacgggatgctcaccaccataaaagttagaaattcttaatttttgaaaaatgatctcactgtttaaaaagcacagttagatggaaaaggggacttatataaaaaagactttcaaaggatatttatctgttgtgggtttttttttcattttttggagaggaagctaatgaaaacagttcaatactcatttatgtagagaatatctttcaagacattaaaaagcatatttttagtattgccaaatacagagatttctattaaaatttccagaagacatttttttgtgtgtgttcacactgttacccatggcacattcctggttttttgtttttgtttctgtccttaagtgatcaataatattggtatttggtcattttgaacattgtgatccttacctttggacttgttaacaactggctgaggattcaaggcataaaaggaatattatgcttactattgagcctcagcacctttgtattttaatatgacatgtggctgatgatcaaccttgctgggtctcatttcatatatcagttaaataaatatatgaatgaagtaatattttcttcccaagagtgatatttgattcaatagattaaaagttatttgagtccctaaacataaaaaagccagtagggtatagtagctctgtggcaagcaattttagtatcagaacacatgaatttaaaactttggacaatggccttattcagaacactaaaagcttagaagcctactctttagattgtagtgctattttggaggcatatcttttttctttttttctctcagtttttcttttttggatagtattccctgttaagaaacagatgatgaggctttaattcagtacattctcaaattgttcccactacaaaacttatttcaaagataaactttggaagttttcataggtaggactgtaagaatgttttaaataaatcctaatcattttaccagagagtataccttaaaacaaatttttctggctttatttgacaggttttttaaaaaaaataacttagtcatttttaagttgattgtagttcatccagaaagttactccatgttggtaaaaggttaaaaattaagagagtccaatttttgaaaattttcacaaagttctttttatacttttaaattagtcaaaggccaagtatttcataaagtgttgatgtaaattgtgttactgatctttgatcataatgtggaatagtagttgcactcaagatatgaaggaaaaatatgttacagggtttggctttgaaataactgacatacagcagaggcactcaccctaacatactttccatctatacgccaggcagggctgtcagtttgtggaaaggcaaactgggacctccctcagctctgccctcctaataagaccatcctgacacaaagcagcaattattctttgatgacatcaccaccgtcttgcccttatttttatgtgcataatggaagatttcaactttaaatctgacctagccatgaaagtcagtgtgagtcctgcatcatgttttcatcctgctatgtttttactttctggtagtgcttttaacacagagagtttccaacttgaaatatagagaccttttaggaagttttttacataggaatcacctgtctaatcaactacaagaggtcacacttttttttttcctttgagatggagtctcctctgttgcctagactgatgggcaataacgaaatcttggctcactgcaacctctgcctcctgggttcaagcgattctcatgcctcagtctcccgagtagctgggattacagacgtgcaccaccacacctcggctaatttttgtatttttagtagagatggggtttcaccatgttggccaggctggtctcgaactcctgacctcaagtgatctgcccacctcagcctcccaaagtgctgggattacaggagtgagccactgcacccagccagaaagtcacacagagggttacccaaactaagtctcaagatacctgtttctaatgacttttagatagcatagacctctttattgattaaataggaaagagaaaagaaaaaaaaactctagaatttttaggattcataaaattggcatcacaataacagtaatcacttatggctcctaagaattttttcttttttttttttaaccttaaagattagttaatttaattacatcttaaatacatctcgcaagtgactacaaattctttgagggcagagacaatatattttttttaccttttaatcccttaaagaccttctacctttcctttcacatgggacttttattaatgtccgctgaatgaatataacatattcataatatagtcatgtctatacattgattaacatatttgttatcaactgcagagtaggcccagtctttctcttttactctctgtccttttaagaattttaagagctttttggggaaaataaagtaagaagaaaacaatgagtcatgtctttgtagccatctagatttcttagctctgttgcctcattcttcctcctcattcttcccccagccacggtggagaaataaagttgtctgggggctcattactggactacccaatctcagttcccttctgtactttagaactctctccttccctcatcttgatttcactaggccacactataaccctgcttcctggagagaatcagacccatgtaagctcttgagcctcctgttccatggatctctccaccaagacaagagcctactccaggctgccaacctgagattagagagttcatactctgattggtccccatagaattaatcaacggtggccaagagtgtaggtaactagatggctcattcagatctgatactcattcctggacttgtcagctgtggcctgggtggcagagtcacttaaaaacattgcagcatcttcagaaatctttggttggagtagaatagatgccaaaaaaggtagttgttggcttctgatgaaatggaagggtcaaattaaataatagctgaggtctcatcccttctacccataagattctatgatttatcactaaaacaatcacatattaggaggtcataaataattctacacaagttcttctaatctccatattttcttacacctatggtcaaatacatctctcttgcaagaattatataaccaaatattacatacactatgttagaataaagaatgaacactatcactagaacttggaagcagatttaaatactgaaaaatattataggtatcgaaaagaccctttttattctggcagaaatatataaatctgtgtgtgtgtgtgtgtgtgtgtgtgtgtgtgtgtgtgtgtgtgtgtcttctggtgctatttctcaaaagagtttttttttggtagattttttttggttacttttttatttcattttgttaagccatcaaaagctttgagattgggctgggcatgatggctcatacctgtaatcccagcactttgggaagccaaggtgtgtagatcatttgagttcaagagctcgagaccagcctggccaacatggtgaaaacccatctctactaaaaatacaaaaattagctgggcatggtggtacacacttttaatcccagctacttgggaggctgatgtgggaggatcacttgaacccaggatgtggaggctgcagtgagccaagatagtgccactgcactccaacctgagtgacggaccgagactctgtctcaaaaaaaaaaaaatgctttgaaattagcctttacctgtgtgtactacaatttaaaaggccatctttgaaaagacagtaaaacagacttttactatgaaaagctaccatctggaacccttagtaaactgactgttgtctcataaagagtacaaccaagcctaatgcaacttaattgttcacacagttatgtaagatgtacttcttctataactctacaggacttaaaagaactcataatactatatgattgtattatgggttccataaaacattatgacaatgtattttctggaaaaatgtttcctagtgaacatgcataccccagacattttacctttctcttaaattattccatctgattttactaccttgctcttgctagagttaagagttttctgaaagcttattcagtgttaactaatgttacttttcctgggccatttttgttggtattgagttttttctttatgtgatcataaagttatagtttagaacaaggttattttgttgcaagagtctatttaggtgtaatattttttaagcaaattgaagttgttctgataaatgtttatctaaattaaaatataactccataaactatgatgtggccatttaaaggggaggtatattaactttgtggaattgtgccattaaagacaaagaaaaagaaaaaagaaaagcagttggctggatgaagtagtatagaattgcaaacttacatgagataataattagaatcaataagacacctaatggaaaaagaatattcatatgatatattcattcattcaacaaattttattaaacacatcatctaccaatgaatctatgaagatcaggtactttagcaatatagaacaatgtacaataacacataacataagacagtccatgtgaaggcagttcattcctggtgtggtggctctattgtcagcataaccctgtgttactttcatctttctgcttcagcacctagcacatcacttctgttcaagttcacttcatagtccaacagggcagttgaagcctgtcttagtctgcttagttgccatagcagaataccatagactgggtggctaatataacagaaatgtattctccctctgctctagaagctagaaggccaaaatcaagttgctttcagcttgatttttgatgaggcttcccttcctgtcttgtaaatggccatcttcttgccgtatcctcacacggccttatctctgtgtacatagtggagagagacagagagaaagggggtggagagagagagagggagagagagacagagagagaaaaagaaggaaggaaggaaaaagagagagaaagaagaaagggagaggaagaaagagaaagaaagagaaagagagagagaaagagagaagaaagaaagaaagagagagagagaagaaagagagagaaagaagaaagaaagggagagaaagaaagacagaaagaaagaaaaagaaagagaaagaaagaaagaaagagaaagaaagaaggggaaggaaggaaggggaaggaaggaaggagagaaagagagagagagatctggtatccctttcttttattataaggacaatggtcctatcagattagggccccagtggttgtgatttcatttaaccttaattacttccctaaaggccctatttccaaatgctgtcactttagcggttagggcttcaacatatgaatctcaggggacacaattcactctattgagtgaacgctaactattatacaagagttcataactgagagaaggacaaagaagaaaggtagaagaaggataaaagagaaagtagaaggacgtaaaaggcattctgagttgaatcagttctgcacaggggatttctgggatatcccatacaatacttccacttactttttttgggccagtatttagtcgtacagctatgctatctacctgttgtcttctggctgtgtacactgctgccccaagtaaagattttattactaatgaaaaaaacggatattaagagctaataagccttcttaatcatatccagaactgtgctaggcgttgagaatgagaatataagttcttatttttaagtactctaaggaattcccagtctaacaggagactagtacatgtaaaccagttacctttaatataaagcgatacatcctatgggataaatgtgtacaagttctgcaaaaacagaggaagaatgattatcaacgggggagttggggagagttcaccaggctaagaattgaagaaaggaatttccagaagtggggaaaactttagcagaagttcgattgagaatacaagatgtttcagggaactgcgcatattgaagggtggccattacttgacattctgagccagagtagtaatgagattggaaaggtcaaatgagccctcattttaatgggtctaaaatggtgcttaaaaagtgggacagcatttattgggtgatgaatttatagatgtgtgtgtgtatatattttgatacaagaaacccttctgaagaaattagttattagattccattgatgtcacaaggtgttctttttgttgttgttattggttcgtttgttctaatttctgcccttttcaagattcaaatcacaacttaaaagcaaggagttgcaagaatatatggaatggtgagaaatgattgatgttagaaagctttcgaaaattgcaatacataaggaaaattgtccaatgcacattcttatttatctgcatttatctttctatatcctgttgaactttgccgataattgtagaaacaccttggcatttctttcttccatctttatattttcttgatatcattagaaatagatgttcagtctacctcttgcatgctgaccaatcctaaattgggcgatgacctatttattttgcatcttccctgaatgcttaatcttcatgaactagaaatggccagtagaaagtcagtaagtgttacttaatttacttccgtatttattaaatttctcccagagtaaggaattatgagttcctggagcagcacatgtgtctctttcttacagaaaatttcagttccatggtgaggattatttgcacatctctgaagaggcaatggtccatccagacaaaatagcacagagccagtacataaaataagaaagtggactgtggacaagtcctgacaaaattatggaaagaggaactagtgaaaattctagcaagtcagtatcttttctggccagtacatttgtgtaagcaaattgaactttaatcataatatagtgccaatttgatttccaaaatctttgtctttttttggtcccgccttggaagttgaatctcagtcatgtacaccagaatatgaatgcgagatgacagctcccataacaaatcacccttggccagatttccgccacttggttgttcattttgcctacctctgaaattagcaaatctctgcctttgtctacttgtgccttctcagatctgctgctcctggcccattccttgatctcaatgtggctgaaagtattaagattttagagcatgtataaagataataaaggtcattcaatcaagctcttctattttgtgcattttttgcttctctaagaagcaagaatggcactgtgatttcattgttgaaatagttaagaaaataggggacaattttgataaaattagaaaatcttagagaagtatcctgttactacgtcttcaaatgtataatgataattatacaggaaaatttaaaggcatttttatcataaaatgcttcaagcaaacgagaaaattatgaggaataatatatcaaatagcaatgtgccctctacccagctttgcaaaatctaaacatttttctgtaattgtttatttttcataagaaataaaactttattaggatttttgagaaagtccagtaaagaccaaacctcttcctcacttgagatcagaaccaattgggaaatgacaaagaatcagactgatgaatcagcatggctgatgaattaaattcccactactgaaccgtagaggaggctgtctacactccagcgccagccgagagcctgacactggacgaacaaagcaaagcattttcttaacgtaggcaggctcagttctaaaagaaaatgagaaagagaggatggggctggccacacagtgtctccttccagactcaccaatcaattagtgtgaaggaagggcaggttgagaaatagccgagaagtattacaaccggtgaggcactcaccccatggaaggaaatgtcagaagtggaaagttagcatttccctctaaaaacatataaagttaaagccatgtttttattcccttttagaccctattttttcctccccttctcccatgcaaatgtaacctctaccctgaattttaagatccttatatataacaaatacttagtcactagtgttgtgattctaagtatcagaatgcttccatttaagggaaatattggctgccggttcttggggatattgactataacatctgcagttacttcagtttcaagatactcttgtagactaatggaaagaatgtaaaagatgatgctactagatagaaatagagtttggatcgaaggatgttactgcccaactaatgttctaagtgctgaaagatcatcctggtcttagcaacagcaattataactaagaaaacaaagtttagagttatctcaaaacagaaaagaaagcatcaaaaagttatctctttcctctgaaacaaaaataagcattctagtgacccttgccttctgaaatatttcaacattccaagctactgagacttttcttattttcttataaacaaactttaatgccctttaaaatactttctgatttcttttctaagcgttttcaggtgaataacaagttacattcgtttggcttattttctcttcataaaatggacaagtttttagttgagcagaggaaccgaaaaacttctgaatgaaggaaatatttggtagtgaatgatataatggaaaattgctataataagtagctgggaagaagcaaggaagggagagaaattatacagaatcattttagtttaagtggcagtgtatgattagaagcagtactgagacattgagaaaaatagtctattacataccataggaaaatcaacaatggcatctctgaatatggaattgctagttaaagctactaggtgactctaggatggacaattttttttaataggtttttggttttggttgaggtacactgtcagagtgtgcacagtatttcattttgttagttagcttcatgaagaccttaatttattaatgttaatgattgaccacttgtgtgttaaaccagaaagtatttagtcagttgaattccatcacaaaagaaatgttatgaatccgtatattttgcctcctgtttctgagaaatatggcaaataaaaaaagagaggtcaaactaaatctaatacctctttaagtcccacagcaaaataaaacataggtaggcctcattttatgttttgattatgtcttgaaaaccttgtatacaagttaaaacatttgtaaaagtctaggcatgcttcatttttgaaataatgtggtagataacttaaaatgccagtaattattttccagtctaaataatcacaacattgagtcaggtgtggtgactcacgcctgtaatcccagcacttcaggaggccgaggcaggcggatcactcgagcccaggagttcaaaaccagtctgggcaacgtgacgagcacttttctatacaaaaaatacaaaaattaaccaggcatggtggcatgtgcctctggtcttagctacttgggaggctgaggtggaagaatcacttgagctggcgaggccgaggctgcagtgagccatgattgcaccactgcatcctaggctgggtgactgagtgagaccctgcctcaaaacaaaaacaacaactacaacaacaacaacaaagtcacaacataatttaatagattttttcatatgttggaatttcactaagtgaagaatacctgttatatgttatatgttataggtgataccgtaaggcatatgaatgatcatatttctaaaaaactttttactttggctcctaaatttcaataatctaaataaatactttgaggtatatttgaatatgttttttgttttcattcatttctattttatttttatttacatctgaatgtgttttcacgaaacaattttagctccaaactccaaattgcactattagggaaagggagaatagcttttggctcttcttgtactatttgaacattaggtaactggttactgtcttctgcacacttttaggatgtcattggttcaatctcagggtcaagtcttacccaactgtcctatgtactctgtccattcatgccttaaaagaaagaacctgaagaaaaagttgtacctttattagcaggttcttttaaatgaattttattaattaacatataatttcttctcagtaagatatgtgagctggcaacacattgccaatcctatggttatttttgttagtatgcacaataggtagtttcatgggtcaggaaagcagaaatagtatacaaggttaaagaaatgattttcagttctctaatttccactggaattattaaacatataaataaacaaaaaagaagtaagataactcactgtccctaggtgaagcaatgaaagtaagtgaagtagtaactgtgtctcctgtttcaccctcatgcttggaacatgtgtatgccttcaaaagctcacatccaagtcatccagaaaaattagcctgttaaatagtataggagaatcaacaatggaatctcttagtgcctggaatttgcaattgccagttaaagctagtaggtaaattaaaaataatttattttacagtgtatactacctctttgctttactgaccctcaaaaacgcctgctgtgtatactaacaaaaatacctttataactggcaatatcttactgagaaaaagttataagtaaatgaataaaattcatggaaaatattccactaacgaaagtaccacttttattcagattcttatacatgcaaaggcttacaatatcatatttctgggtaaatacttaaataggatgccaccctgctttgttttgaagcgtagtacgcctttccgtatgcagtgctccatgctgtgcagtcacggaaattaatgagttcagcgttcaggatgccagggcagctggagaacagagttctgtgctcatgtggcttacacaaacacacgagttgtgtttcccacagtgggatccagggacccctgaggttctgcagcttttttatttggtgaaacatagatccgaaagatgatgctgatgtggtgaagggggttggtttctgaaactgtttaagaattttagagatcaagagtaggtctgagaggagctggcaaagcaggcatttatttgtggtgggaggatatggggaaagagcagatgtctgtagatactacaaaggaaaataaacaccatgaaagaacaaacttatgtagaaaaattttaaaggaagattttttaagaaaggatgtttgggaaacactctaggagttattctgggtagcacttataaaatgggacaacttcttacagccagaatgacctttatactgaaagtcttcatttcttttgatttattccatcctgtcccatttaacaaacttgtattaaacagctactttgtatcaagaactatacttccttgcctcctttccaccagacacagatatacacatatacacacactcactttgaagttcaaataccatttgtaataactggagacccacaggactttagcactaaaagtcaaaacaattcgcttgctatggcaagatgaagttaaaaagcagcttcccaggatgaaacttggaaaatgcttaaatactgaggtgtttatttggatttgcttttctaaacttgttgatggaggtaggtatcttgctgacatattacatcatttctgatgaaagaattttagtaagatttcttgagccagattttcttcttaacattaattgtattgggaagttccaattgtttgaaggagacactgagttggatatattattttttacatcaaatataaattttctgtatttgagattatgatgtcatttccaaatggttgtgttgcttctgtactcattggccaaggccctataattatttgtcatattttaattctctttgttccccatatctttaccactagaggtctgtggctcctccttctcaaggttatggtgctataaaaatactcatttcagatttcaaaccaactagaatgatgtagtactatagagtttttggattcagttatactttgagtcaaattttatcttttacagcaaccatatacatccacactgagatcaaactcacttaacctattaagagtaataaaactgattaaaatttccaacccataagactaatattataaagttgttatacattaaggaaaagggcttccaactttcacaaactcttattactaaaatgtttttcttccaacctcctgtattgcctcaaaatggaatatatttcatctgaatttagtaggtaaaagtaaatttggagttatagaaaatacttaatatatcaccttttagttacagtgagaatatatgactttaggagtttataccatgtgaatggggtgaattaactctttccaccaggaggctttggcaagaggtaagagctaccaagaatgtaccagggctcaggcttggggaagagaggggcctctccagctcttcattatagagctcatactttctagatatgctgtctgattctcaggtggttcaggtcggtgaattccttagtagaatattaatatactagaaagagtcactgcagggtcaccctgtccttgtaatagacttgcaacccttaaaataggttagaggggagtaaattttcattagagtgaaagaaggcccaacttgtgattggctcagatcctaggtggtatcacagatatgcatcatgttttgagcaactgagatgagaatccaaggactctaactgaatggaatggtgtcatctgtactcctcctccctggctagctcttccacttagaaggcctgacaccctcatcttagattttcttcatgtatgtcattgcagccaagtttagaaacaggagatttgctatgaaaataagtccatgaatctgctgtctcatccccactgatgtaacatacctgtattgtgtttcaagatacagtcatcaaaattagggaaaagtcctcttttgaaagaaaaatcaactgccaaatggtatactgattctttggattctacctacgaaatcagttagctcattttttgattattctcttttgctaaatgcataatttgtatttcttgcagcaattaatacctgaaagttatttgtaagctcatttcaaatgtgataaactgaggttcatagaggtgaaatcacttgcttttttttttcaggagcatcatcttttttttttttttttgagatgaagtctcactctgtcacccaggctggagtgcagtggcacgatctcggcttactgcaacttctgcctcccaggttcaagcaattctcctgcctcagcctcctgagtagctgggactacaggtgtgcacctctatgcccagctaattttttttaatgtacttttagtagagatggggtttcaccatattggccaggctgctcttgaactcctgaattgaggtgatccgcctgacttggcctcccaaagtgctgggatttcaagtgtgagccaccgtgcctggcttagcatcatctttttatgactgtatttccaggccctaccatatattcaattcagagtaaacacttggttatatttgtggagtagtggaatatatgaatgattgaataaataatatagatgaaaagattagttcctgtatctccagggatcactatctttctataccaccaaagaatttgccctaaaaccattcactgtaaaaacataattatgattatatcttgtcttaatcttatgtcattatttcattccttatgttaaaaataataaaaataatgttaattctatgatttctcctatttctaaattgcataaacatatgtaagaagctactgaaataaagcaatagcattttaatacattcccttgtcaccatttatttgataccctcttgccttggcttggaatttgcaatattcagaattgcatttgttgttgaatattcctatctggatattactagattgggatttctgacccacctagtccaaagacagaatttctttattaagaagccaacaactaaacaggctacagtaatactccttggaactcaaggatgcgtacaagagggtggcttccttcaatctgtcaacagcctctgtcacctccatttatcctttttctgccagtcctattctcaaatactccagagctacaagatgattaagagccatcatgagacttttgaggattgttgtgagctgggttgttatttttatttttatttttattaatcagaccaactcaatagcaccctagttacagaaatcctatgatttggcctcataagatcaatgttgaaatcttgcttctgtcattaatgcaacctggcttttggcaaatcactcaacctctctgagcttcagtttcttaatacacaaaaagaggggaatgtctgctgtcctgcctcacctcctcaaattattgaatagctcaatatcattactgttattattattattatattttaaaatgtttgtaagcagaaagcactgcagagctgtaggttgcttctccctctttctcacttagttttcttacatatcaaattccatcctggggtaaagtaattgctcacaatttctttttataagagatatccttcaacaccagcaatttcatctttctctttttttaactcttgcatatatagcatatataaccatatttgaatgggagcaagtcttttcatttcttttctacttggacctataagttctagctgaagtccttcaagaagttagatctggagctctgtggccaggacttttctccttactcagactttccagtcattccccaaatcctttccagcccattgctattgtagaaaagtcttctccccaaatttgcctctcaggagatgcagttatgcagactaatatgtggctgtcttctaagctcatcctcatatcactttgtactagccctttctagttttaggactaagatgtaaaaattgaattaatatgaatagtggttactactttggatttggaagcctgtggaaatgtgggcacatttctctgccttcccaagctttcttctccttattttcagaatgatgatagtaatggtatttaattatagagttgctggcaaattaaatgagagtaacacatggttagtacacaatatagttattatttataaggggaaaaattactggttttcaattgctggtacatgtgaaatcagaatttcttttgacatctgtcttatctatgtttatttcccattattttttgtattttttctatattgtctctgaagccacctctgtgttttgcttttctgggagtggaagtggaggctcggttgtgaataagtacaattttgctttacttctggtacataaaattccaagacaacttagtataacaaaattcacattgaactaaaagttatgaaaagctgcttttactgtttactcactcctttaaatcaaaagaactggatgtaaactatttttttatgtcatctcctgttcttcaggctcttcggtgcctcagaaaacataaaagagtctgatttacaatcattttgggcaaattgcctgtagaattctaaggacaggaaatgaaaaaagaagtacagcacacacccccagacattccacacaacatgtagaataaataaacagccccaaaaaggaaaccaaaactgcttggtcttatgttgaggagggggtaccacaaatggcttttggagaaaatgtattaaagatgatgacatgctagaaaaatccttcaggggggtgaaattgaccctgattaaagatgatccttttccccttttctctacagcatagtgagtattttttatttagataacttccattacctgtattgacattatgaaaaagaaataccacgttacagagctgtgctttccaaaccttaataggcagggctgccctggggatctcgtggaagcgtaggtagtgattcagggaatgtggatagggcctgaggttctgcattattcacaagctcccaggtgatacagatgctgctggtttatgagccgtggttggttttcggtcatcttcttcaacaaaataattggtggtgatgttcttgtcttcatctgttcaagagtggttttcaactggggacaattttggcctcatgggaatttggctgtgtctggagatttttgattatgacaactcatgaagtgctattggcttcatgtgggtaggggacaaggatgctgctaaacactctatagtataaaggatagccccttataacaagaattttctgacccaaatgtgaatagttccaaagttgagaaaccctgctgcagaagtattattttatgcatttcttgtatcaaaaaatactttcttgaaattgttcaaaaaataaatacacaaaacctgtgagagcaaagaataggagcatctactacagtcatgcatcacctagcactagggatgtgttctgcaaactgtgtccttaggtgattttatcattgtgcgaatatcatagagtatatttacacaaatctagatggtagagctacacatctaggctgtatatcgcctatgtcttctaggctacagacctctacaagtggttactatactgtatactgtaggtcacggaagcacaatggcggccgggcgcagtgactcacacctgtaatcccagcacttctggaggccaaggcaggtagatcatttaaggccagcagtttgagaccagcctggccaacatggcgaaactcagtctccactaaaaatataaaaaaattagccaaacgtggtgtcaggcacctgtaatctcagctactcaagaggctgaggcatgagaatagcttgaagccgggagacagaggttgcagtgaacagagattgtaccactgcacaccagcctgcacaacagagtgaggctcagccttaaaaaagaaaaaaaaagtaaagcattagtgtgtctaaacatatctaaacatagaaaaggtacactaaagctattgtattataatcttatgacaccaccattgtatatgcagtttgtcattaaccgaaacatcattatgcagtgcatgactatttagtttagagagtaagcagcatttaaaactgtcttcaaatatgtgaaagactattatgcagaagatggtaaccagctgttctctatcacgctggaagaatgaacaggaaatgtacataaaaggacccgtgcaattcacccattctttttctgcttccttcatgccagctagacaaatctcttcatgatcttgcaaccatatttgtcctggcctgtgtcttaatacttgcagagaccctcccaaatcctgggtacacattttcttttcactgccaaatctcatctctttctccctttaaaaatcttaattgaaaatttctatctccataaaatcttccttaactaagatgaaatagttgccagttcatctttaactagagctggcatacttcttccttcaacatgttatctgtcagtctgaaaatatgttactgcccatctgtgtacaaggagttgtgctagattttgataaaggattaaaaaaaggtaagtaagagagtcattgtttttaggaattttccaatttggggggaaaaatctgacacagataactatatagtatttaataattatctccatgagaggtttcttaaaaaataagaaaggaggttttagaagtttaaagattacttctaggtagggaggtcaagaaagactttacaaatagatatatgggtgtatctttttttttgtttctttgatgaatttattcttcaaggaaaaagcagttactattgtcgccaaaatttaaagattataaattagagtagtgtggatttaaagtatatttatgaaaaaagttcatagtgagcaagggttaaaatattagagtgatttaatccactcacaatttataagactaggaaagataatttttcaggatctatgtggctatatggtggttttaacaaagaagactgaatttagccacctctgaatgtacctgatgaggctctgtaattttataagacagtgctctttggaaataattttgtttgtttgtttgtttggtttgtttgagacagtctttctctgttgcccaggctggagtgcagtggcacaatcttggctcactgcaacctctgtctcccaggttcaagcggtgcccctgcctcagcctcccgattagctgggactacaggggcatgccaccacacctggctaatatttgtatatttttagtagagatgggatttcatcctgttgaccaggttagcctcaaactcctgacctcaggtgatccacccacctctcaaagtgctgggattacaggcatgagccatcatggccccctggaaagaattcttagttacatctaggagaagaatattttggaacttcacaagcatactttaaaaaccagtaccaaagcaggaatttggcaccatccatttgagatggtgattctagaacttctttaggagacagtcttacttactaagagtttccacaacctgtactatgagaaaattaaaaagaattaaccctcatcaaatatgtagtatgtgccaggcactgggtagaccctttagatatatcatgtgatttaatctggataacaactggtgaatttatcaacaccaacattataaggaggcttcagagaattagtataaatttccatccaattaaggaagggaaacagagcaaatctcaggcctgcataggaagccatctctgagtggagaccatcagcttgccttttccttttgaagcagcaaggacaacatctatttttataaagctttacatggtgatatgtgcattctctgtagttgaaatgggaaaatgagctgttcagagttcattgatggccatggttttctgcagggctcactgctggaaaactatctgcaactgtattagtcatatatgaatctgagtttctgcctgctcttttccacacattctgaaaacctcagctctaggaatggtacagatattaaattagtatggaatttttttgaatgttaatatttgtgttctttaaagtcattatggttttttattttttattgtattattattatttttttattacactttaagttctagggtacatgtgcacaatgtgcaagtttgttacatatgtatacatgtgccatgttggtgtgcggcacccattaactagtcatttacattaggtatatctcctaatgctttccctcccccctccccccaccacacaacaggctgcggtgtgtgatgttccccttcctgtgtccaggtgttctcattgttcaattcccacctatgagtgagaacatgcggtgtttggttttttgtccttgagatagtttgctgagaacgatggtttccagcttcatccatgtccctacaaaggacatgaactcatccttttttatggctgcatagtattccatggtgtatatgtactacattttcttaatccagtctatcgttgatggacatttgggttggttccaagtctttgctattgtgaacagtgccacaatagacatacgtgtgcatgtgtctttatagcagcatgatttataatcctttgcatatatacccagtaatgggatggctgggtcaaatggtatttctagttctagatccttgaggaatcgccacactgtcttccacaatggttgaactagtttatttggtttacagttagtaatacagttaagagtggagaccttccttgagttttcattctttgagcttctttttttttaatagaaacagctttcgatggtaaccttaaccatgccttccataactcaaaacatgatggactcttagttaactctatgtaactggattttgtttttctcctaaagttgttctacgctgctgcgtatcattcaatgttgatgtgaaaaattcaatgactttcagcggcccggtggaagacatgtttggatatactgttcaacaatatgaaaatgaagaaggaaaatggtaagccagtgggttttgttgttgttatttacttatttcacaaggtaatgagaaatattatttgactacagtttcttttatgaatgaaactttaacagaatgaattatttatggtagaaaatgcagtctagtcatttggcaatggaagctaacttaaagtaaaaaaaaaaaaattccttggcaatattagaggaagcgattagtgatttctgttgatgcctggattgacctcaaggaaggtctgtatccaaaaaagctattgttccataattatgttttttggcaagaattctttaattgttctcatttcagagtagcttaaatgcacttgtttgaaattcagtaggaaggattcggaggcaaatgagatggtgctctgaaagggtttaacacacttccgtgagtttggtctttactgatctactgagcttggtctaatgtttataatgaactttattgggtttctggtatctaccttcaaaccctttaatattggttaagttcattgtagataggattttttttttttttttctgagatggagtcttgctctgtcacccaggctggagtacagtggagcgatctcagctcactgcaacctccgcctcctgggttcaagtgattctcctgcctcagcctcctagtagctgggattacaggcgtgtaccaccatgcccggctaatttttgtatttctagtagagacacggtttcaccatgttggtcaggctggtcttgaatttttgacctcgtgatccacccacctcagcctccgaaagtgctgggattacaggcgtgagccatagcacctggccgtagatatgatttttaaagtatatttaacttgttgaaaattatataaactgaatattagagttcttttgcttaatatttaatagaatttttagtaaatgcaatttttgtttaattggacattctaggaaagaagagcagtagctaaactttagtttaataacttaaactaaacaagcctacatttttagtagctgtaataataagcaaaaagagatttatatctacttggataataaagatctatgaatcactataattatttcattaataaaaatatgtggattttctgcattttgttttatcttttagacttggttaatttgataataatgccctaaagactataaaaagtaatgagttctcacattttttaagtacattattttatgctaggtataaactagaatttgttgagatacttcactcttttattctccttacaaatatctcagatgacaaacccaatgctacatgctaaatttttaagttccctttccctccctcctatactctccacccatcccattccccaatttttaaggttaaatgagtacagccctccctctagacaccagctttattcttttaggaattataccttcaattcaggtacctctgggagaataatggtgagtagaccaactggtcagactttgtgcgtaagctataataaacagaaatgcagtacatgttattcttaaaaagcttaactttacataaacacatataaaagttaattttcactaattactaatagttacacaaattttaaagaggagtatagcaaatagcaagctttaagacttaaaccacctacttaaaatgaagtatctcttttaaggatggttaaatattgctaaaatattttatgaaattctcattttcaatttctgatatcagaaaaacctgtatgttttctttcttatccagtcctgtctctgtgattttagaaaaatctgatgtcagaagtccttaattatatgaatgaaccttagtagagtgaaaaggggttcatatttctttttagaagccttagtgcccccatttgatctctttagtcactgtttctcatgataagaacctatcctattgtgagatttccaccctctaaattctacagtccctcctttcaaggcaccagaagtcaaagcaatggaaaattgaaaaatcaggcctgaatgaagccttgatgtcatgaggaatgtccttcctaaggttattctatctttgtagaaagttaaggtatggatgaggaaaaagaaagacagccaacactggttaaggaacaaaagagtgcatagattggatagtaagaataaggttgcaagaacgatgttgctaatggtctgtctgaatgaatctacactggactgaaccatcacaattctacatacatttgtgaggtaatgttaataagagatcggggactatgccttatatcttggtttacccatgaagctgagttgaattgtctctgaaaatatttgttggtgggttaggttttttttatttagccatagcataaatgtgggtcagtcaatcaacatgtatttatgtaatacattttatgtgtctggcattatgctaaattccatgggaaatatttatacataaaacaaatataaaagctttaacctagtcaaggacatacatgaaatgtttaggaatagagaatagtgccaacaaccagtgcagaatagactataaattcaatgggaattcaaaacaggaggagatgattcttggttcttgacctaagtcttgaaagatgacttaactttcaatatgagaagaaaaatgtcactccaagcttgggaagccacaagagcaagggcccagacttgagaataagtgaggtgagtgtgttggtaagtaaacaggtctcatattgggatgaaaaaagagaaaaggatgatggcagatcttgaaagacaaacacaggagcttggacctaagatgaggacgttgagaagccatcataagttgtcattttatgaaacttaatttgggaatttacatataaattggattggagaatggagttcctgaaaactaggaaatatatagactcaagaactataatctggtacttaagggatgagccttcaggctgtattaggggcaactggaagaaaaaagaaaggtgtattcaagacaaatcaagatgaatcagtaaatcttggtggaagtttggaaatggtcaatgaaggtgtaggagaggtcagatagattccaaaatttctgtactggctcattgggaaatgggttgtcattgacagagaaagggaaattcacttatcaggaagtgggtaagtctatttttaaatagctccagttcaaggtgatttctaggtagttggaaacctcagactggaatgcaggtaagagggagaagttaatgtgttagtggaaatgcctagaaaacaaagactgattttgcagcccacttgcaaccctgggcactaccccacatctagcatgaggccttatacataatatgcactcaatcattatttgttggctgaacaactaaatctagtttaacactctgttatcatcaattaaaaaaaagctgcataaaaaataaagttaaatgtgactctcctagggaaatgcaactacttaggaccagagctgtaatagatttcatctctacactcagtcttgtgcctttttcttcattagaactatatttaaaagtaaatgttgttaaaaactatctttgtggtaggtaccagactttacatattaatatgtgtgtaagtttgtaagcatttgaatgtagatgatatcagaaacctaaatctcacgttgacatttattatttacaatgattttatggaaaagttgtgaaaaatcagagcaaccaaaaagatgtgggcaattgaatttaaaagtaagcaaattacaaatacctaaatttccaaacttttaaggatagcatggtagcagcatattgttctaaagaaatctgggatctggtagtgcaaaataacctgtagaaacatgtttggatgttctgtaagtgtctataaaaacagatagattgcagacttacttcgagaaatgtgctacagaataattgacatatttggaggaacatggattttgttatttaattatctctagaggtaggcaccttcataagtcatatttactgctcatgctttcgaatttcataaactcatatttaaaaaaatcatcctgacccatcttacgtcgtgactatagtacgcctatagaaggagcacttgttagcccatgacaagtacagtctgtgtatttgaaaaacatagctttaattctttcgaaagaaatataagttgacagaaaaggtagccttatgtcctctttactgttcagaagtttgctctgaagtgtaatttatatcttttgctcagaagccacatgctttctcagtagcagaacacatcatacatctgattaagatcagctgttgttcattatgtttagcatgagctggagcatccaagtaattgcaatgtggttcagaagaattcagaaagaatataattgccttcataattttgctttgaggaaaagaaattcaaacatgctcagcacagcacaagccttccagatttccagatttagtggtaaacatcagcatggccaggtctcagccgaacgggaaaatgtgagatgtctgtttggggctttccactctaatctgttgctgctttgcttcattccttccagcatgtgtgcctacccttttaactgcccttcaagcaacctttcttgggggtttcagtgacttcactggacctgtctgatctcaaagtagattttcaggatccacccttgccaaccttcaagccaatgtttatcaattatcttgacttcatgccttttctctagaggatcctgctttatgccaggtcagggtaccaatgggctcatgtgattgatgccctatttccaataagtctgtgttgtaaaagaaaaaagaatccctgctaatgtagagctattccagactggggaggagagacattttaagggtttacacaattttctgtaacagattttaatatgcttattttacattgcttctaacgccttttgaagttgaaatttcctcattgccaaacttgtcatttctttggctcccctcatttccacccctccaccttttatgagcaaatcactgcagttaatgggtcactgtgtaagtttcattctctaagatgaaaaaatgcttattccatttatttaaaaagaaattggcgagcagaatttgcttggcactctgagagtgactttggcttgaactatgtattagacatcaaggcagagttagttgaaaaggatgttaatgaaataatgtaaatataagacactcttttccaagaaactatcttttgcagggaagaaaacataaatatgaaacagagacatcagacaccacctactcttcaaataaatataataatgggcataataacaagataactattgtgaatagcaaatatttctgcttactaaatattattataattgtagcttattcatggagaaaagtgtttctctcactttgatgatccttgagttgatcagatgtttctccagaaatgagtaacgatatccagaacatgttttgatcttctcagtctgcatacaggtcattacaaaaatgccatataaaaagcaagatctaataggaataaaacgtaataagttaaaactaacttgcattaaattttaaaataatgattctcacagtttataaaacaatgtgcctgggccttcaccttgaccctgtgggtttgggcggatatcattgttatcatctgtattttctagacaggaaactgagacagagaatgaatgtccaaaggtttaatatagcaagtatgtcacagggtcaggatatggaacaccagccttctgactttttagccaattctccccctttagcaacaaggattctctagctgtttgacctggagaaatgcctctggtgtcactcaaaggcatgtatagcatcccacttaagctgaatatatattctctaaaatggaaaaaaaaagattttacaatccagacctcttggctggtcacataagtataaattctcaggtctgccttattcagatttttaagtacttgacacagtcgttaattcattcattcaatagatatttattgaatgcctattttgtgcttggtactagtatgagcactaaggatgtgtttgtgaacaaaatagaaaaaccaatccctactattgtggagcttatattctactggggaatagagaacaaaaattaaataatgaagttaataaacaggtaggttacatcaaatgccagaataggatcagtgttgtgagaaaaaactgagcaagagagtggattgagaatgctggagattcctgaaattctgtaaaccctatgctaatacttttctaggatcttgttattttgatgcagttggagaaaagtgaggcttccttaggattcaagtggtaagatacacgtactttcaagcttgttattaaaagtttcatgtttgttttcaaagaaaacagatactaggaaaatacagaaaattagcagtcctatgatctgctaacctggtctttactattggtcccaactcccaaactccctgtctcaatcctgggctcctacactctaccactttctaagttctcactccgcaatcttcacttatctcagaatatgcaataggccgtggttgagattgctgtatcaggtcagtttccaattatcaccatatcctaagtgctttctcttgccctagagatcaaacataaactccagaccttttcctccagagccaaatgcttgccaaatctcaagctctctgttcctgtctataagcaagctttattctgagttctagccacccatactttctcattatcttcccttttccatcttcattctcctgtctccacacttttccctgggctatccatatctccctttccttctgccttacaattcacaatagctctcctattagcatgctgtacaagactcacttttcatcagttatcctagattttcccccacttgatattacatgttttccaactagtgagtcagttcttctctacaaacttatatttgttctattcagatgatggaatcttagaactggaaaggactttgagggcctaactcccatccactataaaaacaccttccgaaacatccctggccagctgcaacccacctcatcttgaccagaggagctgcctgacagacctacgtatgccttatcagtttaaatcttcatcgctctctacaagcccaccacccttctacctcctctgtaaatctcactagacaactgcagctattattttccaaagaagaaaaagagacagagagagagagagagagagagagagagagagaagccactaggtcaaaatttaatcctcacttcctgtttcagttaactattgctgcataataagtcattccaatacttagtcacttaaagcagcaatggtctataaattctcaagatttttgaggattgaataggtattcccctattgcctgggctcatcatctggtccctcaactggggctggagtgtccaagctggctttcctcacacgagtggaagttcatgctgtcagctaaagcaccaattctgttccacgtggcctcttatcctctgttaagcaacactgggcttcttcacatcctgatgttctcagctttcaaaaacaggtaaaatggaatctgcaaaggccttttaaggcctagccttagaagtcatagtatcatttgtgctgcattctattcatcaaaacaaatcctagattcaatgggtggaaaaacagattctacctcatgaaataataaaagtcaaagtcgtgttgcaaaagtgtacacaattccaaaccatcgaccacccttgcaaactgctcaatactgggctgctcagcgtgctgcctagggaatggtcgctcttcctcatttttaagacaaacctctccttctggatccaccctgtctacctgctcagagattctactccctctcctgtgaaatcaggatttctcttgttactgtttctttcttgccatcatttagccatatgcagattgcctccatgataaatttggacacatctcaagcccttaatggtttgtcattgccctgaaaaaaaaaagccacatttattaacactgcccatctccctcatttttagccaagttacttgaaatgaaatctgccacaaacatgtacctctcattcttgcctcctattctttatattgtttccttctttggtttctgtgacactgctgttttctgattcttgctccctttctgattacccttgcctagttttcttcctttgctcattgaaaccttaagtgttatttcaccttcagatgtcaacatttagtgctcttctcactatatttcgaggtggtaatatttacttttagggcctcaaccatgctcatatcatgctcatacatgttccacatggtttctgagatgttccccagcaagactgagcccacttgcctacagaagtaactcattatcagtgcatcctttcttggcctttcttccttcccactcttcttttccccatctctatacttatgcatacttggaattgcctccaaaaaacttacctgaaccaaagtttttgtcttggatctacttttggagaaacccgaactaagacagcttatatcctaaatatttatagagttagtccttccatcctctgtacttcctgaatccaaatcctcatctggattactttaggaatccatatcttgtcatttgactctaattttgttcctcttcaatttacttatgacacttcaagcaaataagctttgtaaatcaaaaaggtgatcatgttacacccctctttaatagcttcattggttcccaacttccccctacatagaataaagccaaagttcttaaagctgactatgagaacattcatgatctggactctttttacctctctagcctcaacttctactgcagttatactgagctacttggcatttatcaaaggagtggtattcttacttctaagactttgctgaagttgcatcaagttcagacctattcaatattgcaatagtacatgtatagttgtgcttctctctctaagttataagcaaactaaaaattgtgttttattcacttttgtatcattttatatcctcaggacctggcataaatgcccagcatgtaaaatattgttaataaacattaattactccagcctcaaattaaatactttctaaaatcgtaggctcatttttttctctaaactgtttttaactgtaaaaccaatttattccattacgtattttacaactgaaaatattaggaaaaaataatcgtaacctcattaatataatttgttatattcttgatgtattcctgattaatctttcaacatcgatgttagttgtttattcatctgaaataaatacctaataataataagaactaacatttagatagcacatactataagccaaatactgttctaagcattttatatacattaacttatttatttttttgatgatcctctgaaatggatctccattttatagataaaaaaactaaatcacagatggagtaattgacttgtcctaaccatatagctaagtgaatggtaaagccataatttgaactcatataggctggcaccaaagttcatgctatatttcatggagaagattaaattatttaatacacagaaagcacttagaacagggcctagcacatggtataaattcaataaagcctagctgccattatcagtggtagtataatgaacatagtaatttggtgtctttcatgttaaattagggcacagattttcactaaattagataaattttcactttgagttcgatcataaataatttttcatcctaccatacaatgaatgtacaatatgctatagaatgatcctgaaataattagtttttatttaccatatttcttttactctttcataattatatataacactatgagcattatctttgtgcattaagcttttccctcttactttaggtcattttatttaggatagattcccagaagtaaaaattatgtattaaagggtttgagcatttttgtagttctttatacaaatcagaaattgctttccaaaggcattatattaaaaccatgttttagagtctcaatagcttaatatttacaattgttttataaaatttattttcattaatactagcatgcctatagggcctacacaaaataaatcccatttcttttcaatatgacagactttcaaatatttaaattttcaaaatgtgtgcctaatcaatttgtacttcaatgcaacttctcagttctcctgcagacattctttctccatgccgaacatccccaactttcccagcatcttttgtctgacaaatttaccagactcctaactatctgagtcatagtctcctaaatacattccattgtgcatatgtccctcttaatttagatatttcagacatggcctgaccagcacagaacacagggggactatcactgcttgaccagggcatctatttccagcactgcagactaaagtcacattagcatttttggcactaaaatacgctgttgctcatgtttatgtgctatcatctaaatcccccatgcctttttcacatgaactcccattaagtgagggctcccacatcctgcactgatataaataatagtatgcagctgagcgaagttatttatgtaggttctaagtaaactttagtttatttatgtttattgttccagaatgttgagattcatctgaattcctaagtatgtatattgatatacttgataagtatttttttcttgctctgtcttatggtgctgattgataactatatttatactttttatatcttgactaaagtcattaataaagttgtcatctggctgggcgtggtggctcatgcctgtaatcccagcactttgggaggccaaggtgggcggatcacgtggtcaagagaccgagactatcctggccaacatggtgaaaccctgtctttactaaaaatacaaaaattagtcgggcgtggtggcgtgcacctgtagtcccagctacttgggaggctgaggcaggagaatcgcttggacccaggaggcggaggttgcagtgggccaaggtcatgccactgcactccagtctggcaacagagcgagactccgtctcaaaaaataaaaataaaaaaataaaataaaaaaataaagttgtaatctaacacaatcccaagtacaaaatctcatactatgtaattaagtcctttgattgctagcagccagagtttttggatatggctactcagccagcaataaatcagcaactgtggatccacccaagtatcttactatttactttagttcatccgattcctgaagatatcatgggagacttaaatgacttgttggaactaaaatcagttgtgattatatgttttttccattaattactgttagaatggttttataattctgtctaaaaggaaagtaagtgattttaacctggatctcataaactatccttattttctaagcacttataaactagcacatgctaatattaaatcttatgatgttccaatgtttatatttcctgacttctctataaaattagcagttcatcataggaaaaagtcacttatacttccacatgtgttttataagttaatacagtagcagacttagccaataattattgattatttcagtaccccaataaaaaatatgataaagtaatataaacaaaataataaagcaaaatctctgaaatatctatcctacatatacacacacatatacatgtatatacacacatatatatgtatatacacacatgtatatgctatatatgtatattgtatatgtatgtgtgtgtgtgtatatatactttttaatccacatcaatatgcaagaggtaggctctctgcttagtttacataacattaaattactaatagcatgattattatctgattatgagtgttattgtcaattatcttaaaatcagtcataaaacaactcatataaactgtttctcaatgttcaaaaatgtttactgatttatttaacttccagggtgcttattggttctccgttagttggccaacccaaaaacagaactggagatgtctataagtgtccagttgggagaggtgaatcattaccttgtgtaaagttggatctaccaggtatgtaaaattaaaaaaatctggttttaggccaggtgcggtgagtcacgcctgtaatccccacactttaagaggtcaagacaggcatatcgtttgagcccaggagtttgagaccagcctgggcaacctgacgaaacctcatctctacaaaatatacaaaaatagctggatggggtggtgcactactgtagtcccagctactcaagaggatgaagtgtgaggatcgcttgagctcaggagtttgagactgcagtgaatggtaattgcgccactgcactccagcctgggtgacagagtgagaccctgtctcaaaaaaaaaaaaaaaaaaaatcaggtcttaaattatgcccagtattctcactgaaaacagattttgggctgggcgcagtgtctcacacctgtaatcccagcactttgggaggccgaggcaggcggatcacctgaggtcgggagttcgagaccagcctgaccaacatggagaaaccctgcctctactaaaaatacaaaattaagctgggcatagtggtacatgcctgtaatcccagctacttaggaggctgaggcaggagacctgcttgaacctgggaggcagaggttgtgttaaggcaacatcacgccattgcactccagcctgaggaacaagagcaaaactccatctcaaaaaaaaaaaaaaaaagaaaagaaaaaaaacagattttaatcaactcaagaaaatattagaagtaatctgtgtgtcagaatggtcgagcggtctaaggcgctgagttcaagaagtaatctataatcatttttcatataatcatttataatctataatcatttttctataatcatttatcttccagattgacatagaatgccattttgattccctctgtccttaatttgctttagaaagtcatcaaggagcatacataaattagaataccgtactaattttataacttttaactctctgcatttttcagaattctttctaattcagtggtaatgtgaaagaacttctccaaataaacctgcccaccacattccctccacaaaatttaacttagtgcctggttttcaagaggaaatagaatcagaggaattgtaatagataaatttaattttaaaaatagaatcacacaagataaatttatattgaaatagatgtatttgacataaatagtaggaatgtgaccggaaaattcctactaaaattatctagaaattagaaccctgtcaatgttctatacaatattacatactatggaaattatttatagccccacaagtttatttcacatattgtatttttcagttctcctttttttgaattttctatttgtttgtttttatgaactttttttctttacatgcataagcatacttataatagctgctttaatatccttgcctgataattccaacatctggaatatctcaacatcactttccatttattacctttccttgaggttgcatcacattttcctgtcttgtcttgtaattttggatcataacctggattatatttttgaattacaggtgtggagattctagattctgttatatgcctgtgaatagtcttaactttttttattagcaggaaatttacttggctcaactcaatttccaagcattgactttcttgcaatgacaagtagttaaaatctctattcaggttttatttcagctgggctatttgaaatatactctgcgcatttactattcaagtcatctagttatttggataaaatatatatgcatattatagaactgttgttttgtggctctttttctaagatatactactctcctcctcattttgcagctgctgtcattgccctcaatctctgttctctttttattcagtacagtaagactaggagttctatttgagttttagccactgaccagggccttccctaggttgggggtgggttaggggtgggggacaaaaacaaaacaaaacacaaaagcacaaaactcatttagtgccagtatcttcttccaagtatggattcccctccattttctgccacctttctagtgccttcaggtgattgtttcatgtattttttttaattcttcctagaatttatagttgtgatttgcagaggagctgttttgttaggagttactcctcccttactggaaattggaatagttttaaaattaggctagagattttagccacatcaagtacagtagggaagtttccactgtagtccctaattgtcccaggaatgctttttctgggtcaagctttgtatataaaactctaatccagattatacaagatcaatgcatacaatcgcccagctctaggtgctttcaaagcaaaccagactaaactcttggacaaaggccattgcgcagatcaggaagtctaactgaccattccagaatctctgcttccattccccactttaaatccacatacagtcttaacatgaaaacaacctctggaacaaacagtgagacaaatctttctcaacctgaattttgcctctttctaatattccactctactaagcagatttagaagttcttgtttttcctgtccagtctttttttcttttttagtgtgagaaagtgaaacttcttgccaatattgttaggctggcatgcttcatgcttcaggacccaacattcccttcagaatgtcaaatgcagtctctttactgtgtttcctttatcaaaactttctggacactgctctaatattcctctagtttcctttgtcacccaaaggatgtcctcatgattttggaagtcatggtcaaaaaactggtgtttgagttttcttttctgatcttctacccatttccccttttcttgccaaaaatcgtgtttcatcactggtcatttataacaaagttataagattacattatatctacagtattatgagattaaaaactttgctttaattagcaagaacgtgcaaaaagcaatcccacattctcattgccctgctagttctgcattctttcacagttcagcaaaactatctgaaatagtttctgggacatgagccaactcttcagccttagcttgttcattatattccttaagaagacttggaagactaattagttgaaccaaaagaagaatgtgctatgatatgagcaaaacaaatagaatgtcttaatgagagatgcttaaaatttcactttgtgaaacttttcctccctcataaaattttgttctatttttagttaatacatcaattcccaatgtcacagaagtaaaggagaacatgacatttggatcaactttagtcaccaacccaaatggaggatttctggtaagaatggagagaatgatatttattgacaacagatatgctatcattttaagtctttgtaagatctgttatataattttcagtctaatgatttctaattttaaaacaattttttaaaggcttgtgggcccttatatgcctatagatgtggacatttgcattacacaactggaatctgttctgacgtcagccccacatttcaagtcgtgaattccattgcccctgtacaaggtacagattttatgcaatgttcttgcatgtttgaaaagcctatgcaatgaatgagacgtatgtatacaaaggaacataccaaaaagcttaaagtattttcttagctaccagcattaccaatttaggtaaatgtttgctttgccagtatataacaaaatctgactgctatttttggaattgatattagtgtaaataactttacaaagtcatttttaaacatcatagataaagctgtcatgctgcttatatttaaagaatgagtctctttgaagaaagaagtaacttcatttgagatatgctcaaaaactgttttataaaaacttatataaaattcatattgagaaaatttgcaaagataactctcatacaatactaattaaaattcagtaggtatgaattttatcccacaccaattgttattgaaagcaatgaatatttttatcatctttactttttcgaaaactattttttattgctaaaacaatgtgtctactttggagaacatcagttcatcttttaaaatgaacttctttcagccatgaaagcacttcatatgcctctgaaaaaaatagattccaaatttgacaattgactccttttattgcagaatgcagcactcaactggacatagtcatagtgctggatggttccaacagtatttacccatgggacagtgttacagcttttttaaatgaccttcttgaaagaatggatattggtcctaaacagacacaggtatgtgactttgtgttttgatttctgttgttctaaagataaaaatgcacaaatttttaataaaaccaaatattctgaaagcaaattaatcaataaaactaaagttgagaatgaattttatatccatttcctgttcttatttctgataaaaaggacattactttaagctgtgttattttctatttttttcttttttcttttttctttttcttttttagacagagtctcactctgttgcccaggctggagtgcagtggtgcaatctcagctcactgcaaccttcacctcccaggctcaagcaattcatatttctcagcctctccagaagctggaattacaggcatgcgccatcacacctggctaattttttaaatttgtaatagagatggggtttcatcatgttggccaggctggtctcaaactcctagcctctggttgatacacctgtctctgcctctcaaagcattggtattacaggcgtgagccactgtgcccaacctaggctgtgttattttctaaacagaaaatattatgaaagctgccatttttaatgcacttgaaaaataactcctatagagttctataaactcatagtttaatttttacttaaaatggatatagccacttttggtaatgtcagagccgggtgtcagagtttgtaaaaactaatctgacatcccaaacaacccatcacattataatctctcctctcatattatacaaataagttagtaactgaccagaggatactacttaaagcctgttgtcctttctgttaataatttcttttccctaagttaaaagaaaatgcccctggctatctctgcataaaatcaaatagttgtttgtttatccccccaattaatatctatttctaaacacatctcctttattgccactaaatgaagtggaacttctcacacagcttttccactttagatactgagtttaatttaattacatttaattaaatacatttgactgatttaatgtttattaaactcatatgggcatatatattaaaatacagggcagacataatggataacaggcaaataaaatgtcaaaatgaagtcaatgcctcaggtcaggaattagccctagaatcagagcctaaaagattgttgtgtggtttggaggctgtagagagcataggagactttaagattatagtactgcaatcaatacagtgatcttccttttttttttttttttctgaggactttactttgggagaagtttctgaggcactgaaaaagcagactgactgcgttaatgtttgccacacctacattaaatttggaacataatatgtgcacatatatatacatacatgtgtcttcatgtgtctgtgtatatttatgtctctcttaatattttgatatctatgtatatataattttctaaaaggatggtggttgaaaatttcaaagttgaactcaaacttcaaagtgaaatgtattgctgcattccaaggctgaataggtctctgtagagagtgagtggaagggtaaggttataaatatcctgctggacaatagagaacttgttgaaatcagtgtaaaatcattaaaaatgaaatgggcttttacgtatcacaaaatgtaattttccctggaagtgacttatttgcaattgaccttctcaagtgaaattactagtggatggtaggggacctttttatcccgtcttgctacagggtacagggcagcctgcatcttaacagaccaactccaggatgtgacttgctcttccttctggcacctgttcctcatggacctccttttttcccttctgagaccactcttccttcctcctttcctcgcttcccctatcccttctctccttggccaataagatagcatagagtcataagattaaagctggaaagaatcttaaaggtcatttggcccccaacctcaatttatgaaggagacacgagaggctaactgatttgtttaaggtctttctgcttgctgatggcagattagaacacacacagctctctaattgtagcccagtttgctgttgttttttttctttctgagggctctacttctagagaagcttcagagccagtaccatctaatgcccctgaatagtagatttcaatccttttctatttcatgaggatgactgtcctcatccttcctcaggcagcctcttggctgaaaccgtgctaggcttggcaatgactcactgcctggactaataccttaaatgaaatggcttgtgttcccgctttctccacttttgcccatgatgtgctttctttccttcttcttgttttgtccatcccatttgatcttcttacctaactttttccttccaaagctaataacatgcttgaaatattttttacaatttattatacagccatctaaatattttattttacctttaaattcacttatgtatattactcttaaaaattaatttatttgtagctatttgtgaaaattagtgcagctgtgacatgtctgaagttggtccacaactttagaaagaaaatccatacggctcttttagaacaataattacagcttctgtgaagatctatgccagtgactccattttgtaaagaaataaataacagtcaattgcttatatgctcaagctattcttctgcaatttcgatgtttttcagttagaactataattaatttacatttctgtgttgagagtcctaaaagaggagctattctgcctgtccaccagaggaattctagcctgccagagtgggcaacatgaagttatatgtattttctggagggaacaatggctctattcagacaaattcaggagggcccttggggtccagatgctaccagtgaatgggaggaaaatgaacttaccctgcagcagaagagttcagttacatttaccaagatccaggacctcaatccacagagaagaatatttctgaatgaagcaccctgcacagtgtcgtttacattatcttctgacttcacccaagggaacctgatttttaaagagagaagctgattatatttctgaatttttatgtcacatcttgctttcatcattgattgtggagcttaaccatatacattcattcatttattcagatgtatgtactaagggcttactatgttccaagctctatgctatagcttgggtaatagtggggaagatgacagacaagggtgatgccttaatggtgcttctgtctaatgccatgtttctccaattatggctcatggaatttctgcttccaaatcactgggatgcttgaactataccccagattttcaaaatcagaatctctgagggtggggctataagcctgcattatatataagcaacccatatgattcttttctgtttgtttgtttttttgacaaggagtttcactcttgctacccaggctggagtgcaatggtacgatcttggctcactgcagcctccaccttctgggttcaagcaattctcgtgcctcagccttctgagtagctgggattacaggcatgtgctaccatgcccaactaatttttgtatttttagtagagatagggtttcgccatgttggccaggctggtcttgaactcccgaccacagatgatccgcctgcctcggcctcccaaggtgctgggattacaggcttgagccactgtgcctggccccatatgattcttaaacagattaaagtttgagaaacactggactaaggcataattattatattagtgtgcgtgagtgtgtgtctgtctatctgtgtttgctgcatactgtagataataggcacctcaagagcaaagtctgcatcatcttcttatcttcgtcagtggccagcccagtggtttactgtggcacagtaagtcctcaatgagcacttgttgagtaaatgtttgtatcatattgagtccagttttgtatttttctctgattattggacatttaatgagtcttttttctataactggtattttaaaaattattttaagtatattactttatactttattctctagtattcagtcttttctaatctttttttttctattttggcttatgttttatcagtgactaaattcataaataattctctaaaatgaagagattggaaaggacatatttaccaagccattgcttttgctaaataacatttaatagggttttaagtataatgcatgtgaactctttttaaagtttgatcatctttcagtggattcagaaaagaaatcctgtcatagaaaatttggaaagacatttccttttcaaagaaaatatgtgctgaaaagcatgcttatctttcatgtagtcttacagtaattctttccaaaaactgtttacttgacaatcaattctttttcttgattggttgctaatgtaatttaaatccatttgatttgtttgtttgtttgtttttagttttatttgtttcttttaatgaaagcattcaattccaccctatgattggcagaattaacttctggaatttattctcccctttatgtattctatctctgtttctgaaaggaacagatgtaaaaatgaattgtgagaaagattacccagaggagggtgcaaaagatagaaagctaagagctggacagagaacttttagactcctcatccataccaaatttctaaaagactatgaatgtagttgtaagatttgtagagaggatttctctgtagaaagagcctactcagaaaggcttcagtggggtcatacacatcttagtatgtgtatactggagttgggacacatagttgattgactaatgcctaactcctgtctgaattgtcagagcatgacagcagctgttatgtctagctgctgacagggaagtcggagcagaggtcactgcactggagtcagcctgcatccccagagattgttagaatgcatgtgttttcccaggattggcatgggtactcaaaagcaagagccagtgtgaggtcatgtcagggcctgtccttagggattactggaagtgagtggctgcctctgcagagaatgcagaagatctctgtaattcttaggaactgaggcagtgggatgcattcactcagggcaagggtgtaggtgagatatctcaatgaagggagttctccaaagaacccttgaaaaacttgtacatacctattaggacctgattcatcttaggataataccaatgcagtaataatttctctatccttatttatcttccctacctctgtccctggaaggtcagaaatcacagttagcactctaagtgaaaacaagtaggaaaacaaataaaagccagtcatgcatctttctcaactacaggcttcttacctcgtgtaagcccttagtagaagtaggagagaagatttaactacaaatgcgctttgatgtttcgccttgttggttttaatttagacagaaccatatgaaagtattgctgtttgatcttttttttcccaacctacaaatacagcaatttcatttggtacagcctaaattaaaatatataactttttaaattaacagacattttaaaactaagaataaaaaaaagtcataagatatttatctttccatctagggatagcaaaatacttcactttaaataaattttgaaggactggtgggccacaaataaaggttatattctaattacacctcctgtatttttgtttgctgtattgattagttacacatttggtacaatagatatagattgaatatgattcctattctctgcagtcatagatttgtcatttagtaattgcaagcaataaaaggcagagtcaaagatatggaatatttcccaaagtaactgttacctccaaaaaacaaaaataaaaaaaaagaaaaggaaagggggaaggaaggaaggaaacttacattaagttttccatgtgacaatttagtatacattagggaaatacaacacaacgatggaaacattcactctaaagagttactcaaaatccattctatgtttctgtgtggcccaattaagacttttgcaagcatagtcaaggaatttttgtcaaccaattttttacccaagacagagtaaaggctataaaattgccttttaaaaatcacctataaaaacaaacctgaaacactctgagcttgccattaaagatatgatggtgtaaacattatggaggtcttattgatcctcaatacctaaacataacattgcttttaataataaatgaagataatataaatatgtcaaataagtgtgcattaccctaaataaaaccagtaaattgtgaggcttgatataaaagtgaaatatactaacggaacaatgtctagattgttcacatcaaaagtgtagcatagcattaaaccaagcaaaatgaaacagagaaattaattaaattttaggaatattatttatctttctttttactgctgattttatggccatttccctagaagccttaaatctggggcctgattcattgtttgtaggtctgaaaagaagcctgagggagacatgcagccatacctttgtcagtctgcttacagtttccgaatgtggggtagggaatggggtgaatcttctctctcactagcctctagtctccattctcccacccctccagccatcaggcactagaataatcattccgaagtgagttcagaacatttccctaataacaaacaaaaaagaaacaaataactcttcttgttgcctgctaaataatatccaagctctctagtggactaactggcatctgaccacctggcccagccatttctcatgcatcctgcttccccttacacccgcctcagtcaattttttttttttttttttgtgggtggaggagatggagttttgctccgatctcagctcactgcaacctccgcctcccgggttcaagctattctcctgcctcaggctcccgagtagcttacccttcagccattcctgggcccttgccttccttgttcatgaagtgctgtgctcttgttacttgcttttcctgtgattccctgctccatctcaagcgctgtattctaggagaatttcaaatgtcactttctctgtaattttctatgattatcctacccactgttcttgagaaaaatgccttcctctcctatgttcccatagcagctgcaaccgtgagagcacatttccttactgctcttatcactcagtagcattgctctttgttttttgggtctgtctcttctagtagactgaattacatgacgacagaattgtgccttagtcttttcatttatggaagatagtctagggttttatgtttcctagcacatgacatgagccatttatgttgaaaaaatgggagtttttgaattttcaccttctcatgtataaaatcgttgtttttagtgacctctttcccttactttgcttcataaagtcatattgatccactgagctggaaggtacttgcttgtgggggattcccctggacaaccctttacattgtatttcagtcttttctttgcaggtgtttacccacctagccctattcccctcagccctaatttctcctatagcccttgcccttctccacaaacacagtgaattaactttgttttaacctctcctatctttgcatttttgagcctacgtcactttcattgtagcatcttccatgaagcaagagtccagataaagataccctttttctagaacctgtatctattatgtatcaactttattatgtttctgaacacttgtttccttaggaaataatcatctacctgtaaatcagtcccatttatatccctctttataatgacaaaatgttaaacctagcctctgctaacatagcttcagaatggtttgtgctaacagttaactgggattgtatcctgtattatcactacatttatatcctgacttagtcacactggaagcatgttgtagggtagggctttgtaccatagtttgataaaaggaaatatacattggccagacataaagcctgagctcttttcatattaggcaattgtgcatcttacaggaacacacaaaaacacctcattgtttcaccttgtcattacttctgtaaaggaacaattgacttggtaatattagttattgaatgaaagcccagaaacttagcttatgctgggcattaaaatttgggtgctggtgtaaccctgacttaacaagatagatatagaagataataatataattattaattaatagataactccattccttcataactctttgactaaatatacttatcctagttgagtttctgttgctataacaaaatacccaagactagacaatttgaaaaaaaaaaaaggtggattatttagctcatgattctggaggctgggagggccaagatagggtggctgcagctgttcagcttctggtgagggccttgcgcttgggtcataacatggtggagaaacaggaatggaagcagccacgtgcaaaaagaccaaacacaagaggcagcctcgctttgtaacaacctgttctcttgtagtaactaatccagccccacaagagtgagaactcactcctgtgataaagtccctcttgactcctctttttgcctcttaaaggcaccacctcccaacaccactccattggagaccaagcatcaacatgagttttggtgtctcggtggggacaaaccatattcaagctgtagcagaaacatagctactttagatacttctttttcttaaacactcttatcatttaagatagttgttaaaatcttaaacatgactttcagtttcataagagactaatccaaaaggccctcctttcagtgttttctgatagtgtccttcctttcatgttcacacactcacttttctccctctttcttctctgcacccaaaagaaatgaagtcattggataattaatttgctttaattgagcagatatttataaagtgtctggacgatcaagtattatgctaggtgtcaagagcaataaaaaaaatcactgaaatgttgttcctgattctaaaatcttccaatttagaaatgaggtaaaataatatattgggacagctacaatgcatgatggtatgtcataaatataatgaaggtgaatttaaaacacagaacaattagttgatcttgacaagtaagtaagtcttactgttgtagaacattgtttcccagtctgaggtgttgaatatgatcctcacaaaaaaatattactttaaataagaataaaatataccaggtcttccaattagtaatccacaatgcatgtttttaaagactctgagaaaactttcaaaagaatttgcttataagtctaaatagaacaagtagggataggagtaagagaaaaccttactcttttgcaccatttgcaatttgtgacagttttcatagtgataggagaaaggtagagatggggaggagtctgccgtaaagatatatatttaactttattttactcattgttttccaagattatttgaccatagaattcttttttaaatcaaacttagtaacatacaaagggatgctagtattcccaaaaaaaaaaaagtgagtggatatttgtgtgggggcttaccagaaaatatgattgtaaatctcatatttaagtggaatgttctaataagtgttacaaacctcttgttcatgtaacaaaattcatagccaattgtgtacctgatgtatgccatagcctgaatcagcctttaggtctctttggccttggattgtaattatctacccatctatttattttgttctacttaatcaagaggtttaaaccacatctccccaggaggtaaatgtatcctttccagttgtctctgaaaaggaattttccttctgcatgtgactccttatcccccgtgatattataagaaactgttctttctatattcatctactcttttactgataccacaaactgctctttacaatctctgggaaagaatgtccacatttaacccggttgcacctttttagctgtcatccctgcatacccatttctattcatcaaaatgcctaggatatttccacctccatgatttgttgtcatcagctctctatccaacttccaccatctgacttttgtatcatcccaacgtaattggctacttcaagtcaaatattaggattactggttttttttttcctttttcctctcaatttctaggatgacttaaactcctttaattatcatctttgacatattttccaggctgagggccactttgtttccttccatagtactttcataatctcttggctatttttgagctggctttcagattcaggaagctgaatcctccttcctccttgaggattttcacgtgggagagaataaatatgcttgtgattttctctcctcttgcttcctcacgatgttcatcacttggctcactttttaacttgctatttaattctcatactttatttgattctgctacatacatttacattatgcttgttttattagccttaaattataagctaaggtgaaatgggaactatctctgttgaattgaatctcaccaatattcagcacaacattacatttgtttgtttgtgatttgacccttgtctgtaatgaaaattaacactaggttagtgccaaagtaattgcggttttgccattatttttaataaatggtacccttttctggggaagactcacagcacaccttactctttctggttcctaagaaaacaagcaccccggtatcagccaggaactacattgaatgtcatttccctgagacttgagtttttccactgctccctcttcacatttcccagacttcgttgtatctctctttttctgcttatcattatttccctgctatctcggttttccatttgcttatgcgaaatgttacagtcatctagtaagaatgtcttagggtcagctgtgagcaaagcaaaacagcagtgaaggataagagaatatcaaaagccatgacatagtccatactctttacccctgcctgtccctctaaagttaggatgtacttgggaagatatagtgtgcactcaaacagttgagaagaatgcaatactcacagacaagtttgtttcagagttccaagaaggggaagctcaatatgggctatcctggcaacaaggtaagaaaagttttgcagagagagtggaactggaattaaatcttacaagattagcttagtaggagggacaaagaagtgcatttggtaggagtggagttcatattggggagtcctgaagatgggggtgaatggagaatttagcattggaatattaagggactgaaggtcaagaggagaaaactggattttaacatatggacctagtatttcaaggagtagcttgaagttttatctatttttaaaaaattagaataaaaatctatcttttaaagtatatttcgaagtcattgatacaggcaatggagagttattggaggtttttgaacaagtatgttataggatgaaagcagagtttcaggacagttagtctgccaggaatatgtagaaggatgtgaagagagtggaaatgaagagagggagatcagcagcaaagagactgaccattgccatggtccaagttcaaagcaatgatgtctggcctgagctaaggtaatgaggtaggaggcgagacttgactctggagtcgggctccaacaccagatcaaattgaggactagataaaacagggatgaggcagaagatgccttccataaacacgcccaccagggtgccatgttagtttaccattgacatggcaacaaccaggagttactgtcccattccatggcaatgacccaaggactcaaaagttattactccttccctagaaagttctgcatacaccacctcttaatgtacatgtgattaaagttaagtatgaatataactgcaaaactgccctgagcttctcctctctgcctgtgaggtagtcctgcctggcaggagcagtcacggagccgtaaggccaccagagctgtaacgctgcagcttcaaaataaagctgttttcttccacctctggcttgcccttgaattctttcctgagcaaagccaagaacccttgtgggctgagacccattttggggctcacctgtcctgcatgagtaggaatgcagggacacagttgacagctgccttagatccagctcccagaagcaaaccctgagaggacgattcacatgatagtgatatatttgtgaggaagcatttccaacagaaagcagatgaattggggaagcaaaacaaggtatcaacagaggacaaaggaaagtgtaatttcaagtggaatccaggcctcagcttgatatggaaggggagtttctacttgagtcaaggggctgatttctcattccctgcactcaccattgcctgtggatcagggtgatggggagctgaggaggacgggggactcccagacactcctggttttttcagtctttggggtaaagcagtctagtagctcaagtgcagtcatctgaagagagtctcaggtagagttgttagaagcaaagtatccagagcagataagggaataggcagttataactcatcttatattttaagatttacaaagaataagcttttagaagccaggcacatattggaggtggatagatggatgatagagatgtaaaatttaaagcactgatttctgacttaccaacattttgagttttttactattcctagtgtgaagataatttttccggacaatccaatggttcatagtaggttctttaagatatgtaaagtgtgttgtaaatgtaaagtattaacacacatgtggcaaaaagcagtcttgttaagttggcatctcttcagctcctctcatgtgagctcatccccacatgtaagtgagataaccctttttcccaaggagttggcagtttacgacaattagattaaaaccaataaatgagaacaacgtggactcattagtaaaaaatagttgtagtgtttgacagcgctcaaatatgcaacctcctttgagattcatggtcattcctttaaaaggagaccaggttacaatttgtgtgacttgtgtctagcagcattcaaagccacagaagcatatagagaggaggagataattggatttaacccgagttggaagttagccaagtgagtcattggagggaaaaaaaggttaaatgagttaaatgtttgcaaataaatgattatagtcattggaccatggaatctagtctaagtaccaaaaaaaaaaaaaaaaatggcagtattaatgaattagttggaggtcttgatatggtcagggaattagtgaaatgagccaaagttaatgttcaaaaagaaggacatttgaaattgggattgacctgctgacaaggtcttccaaatgacaaggtcaaggataagaccttgggagaagatggctagaggaaagattactgatgctggggaggtcaaagaaatgagagactagggtattccacagattatcagtggatactagattaatagattattaagtagatgccaaaattttcaagaaaaacaacaggagtaggagggaaaattttcaaagttctttagcctcttaatcaaataaaaacaaaggggaagaaaaacaaagcaaactgtaagatgtccttaattgatgagcaattaacttccacaacagtgtttgttcactttgatacctagaattagccataatgattatccaagtaacaaaaccattttgcttttatttacactgaacatttatatacccaaagacatgtgtatccatggatatgtcccttaataattattcagtgtttccaaggattactaatcaaaaactttagggtcattgaagaaaagaattttaaatttatgcagagggtaataaaaatgttcctcacattttattataaataaagaaaatatcctgaattgcagtcatagatgtgtctttatccactttattatttttgtgtaattagttggctgtatcctatcttgttcccaaagggtcttttggtcacctttattccaaatatagtagctctctcagaataggtggtaaaggatattgggtgaaagataaactcacagaacaaggctaacctggacatgaattgagcagagtgcatgttcattcagctgatgatgtaacctcatcttacaattacatatattctctagttatttcttatttatcttatacctaactaagcaactttaggagagaattcatatgttctattattttttacaaaatatgatatatgtatttatgtgtttgtttcatcatatactctaacatatctcagttaactagctagttaagcaaattcattgagtagccatgaagtggcagtggcactcagcagaagctagcaggttgaggtgactaaagaatggaggattttagatagatgcctttttactgagaggaaatagggtgattgaaagagcccttggataagggatacacatcttagactagaccccccttccaccacttcactatagggattgggtgttttcaactcagtttcctcacttatgaaacattatcatgtttctgttattataatttaaataattagagaagaaagttttaaaaagaccattaaatatatatcatagtattcttatttaagcataaggacataattgctccaacataaccagtgtactctagagggtaactcaaagatgataaaaattgctttaaatttgggcttctcttatttgtttctaaaaacacaccagaatatgcttttagtttccaaaaagacttagtgtgaaaatgtacatataaacagacatgaaattaagactaaagctttctgacatcagtgatttcagcagaggagcctggaaaccagttactgagccttcatgctacttaagaataaggttagactaagaaataggatttgctctaaagcaagtaacagaggcaacttcaccaacaggcaaagtaggcaattgccttggaaagaaggcaggcttgttgcaaattacctcccttacccaagtaatgaatcacctggaattcctgaattaaagagacattcctttgggcaaataattttctgagtctggattttgagataggatggttaaacaaaaagtcatcttcagtcacaatttttaatgcagattagtttattggttcacatcaacctttaaagggagatgtggaaaaagtgtaggagagatagccattactggggccaggaggcaggtgggaagaggaagaatatggagcaagggaaatcaaatctgggggcactttccctcctgtatttcactgcatgaaggctctgcagttagctgcctgcgttatccaatctgtggactaaagggaatgaaaggaggaaggcagtaggaaaggaagacaaaacaaggaaagaaggtggagtgggaagggctgatttgggagaaatgaggctgcagcaaggttagacaaagctcactgctcaagtgtgtaaccctgcaggctacataacctgattattcctccagcttcatggtgccctcttctttcctcacagccctggccatggctcactgcctttctttccattcttagggtagatctatctctttcccatcctggtcttcttcacatacacagtttcccctgtatggacgctctgcccttctagcactcactcttgaagtctcagcttctgagaagccttccctggacccccattttcagtctggcctctagattatattggctgattagggattttcccatacagtcctttccacagtttgcaattgttcatgtatttgaatgatcacgtgtttaatctctctctccttctagctttagagaagctccatgaaggcagagaccatatcagtgtgtttcatattctacccaccaaggcctaccagagttactctgtaaaatctgttgaattagataaaccaatcgtttgagaagtttagtaacagcatgtttgcttttgttctttggactacgaacagtcacagaatggctatgcttattactgtcaaaatagaagcatttgtgtactgataggtttgcaaactcatctgaaatgtattatatctgattcacatggttaacctgaagaaatctgaacaggaaatttggattgacgtataactcacagtggcttggtatttcaggttggaattgtacagtatggagaaaacgtgacccatgagttcaacctcaataagtattcttccaccgaagaggtacttgttgcagcaaagaaaatagtccagagaggtggccgccagactatgacagctcttggaatagacacagcaaggtatatggataaaaaaataaactaaagtaaaagactgcaaaaataactgctcatgatttagccttttggcatatcaattgaaagtttaatatgacaatatttaaagccattttgtttaaaatgagattcagaagattaaataatggttacaagatcagatgtttgtatgacacaatctcaccatccttcttatccttctcttgttacaagggtttaattgatagagaatccattttaaaatatcactgcatctatattttcatgttcttgggtactaagacaatattagttaatatttgtttcatttattttttgttttcaacttctaagagtctcaatctaaaagaacggattaaaaataggtctacctctactcaatatatatttatattctagaatgtccatgtattttcagtacttgatttaccgttatcgaagctactagataagaggtgttaaggcgccaaattaaatattgtctatttaaaatcatttttagtgcaaagtttgaaagaaatggaaaggatattatcatttgtaatcctctctccttttttactttctttagattccctccaatttacaacccttcctttcttccatctgcagttttccttatggtgaacacataactcagtctgtggttgaatttcattttataagaacgaacagaattgtcctctcttacaaatgtagaacactttatttcctgtgtgttctcttatctcattcattaaactagcaaacttctgaacaaattcaaaacaatacaaaaatcacaggaaatgtaataagtagtttgattaatgttaagaatccttctgttaaatgtcttcaacttctgaactcttgccttaggtggaaagctaattacccatgctctcacttcatctgcctgctaagatgactgttttaagaaggttaaaaaagttaataatgatcctgcaaagaatggattggatattcaaaattttataatttcatgtacagcttttgcctcatgaatattagaaaatcatctggctctagttatatggggcccaagagaaaataaccacaaacagatggaggtaattggacatttacctacctattggatcacctattggatcaccaatttgtatacacaaagagtgcacatgtttaggtgtaccgaatgcacccccattcaataatcaattaaatgtgactgcacattcgaagtaagtcaaagtgttctttgaaacctctgagcctgtagggagctgtacgttttccaaaggcaaccatttaagaatgaatattcatctctgaaaactaactgaagaaatattctggctgcttttgcttctgcataaatacggctctaaataccatgtccctatgtgttttttgcctctgtgtttcacaaagggtatagctgtgggacacagagtttattgaattttgattatacattaaaattctgtagtgatagtaccaagtatttttctcctacattaattaccttttcatgtttaagcacattttaattgttttttattcctttcaggcagaagttgcaaacaatatttttaatatttttagaattctttaccttcattttcagtaaatcccagttcaaagttttgtgtgtgtgtgttcccttcttcctatcccaaatttttacttttgtcaataaacttacagtatttaatcatgaggcctggattctcctgtcttgaagaaagggacactcttgatatattttaattttttaaagcatgcaggaaagtcaatgcttagtgccaagaaaggacactggatactggtactttgaggacaatgacaattttttaaggaatgtagttgaaacaggaaaggtgtactcaggagttctgtcaatgtctaatcttccaatattacataaagccagccctgagtttagaacagtcacattttatttatgaaaggccttttaatcatctccttcagctgatgttcattcaattcttttgtaaccctgatatttaagagaattaggaagttttagtgacctaaggaatttgaatttcaaaagtgattgaatctcatatgatattcgcatacaaagatctgttaaagactaacatgtaacgtctgttttcacctttgtttgtatactttaaaaagtcagaaaatcggctgggtgcagtggctcgtgcctgtaatcccagcactttgggagtctgaggcggctggatcacctgaggtcaggagttcgagagcagcctggccaacatggtgaaaccccatctctactaaaaatacaaaaaaaattagccgggcgtggtggtgggcgcctgtaatcccagctactcaggaggctgaggcaggagaagcgcctgaacccaggaggcggaggttgcagtgagccaagatcgtgccactgcacttcagcctgggcaacaagagcaaaactctgccttaaaaaaaaaaaaaaagccagaaaatctacttgtatagtatgttaaaaattattcatgatatttgttaaagattgtaaggaagacatcactcaagaggaacctttatgatgaaggtattgcagtaaggaagagagatagggctcagctttgactacagtgaggacaagtgggcatttatagtcaaggaacagggcagggattggcagtaacatcaaggctagggggattcttgctagactggctcaacaggattcttgctgaaggcagataaatagtaggaaaaataaactgtttttctctttctatattctaaacacttgacatgtcacttctgatgccagatgtgtgggatttttcccacatcgaccagttatctgacatcagctgcatgttctagaattcaattcagttctgacaccaactagagtttatgcaaacctcccacagattaacggctcagtccttcaagaattcattccaatttagagccagtaggtttccaggtacccacgatttgtccaacgtggctacaaattagaccccttacttgggtttgattatatgctagagtggatcacagaactcagtaaagtatcttacttactattattagtttattataaaaggatacaactcaggaacagcaagagatatgtagtgcaagctatgagggaaaggtgtcagagctgccattccctctcatggtgtacctccttccacctgttcagcaacctggaaactttctgaaccccgtagttcagaaagttttacagaggcttgatcacaggcatgattgattattaactgattctctagcccctcaatctttcctggagaatgagagctggggctgaacgtttcaagcttctgatcatggcctggtccttctagtgatcagctcccatttaggagcccaccaagagttacttcattagaacaaaagatactcctatcacctaggaaattcaacagattagaatatctatgtcagaaacccaggttaaagaccatatattagaacaaaagatacacctctcaccagtattgctcaggaagttatgagagttttaggagttctgcaccagaaaccagaggcagagaccaaatatatatttattatttgttaaaggaaaattttagacaaattaaatttgacagagtttatttgagcaaagaatgattcatgaatcaggcagcagtcagaaccataagaagttcggaaagatccattttagcagtgtgagcaatgggcttttacgagctgaatgcaaaatcaaattaaagaaatgacttgattggctatagctaggcatttaccttatttgggtatgatctggtggaaagttagaggttacttgccaggttctgattggtaaagtctctagttagaagttagttgcagtttctaattggtaatgtttaagttttgttttactgtttacattgaattggactttggtttgattatataggaacatacggcactggagctgtctcagcctaattgcctataaattcaattcttttaaaagataatatcatggaacagcgtaataagatttagagggtggggaatgaggaatgtgatcagataccaaggatgagggatttccactaaattgattaagccagattcttgcttaaactggactaagtgggtaaagaacacagcccagggtcagagcccagtctagaagaagatgtaaaggagcctgactcggttttggtcaaggagagggtctttgtcaagtatagagggcagagagactcaaagaaagtaaaaaattagtacaactatatcctgtatatccaccactcagaactgacagttgtcaacatcttgtcatatttgctttaagtccttcgaaaggaaaagtcatcacatagaatccttttccccatttcaccagaatcctctcttcctgcttaaagatatcagttatggtatatttagtgtgtatctgttgtgcaaactctttggaatgttagcttaagacaggcgtttccttggcaaatctatcccaaatggcagctgtttgtctgtacaaccaaatatctaaatggaccattcagtacaatgattgctgtactttgtaccaaaatcctagaaatatatgaagtcttttcattactttagtcctaaataaaatatactcatctcttccaagactccagagcgaaaaggtttgagtaaaaggaaataaagggggaggggagaagtgtgtgtatatatttatatagaatacatacaaaacaaaaattttccatttccctgtcttctgtttctttccataagtgctgttcaattaaattcaaattcggttttttgttttgttttgtttttgagacgggaaggtgtctcgctctgtcgcccaggctggaatgcagtggcgcgatcttggctcactgcaagctccgcctcccgggttcacgccattctcctgcctcagcctccagagtagctgggactacaggcgcccgccaccgcacccggctaattttttgtattttagtagagacggggtttcaccttcttagccaggatagtctcgatctcttgacctcgtgatctgcccgcctcggcctccctgaaattcagggtttttttgcagttaggttatagcattttcccctcctctccattgccatcttctcccatcctgctctcagcagcctgtgtgctaacacatagttcaggccaaatgttttgtaactccttcaaccactttttgctccctaaaacccaactgactactccatggactcagagcatcaccatctgcagtctattactcccatgtgaaagactgcagatgtccctatccccaggacactctcaagcactcacagccccactaatactctgttctctctcatctctcctccccagattagaggattttcgagccattctacaaatgtcagagtagctgtgggggaagcaaaatctcaagcaaaagtttctgctagacgcagaagaaaagaggcctgttaaatgagagaaggggtgtttacagagaaaggagcacctgggggagtgtttacagatctggccttctctgaccatgatgtatgcctcagtcacaccctccctttgaaatttccaaagaatgaaatactgctgcctttttatatataggatgtgtggtgattagcaaaacggagacctctccatcatctgaaataaatctaaaactattacaaacaaggctcattatgcctcccaacttgaatgatgggcattgatgctaattttggagggaagcaccaggctacctagagtagtcagtgtttttgtttagttttttactttgtctattgtaaagtggtgtcttatcaacctctcttttgtttgtgattactttagaaaggaggcattcacggaagcccggggtgcccgaagaggagttaaaaaagtcatggttattgtgacagatggagagtctcatgacaatcatcgactgaagaaggtcatccaagactgtgaagatgaaaacattcaacggttttccatagctgtaagtgtgttgccggagatattttcaaactcttaggtgtagagaagagctgtgtgcatattgggtaattttatgaaagtcacacaaaccaggttggaaaagagaaaggtctccatttgaaggtaagccctgggaggacagacttggatcttgctccctctgggtccttagtacccagcacaatgccaggccaaacagacactcaacaaacaatcattgaaaggaaggaaggaaggaagaaaataaggaaacatgaaaagaggaagaaggaagcaaaaacataagaaggaaggaagggtgagaaaaagaggactgaaaaaaagaagaggaaaagaagaggaggaaaggaagggaagagggtgggaaggcgggaaaaatgcctttgcctttaaataagagagaggatttgttcagtataacaagagcagtggccattgggcttcccttccccgtctgagcaattttcgactctctttttcattaattatcttcccccatcacttagctaaagtgggggaaagtgccagttgtctctgtttaaatattaacaacttctgacgtttgacacttgcttttcagcgaagtagacaggaattgaatttttgttttctgatgcaatttataagctcctggtatagacctttcgacctaaaatgtagacattctagtggggaacaagttctgaaataaaaagttacccaaatggtatgccaattacttcagagctagctctagttttaacagtgtgcttcttcaaaacagcttgcagttcttctcagacattagtgcattactcctgtaacctcattattcctatagcttcatggaacagcaggtgagggagctgagaaagaggcaagggcacccagtgacttgggtggtcccagaggacaggggcaaagtggcttaaagtcctctgatgagacgtgtggtatttcctctgggatggtcactgatactccccagggaaaaggatgagggctttactgaagcaaaagaaaagaattgagaataaatctgccactgccttctctctagtaaggaacattcaaaagccactgcactgccttcaagactcactttctcacattaacattgagtgtacattatagtatttcagttgctgctctaaactactatccatttttttttttaaatggagtctcgctctgtcacccaggctggagtgaagtggcacgatctcggctcactgcaacctccaacctcccaggatcaagcaattctcctgcctcagcctcccaagtagctgggaccacaggcgcacaccaccacacttggctaatttttttatttttagtagagatggggtttcaccatgttggtcgggccggtcttgaactactgacctcaggggatccacctgccttgacctcccaaagtgctgggattacaggcgtgagccaccgtgcccagcccactatgcatttaatgatacaaataaacaagtctttcgtagattataaacagcagcactttaaacagtaattttagttcttttctaactttctataagtgaaaaatctgtatccttcttaatcaaactatcagttttttaatctaccattctaaatctaactttaaaaaactacatgtagatgtgcagtgggggtgagctactcagatgggtagggggagcctcagacctggaggaaaggggtgggggcagccctcaagcccattgcccttgtgcccactatcctcccaggccacagtgcagaaccatggtcggaagggtgcttgaggtctgttttgtaacaggactttgaaggcagcaccatggagctcttcgtttttaatgatgccagacaaggctattattggaaaaagaaatgtgaagccaaaaaattcctgtaccttcatggtcactggaggccaagactctccttcttcttagaggatttggatattcttaaaaaaaaaaatcaagcaatagcaaagggctcagtgtctttcctttattttttggattccaggagcatagccttgaattaatccgatccttgcttcgttcaggccaaattgtaatcatttgttgaaacaaactttatttgtttctctgtttagaactatatctgtgtatttattttaataatattataagcatccatggacctaccacccaaattgagagctagctctcttttttggtaactacatctgagcacatttaccacctgccttcctccacctgggtaaccatcagtccactttctacattcctcaacctggctctacttttcaaaataatatttaggcacccatacatatccaaaaaaataaattttaagaatatttcattgtttttaacattttaaaaagagtgtaatgctgtatataatattttggaacttttaaaacttaatactatattaagattcatccataatgttgcatatctgtatagttcattctgtttttaaaaattgaagtgatatttacaatacagtgaaatgcaaggtttcagtgtgaaaagtgtgcacgaagtgaacaatttggtgagttttgacaattacgtgcacccacataagacttaatcaagatatagagcaatttcatcactcccagaaagtttcctgtgctttcttttttaaaatgtatctttaatttttatggatacacgatagctgtacatatttacctggtacatgtgatattttgatacaggcatacagtggctaatgatcaaatctgggcaattggaatatccatcacctcagacacttatcatttctttgtgttgggaatattccaaatcttctcctgtagctattttgaaatatacaatatgtttactgtagttgtcctatagtgctactgaacactagctcttattccttccatctaattatagttttaaatccattaactaacccctcttcatccctgctcttccccactactctttccagcctttgataaccaccattctattcagtatgtctatgagatccacattttcagctcacacatttgagtgagaacgtagtgatatttgtccttcagtgcttggcttatttcatttaatataatgttcttcagttccatccatgttgctggaaatgacaaagttttgttctttttaatggataaataatattctgttgtgaagatataccatgtttttttaaatccattcatccattgatccatacttaaggttaattctatatcttgtctattgtaaacagtgctgcaataaacaggggagtgcagatatttcttcaatatactatttcctttctttgggatatatacccagcaatgttttttttttcttttttttttttcattttaaatacacacctcctgtagtaaccactgatgtgacataccaccatagctcacttagattgccaattcttgaatttcaaataaataaaactgtatagtatgtactgtgtgtttagcttttcactcaacataattattgcttgtgatattttgtgtactggggattcattttttgttattgttatctattttatagaccacaatttgtactctactgtttatagacattttgcttgtgtccagtttgagttattgttataaatgtatcatgaacactaaaaaaaaaaaaaaaaaaaaaccaaagtgataatcttcaggtaacacttgcaactatggtaaaaactaatttttttatttattacagaagtgattttttattataaagttttaaaaaaaatattgaagcaaatataaggaaacacctagtgtcctaatatacagaaatacaaaataatatattatgatacacattttttcacattttttatgcccatgtacttatgtgatttaaaaaatagaattaggtcatatctacatattggggatttttaaatttttttgcatgttaaattttacatattgttttaaaaatgttttcattatcttgaacatttttatattaaaaacagttttaacataaaaaatttttacattaaaaactaatttttttaggcagaaaaagtacaaacctcaacaaagctaattagttggacttcatcaaaatgtaaaacttctactcttcagatgacactgttgagaatatgaaaagacaatctacagacgggaagaaaacatctgcaaaacacataaaggacttgcatccagactatatacagaactcttacaacacatttaagggaaaataaacatctcgttttcttttaatgggaaaaagatttgaacagacactaactacaccgaggaagaaatactatagcaaataattgtatgaaagagtctcaacatcattagtcattagagaaatgcaaattaaataagacaccactatacgctaacacaattgctaaaactaacaagtgaacaaaaaaaactgacaataacaagtattgacacgcatgcaaagcagctggatctcttagacatttctgatgggaatagtaaaatggcaaaatgggacgattactgtggaaagcagtttggcagtttcttaaaaagttaatcattcacttattgtatgacccagcactttcatttctagttatttactcaagagaaaagaaaatatatgtctattacagagacctacatgtgaatatttacagcagcattattcataatatgttgaagctgcaaacaactcaaatgttctcattaagtaaattgtggtgcatccatacaatggaatgctactctgcaatagaaaggacccaactactgctacatgcagcaacacggatgactctgaaaagcattgtacaaagtcacagaagccagacacaaatggctacatactatatgattccttaaatctgacattctggaaaaatcaaagctataaggacagattatttatcggtggttgccagggttgaacgaggggaggaagggattgactataggggcaggagggaactttttggggtgatgtaaatattctacaccttgatgtggcagtaacacaactatattggtttgtcacactcatagaattgtacatctaaacagggtgaattttactgtatataatttattgcaataaaccttaccttaaaaaaaaactaaatgtttgagaaaacctgcttggacatctaaataattatagttaacaatcatatataactcctgcttctctctcctcttcataaaaaagaatgcccctgtctccagcatttggtttcaaacaagaatatctcaattgtttattttccagattgccaatttagattaccacttagtccagtatgtgtttaaaatatatatgtgctggactgtgccttggtaatagtttcaggaagaattgctcattcaaaagcaggcaactcacttgctgattgcctttgccagcagataatgacatcactagctggaataatatcaaagacattcagaaactatgaatataacattacttttgaactgtcagattttaaaaatacagctgttagtaacagggacacagagtacaagaggagaaattttcacagacatacaaaattgccctttatatttttctacaccaattgtggtgtttatataacagttaatattagggagtctacaaattttgaaaatcactcttccataaatatgaaagtacataaaaattccattatgctaaggtactctacactgttgtttactgacaaaatgcttgagatcctttatttaacacatagaatttaaaatatattcttgctgtttctgttgtgtcttagattcttggcagctataaccgaggaaatttaagcactgaaaaatttgtggaggaaataaaatcaattgcaagtgaacccactgaaaagcatttcttcaatgtctctgatgaattggctctagtcaccattgttaaaactctgggagaaagaatatttgccctggaaggtatgtctatttatcttattgctgcatgttctctctgcaattcaaaatcagtataatgggatttttgtatttattcctaatacatcagtaatactttttttttttttttactgtgtacaatatctagcatggaacaatgctcttttatataaatctgccattaagatggctgtttctcacaacactgtgtctgctagagactctctttgtaagggcatggtagggcagtgctgatgggacagccgatgaagacaatggtcaatgtagatgtgccaggacaaaaatgtttccatgtgctttgttccttttctgttacatagatttggaaaatgagggtactacctctggtttgggttttttttgtttgtttgtttcttcatttcatattgagctactacaagagtgctcttatgcaataacttctttgttcacttattttctctgtattttgctccttgcccattttaaaggtcttcatggaaatttgccttaaaatccatggcaatgaaacattggttcactgtatttgtctaaatcatgttacttctttgcagatttttccttgagttttcaatggtgactggctgttgaggataacgagttatggcattccctattctgccttaggtagaggatgtcaagtagctaattactttggaactcgatctttcctaaaaaacaaaaaaaaaaagtcttcagaattgttatgccaggcaaactggcaaagcttctttcttcacattctttgatgatctctagtctcagggaacatgcgccttttctccaactagggagagaaaccaccagagaattcttttccccttaggctacatccaaatccagttgaccctgtccttgtgaggacacactgaaagactgttgtttctacatcttaacaatagaaatttaaaagcactttctcagtttccctgatttgattgataataggaaacagaaagacaaaatgggaatgagacacaactgaaaaaaagtagaccattttgattgagcgtcaaggggctgggaaaatgcagaaaaattagaatatgaaaatgtacagaaaggaaagataattatttagagttatggctttcaaactttttttgagtgtgactcacgataataactacattttgctttttgacccagtgcacataaatatatacatataaaaataaggcaaagtttcacaagataattcttattacatgtgatgcactgtgatggtttctcatcaattccattctaccctaatctctttcaatgaaaaaaaaatgctggctatactcagtctgttgatttcatgactgggtcacaatccgtacttagaacatttgatttagaggtgataggaatctacaggccagccagactgaatttctgtgcctcccttttcccctggcctctttcccctgtgcctttagaaacagaacactctaattgtttatgagtctggagtcccagctgcttctgaagaactcagctgtcttgtgctctgtgtacaagtcatttttaagtggctttggtctctcaacagctctcccggtgtcatttaccaataaaccagattatgagcttggctggccttaaggaaaatacataaggtcttccaactaattgtgtacttttaatttttaataacatgggctaagatatgatagaaacaatctgtaaaaataatttaaaagaaaagttacatagttacatttgatagttcaacagaatacagtgtcatttctaaatctccttttaagtaagcaagtaacctaaaactggcaaaaatgaagcccacttcagctaggggagggggagatcaattgcctgaaatgacatttcagattatttctaacctaactacaccatggattaaaggtgacaggttgaagagcccaaacactccaagaagtctctatatttaaatatgacatcattttataaggaactttacagattacaaatgtcttctatatcatctttgttgctacactacaccaaaagcagtgttttgactagactatttcttatttttttcatgagatatttaaaaaggctttatttctttgttgctcgggaaatctccatttcctgtcaacatgtatcttaagatgacaagtagctgtgattatgaaatttctgtttgccaaggacagtgccatctattgaggcaagtatgccaaggacttgcttagtacatcagaaaatagtctactgtctccatttcccgttgagcactgggagaaaatgccaacatttctaaccagaggctgcacagtggttagagtggctggcccaaacacccatgaacagtccagggagaagtttgaagcaagaagcccaggagaatatagtggtctattaccatgatgccactgcagcaggaagaacatcacatagcgtccttctgtctgttctcagctgaaggcagaatagcggcagggcaggtgctgaaaataatgcaggtttccgttgctgcattcttattgatcttgcagataagtgagaaaacacctgaaagcattgtggactgaaaatacatgtttaaattaaagttaaaatgcatctcagtcatttaaattacagggcaattcacacaagagattaaaatgatatatttgaattcttcactgccgcgtctaatctagtcctacaaaggtaattactgatgtatttgttcacaattttatccatgtaaataactaacaaatagttacattcacaaatttgattattctcttgcctcaacgaaagggcagactgactttcttaagtgctatttttaacttatctgcaaggccaaataaatcagtaacccctagtgcaagcaaataaatcaacattccatcaattccctcaggaaattgtggctttgggtttgtgaatattttgagaataatttgagagtagcagactgccatggaatgctctgaattatctctgcatttcagtaaagagcttcaaaatgggtacaggatcttttaaaaatgtatgattgaatggcatgtgggcagccctatcacaaagacccctctggatctgtgagtgatacttaccaccagtaattagagcaaataaatgcatactaaaatacctaaaccctttatcacacaatgaaattctgacagaatctatggcctgaatatgggtgggactgatggagttgagaaacctctttaaatatgtgaatgaaatttttttcagtcccataacatattaagggagtttagcctaagggctcagcagggttcccaaggcatgaatttggacaggaatttcctactgtagtacatccaacttgagccttgtggacccaaagcaccataggatccacaacatgctacagtataagaatggagatttctcaacccctctggcgaggacagggctgctaatgaacaagaatttgagacatgagccctttgactatttttctctgtcttctacccaggcctacctagaaattttgggttgagaaatgtatggctgaaaatgccctaagatgtttgaagttctggttggtaagaccacaagctctaccaggtatctgtattctgcaagtcagtagtgcatgaaaaggcattgttacttatttacagtgatattttcctatgttatagccacagctgaccagtcagcagcttcatttgaaatggaaatgtctcagactggcttcagtgctcattattcacaggtatgttgaccagttggtgaaaaatgaaatatatgtttgcaagacttcccttcccaaaccaacatctagccatcagtatgtaagtgcaacgtgcagttcatagcttgaacaattatgcaggctatgatgatgttttctaattcaaataggaaaatatcatttcacaagcttcttattaagaaaatatgttctctcacacagttcactacattgtactaatagttgtgaatcagacagtgtgagctttgccttgtaattatgtatctgtctaaatgaaataatttaacatatttgctacagatgtggaatatttttccacaggtcaaggaattcaagggtcttattagaattccatgttcaagacctaggatgctgggcacccagaataaagtagaaagacaagattagaaaatatatcatttgcagttaatgaaagaaaaggcataatggtccttgcaaaagaatattgacatttccatgtgcaattttactgtataacttgggtaagttatttgtgccttgatttccttttctgtaaaacaggtatggtagcaatagcatctaactcatagagttatcatgaggattatataagctaacaaatgtaaagcactttgaacagtatacctatacacattgttaatggtgtttaagtatttccccttattatttttattaaatattattatcttatttatttgcatgtaaggactgggtcatgcttggagcagtaggagcctatgattggaatggaacagttgtcatgcagaaggctagtcaaatcataatccctcgaaacacaacctttaatgttgagtctaccaaaaagaatgaaccgcttgcttcttatttaggtaaggtttggatataattataaaagagttgttttacttttccattttttacctttagcattatttgcttatgtttctataggcttgcaaccatatagcaggattatttcaacaagttgggtattttccagaacccatgcaaagttttaggcctctgagcagctttagttagtcaaaatgacatacatgggggtccttttttgttagtagggctgtctaatgcagggaatggtttaggttgatatgtgccctttctgatatgttcagtttctctgtgtctggtatcaactttaacttcaaggagaactttgaacctggtggacaagaaatgagagtagaaaaggaaacctcgacttctcctatatcctgaaaaccaaactcatattgtcttaaatgtcttctatcattaatttctctctatgggtcctaatttgggaaaagaaaaatgtattttgtcatgtaacttcttctttaatagctccattcacaatcagacaaatattgaacttaaacccagtgatataacatgatcttgtttcccagtgtcttgccagaaatgaggagttgtatgtctggtaccactttatttgggatctataccaagctgagcaacacctgggggatgccagggaactctcccctcactgaaaaaagatattcaccaacagttgggaggacctaaaataaaaaggaccatcaggatatggcttcccagctcttactcactcaacaaatatttgggggatcctcttttgccccaggcattgatcttagtgctgggaataaagtgataaagaaaacacataccttggcctggaagcattcacagcttcacgtgttagccttcctctctgggatctttctgtcccggagacaagtctttttctctctgtcccagttgctttctattttatcaggaaggtggcaggtctttactgcggtgtttatacatctccttattgaaggacacctattaaagctgtaggagcagcaggacttaagaagaataaaaggactagagttttagatgactaaaaatgtaacagtcaacagcagctgcactgtgactgctaaaatctcttaagacatgtagaactgcatgaatgaaagtccagtctgtttctcatagaaatcctgttacattccactctggtcagacaacagctagagtatctggttgttctaagtatcacatactacaaggagaaaatgacaaactaggatgtgccagtaaaatattacacagaaaagtcagctcccgaagcaattccctgctacaagtctcactctctcgaaaacttaaagaaattgaaggttagaaaacaaagtgtgcattgcatgtattttaggtatttggaggattgtgatataaaatataggggttaggcttaaaattcatttcaaattttagcattaaaagagatcctatggagcatgtagtcttaatttccaatcaagaaactgagagatagaacaattatgtcccagctgcctatggcaggtgtgaaaccacaattgaggcttcttgattcttatgtcagtgtttatatcacgataccaaaataactgattctgggttgattaagaaagcactgcacaaatattgagtaccagcaatgtgccaaacactgagtttatagggaataaaaagatagatggggcaggtcagttcctacactgataaaccttacttttttgggtgagagacaataatgaaacaagcaatcactatcagtatgatatgtgctatgacacagaatacctaaaaaagagggctggggattagattagatatcttctaaaagttcattacatcctaaggttctatgagactgtttatgtgaaataccttggaatcaagaaccagcttaacctgaggcttctgttatatgtagaataaatatagaacatttatcttcctatataatggatgacatataaattagtaaaactccttatgaaaggcatttgacaatgtgtttacagagctataaaaaatgttcgtaccacatttatacagaaatttcacttctgtggacctaacctagggaaaaaaatccaatatttaagaatgccaagtgaacaatgatttccattgtattattatttatgttattgggggaaatgccattatcctaaatgcccgaaaatatgcaggtagttaagtaaatagtaaatccacttaatgaatattacacacccataaaaataaaaattataaagctgctgattctatgatactaaagacttgaagcagttatggtacaaggtgtacaattagcgatagcgatgaggtcatagagacttgagcttgttttctgattctgcccctggctatggctttaggcaaattactctccccctcaaagcctcaattttcctatttctaaaatggaaataattacaccatatatatcatttgggttgttagattaagtaatgactatatttagtactgtgcctgacacacagttaacactcaatgggtgttgtctattattttattatgtaaatgttattatgtatttttttattgtgtaatgttatataataaacattcctcttattagtattgtggtaggcagaataatgatccccaaagatgtccatgtcctaatccctggacccatactttgcatggcaaaagggacttttcagatatgatgaaattaaggatcccgagttggaagattatcctcagatatctggctggacctgatacaatcaagcattctaaaaatcagagaacctctcctggatgtggccagagggagacagaactatggaaaaatggtcagagagatgcagtgttgttggctttaaagatggaggggggccacaagccaaaaactgtagatggctctagagctacaaagggcaagaaaaccgattctccttgataggctcccgaaaggaacactgacctgccaatatcctgatgtttagtccaggaagctctatgccagacttctaataaacagaatggtaagataaaaagttcatgatgctttaagccaccaacttgtggtaatttgttacagcagcagtagaaaactcatacataatacaaaataataatagtagctgacattagtactattactaataagtattgagtatttacaaatttaaagacactgtgtgaagtccacaaagatgtgtatgatattgttgccactcttaggaagcccacacattttaattgataacactgtagtttttggtattcttaattatatgtgattaaattcctttaaagtaaataaactcttaagaatcctaaatttgtcattcccaaaaacctttggttaaacgttgcttaaagcagatgtggagaattcaacttaaagatgccactgcaagtaagaaaatattaagaatcttatttctgagcacagtatttataatatatgacttctctctgtccaaaaaggaaatttttgggtatgttttctacagtgtgctgagattttcttttctgtttcagaaattatttcattagcttactcacaagtgagggtatatgacattttgccaacataaagtctaatacatgtaagatttctttcaaaatagaaaagcattcagaaaaggcaggacaaataccttgtgttttttttcacccaaaataatattctaaatctgaaatgaagttttcaaaatgtttctttgtgggggtcacaaattgagaagagactgagtgtattttttcataaactgtgtggattgcaagttgtaaggctatgaaaaatcttatgaaggaagcagaggcagaggctctgttagaaaaatcccatgcttatcaataaggatcaggaaactgtaagaactcaagctgtcaaacatctgtctcaggacatagtcctaccccatctttctattacccaaactgccttatgccaatacaggcattgcaagtgaatttggtggtgaaaatacagctgggattatgttcccctgcctcctccacccacagtttgctgaattctattcctgccatacagcttccaaaggagaaggaaagatgtgaggcaatgtcatggcatcaagacagatcatacctgtttcccattacctcactagatcctggcccttttcccaagaagtgaattatgagagctgacagaattcattcttcataaatccatgcaaagggctatgccatccattttagcctttttttcctcttttttttttctctttatttgagacagagtttctctcttattgcccaggctggagtgcagtggcatgatctctgctcactgcaacctccacctcctgggttcaagtgattctcctgcctcagcctcctgagtaactgggattacaggcgcctgctaccatccccggctaattttttatatttttggtagagaccgggtttcatcatgttggccagactggtctcgaactcctgacctcaggtgatccacctgcctcggattcccaaagtgctgggattacaggcatgcaccaccgcgcccagcccttttcttccatcttattcttttctttttcaggaaacactattaagcttaaatatttataattattttccttcttttaaaattaggctttacttggctctggctctctttttcttttcttctttcttgtctttagacacccaagcctcaattagtaactacgctaactggtagttactgtccctgagattatttcagctaatatttttagttatcaagtataagtcatcaaagagagttaactaaataatctcacaactcctagcctcaaacataatttttaactcatttttaaaggaggccttttatcaagttacattcacagctctgcaaattacacacacacacacacacacacaaacacacacgtactaacactctcattctactcccttctttatatttcttagcagagtggcatgaaataaaacagccttcattttgcacattcttcttttccattttatgtatgtataaacatggcctgaaagattcattttaaaacaatattgtggttagtaatacaaacatgtaacacattacatgttcgaaaaaatattttagattctattatgtataataataaaaaaccctcaaagaaagatgaaggaatgagaatgtgaggaatattcataaaggataatatgcctgaggaatagtgttcctttagcacttgtaagaataaacatactgtataaaaacttttgttcctttttaacatttttgaaagaaagtcaaacctactttacagtaaaatacttggtaagtgagttagaaaaatgatctttttctcagtgagaagtgctattctgtggcattttgaaaaataatcttacttctgctccactgaagaaatctggttattaaaagagttattccttttataaaatcaaaatctgcatgtggcaatttttattcattgatatggctctcttctcaaaacacaaagaacaaatctaacttttcactcaaaaattaatcttaaagacacaatttatgctcttcctgtaagcagcctgagatgatctcttaaaatggtttactattcacttgacccagaacaacccaaaaaatcattcaaatcaagagattgaaatcttcgtgttcactttaagaacatccatgaagctacccaggcaatcaagggttatgtatatctgaaaagccaccaagtatctgaaagatgtgactttacagaagcagtgtgtgccgttccatcattgcaatggtggagctggtagatgtgtccaaagccaaaccgtggagctggacagagggtttatggccccaaaagagtgctgaaagtttgttgcacatgcatacaaatgtaaaaagcagtgctgatcttaaaggtttgtatgtagagtctcttgatcattgtgtacatctaggtgggcgaagcacccaagatacactggctctgtttacagggctcatggtcagattaacccatacgtgacctccacccccactatcgcacccaccgcactgaaatgatgcttactgaaatagaacaaatttttctaagccagaggaggaggttgcatagaagaaaaaggtattccagaagaaaccgaagaaacaaaaataatgacccaggaataatttcaatataaaatatatgcaaataaaatcaaaagtagaaaaaagacaatcaaaattttaaagagcatggaagctcaattaaaatagaggagagaaccgggcacaatggctcacgcctgtaatcccagcacttcgggaggctgaggcgagtgcatcaggaggtcaggagattgagaccatcctggctaacacggtgaaaccccgtcttactaaaaatacaaaaaattagccaggcgtggtggcgggcgcctgtagtcccagctactcgggaggctgaggcaggagaatggcgtgaacccgggaggcggagcttgcagtgagccgagatcgcgccactgcactccaacctggacaacagagcaagactccatctcaaaaaaaaaaaaaaaaggaggaaagatcagatacgtgaaaaatgattcaagctctgtgttgaataaagtcacattaaaatcacagaaaggtactgttgttagacaatgtttaacacctattaaaacatacacaaatttaaataatagtgatgatacacaaagcctgggacagtttcatgaaattgtctttcatatggcggttcatagaacaaagtagtacaaattttctggaaacaattttctagacactataagaaccattaaaaacgtgatccagtgatctattccttgaaatgtactgtcaaaaaatccagaagagggacaaatttaaatgctccaaggtgtctttgaaatctgaagcataataccaaaaatattaaaaccacctgaattctagtgttttatcgggaaatggccatgtaatataaatgcaatgtctttatgctttaaccaagagaaatcatcttcaattatttaaaattacaattttaaaagctagtagcagcacagaaaaggtttacattttctatgattccaattatatgaaaagtgttaatttctgtagtgcagacacatatatccaaatgaaatacaattgatttattacaaattggggtggggatgtgcaattttttatgtgtgtcatcattgttatatcatttgtgattttaaataatgaaaaactcagattgggggaaaataacttctcaggagaaagcagttgtggtagatagagagcatattaaaagcttccaccaaaacaaattcttacgtgcattgaagaaaaaatattattttcaaaatataaccatataaaaatgattatcttggccatttaaaaagagtcttaatttattacatgaagcctttaagggtccaggtggtatacctggaatctttcttttgttaggttacactgtaaactctgctactgcttcttctggagatgtgctctatattgctggacagcctcggtacaatcatacaggccaggtcattatctacaggatggaagatggaaacatcaaaattctccagacgctcagtggagaacaggtaaacttgaaaaatattcttttatttaaattaatctattcatactctatgtatatttactgtctattgtcctaaacttaaaaatgcaatacccacatattcagtaacaactgggaacagggccctgtgttaggttctttggaaggatgtatagtgtctgtatctttgtcttcatgttggatgggtgtggaggtaagatatacaatagatgtggatacagatgtacaaatatatacacaagaaaagagatccaaaacattaagaggcatgaaattaccagtggcccagacaatacagtcagaatatgatgggattgctttaagctaggattggtgcagaaaagcttattagaagatgaaattcgggctgaatctacaagggatgatagaatgtggataggtagaaagagcagtgaaagagaaagttaaaaagataacatggacccatatgatgtgaggttttgaatggcaaattaagagcttggattttatcctggaggtaatgggaaattgtctgtaatatttaaaattgaaaaattcttattaggtagtattgaatattaaaagaagtttgggaaatgatacatgaaataacatttacatatgtatatataaaaactgaaagaaacatcgtaaatatgcaaacatttacacacacacatattaactgaaagaaagatctaacatgctttttgttgttgttatttttgaattgtgatagcttgggaacttttgtttctaaaaagttttctgtatttttcaacagttctacaaggaggatttattaactttattccacagtccttttacagagggtgggagaggggttcttcttagccttcactaaatattccaactctctagactagaggggcaggactgcatcagccctcctgctctgcaagagtccaagctgcagcccagcgcagcagtaaagctcaggtgcagggatactcacattaggcaggtccacaaactgcactcgctttaaagccccatgccctgcaggagcagtatcttttatgacaacaccatagacatagcttccagggtgtctacaaagggcaggccggctacaagagtaactgcactctgggaagtcaaaaatatgtcatcttcatcaggtacttataattcatttatagttccacacagcctgaatacaatattccagtaagaggttatttttacccctgtcagcgttgcttagccttagtggtaaagttgaaatcccagccacagcagattcccagggcaacagagttagagtagctaaaggtcagctcctcaagtatcaggtgaaagggttttattaactctttgcccacatttacgcttggaaaacgcataacagttagaaaaaggctattgttgtagctcaaactggaggtaagagaacgtaaaataagatgtcagcagtaaaaatggaaaaggaagggccatgacagatatcaataataggaagttgacaatagtaaaatgaagcattttagatgacgtctttgatccattatcactccattaattgtatacaagacaagaagtgtcaaattttatgaaaatttgcatatgaaagttgaggagagtatcatgaatgatttaaatcgtgaatgatttcagtttcaagcctgggaatctgaaagaaaggtggctccatgattagaatgtcaacacctcaagcaatttagatattttttaacaatgacgtttggcttttagacatgttccttgtaacagtaagcacaaattcagatatttgaaggtgccagtaaagtaaaatcaaaataggtaaagtcaatgagtaaagctgctgggcaaaaaaacacaggaagtggtgggaaccatggccctgggcagcttgtgagcttccactgagctccagttgacggttgccatgtggggaggaaagcccagagttgcaagatcttctattttatttatgtttataattaattcaacttttaaaaaaacctctcaaggccctcaaaagcctgtgagaaaagtgcattcaaaagtcagtgtcttttgcccacatgcctagaagcaatgtctaggactgtagaactgaagccttgagaaggaagacagaatgatgtttgcaattgccttagtagaaatttttaagaaggattggtcatctagggtaagagaatggaaaaaggctacaggtctgagctttagaagaggccaaaattcagaaaatgagagttggggaagaagccagtaaatatgaaaagggtggtctatgccacaggggcagaagcaagagagtaagagtaaaattgcagaagccagtacagggagatgtaccataagataattgttaagagcatcaaatattaaacatagaataatatttgaaaaaattaagcatttaggtaatgaagtataagttctctgcttttctctaaacagatttctatctttaaatgagaaaacatattgctacaagggatgatacccctgcaatccttccatatttttctatgtcccatagctgctgggataaggcttaaccatttcattgagaagacaatcttccaagactatgaggtgaaatatgccacaccagtattccaggacaactcagctccttataatgtatttaaacatatattcagccattgcagcatgcattctactgcttatctaattttatttccttaaaaaatcactatagtattactgaccttttctgatttgtggagaagaaagagaggttagagtgaaatctaaagaaattcattttgttactgtcaagcgatgaaatctgtaacagctgttcatcctcaaagatggaaccgactgatattctttatcctcatgaaagagccaataaataactttcagggagcatcaatttttatctttcatttcctttgccaactagctcctcttctagattgctagaagtaaaacaaatgtagatttcagtttccttgagaatttctgttgttcattgggctgttttgtttcattttgtgtcctagattggttcctactttggcagtattttaacaacaactgacattgacaaggattctaatactgacattcttctagtcggagcccctatgtacatgggaacagagaaggaggagcaaggaaaagtgtatgtgtatgctctcaatcaggtaatggtgtctgagtttggtagaaatccaggaaaatctcttccttctcttcattttttaataataaattccaatttttcactcactttgaaaaaacagagcaaagaagctatcaggattcattcactccaccaacccctcagttttgaaatgaccatttataattctaataaagtagctccaactcttagatattttctgcttggaaatgtgaattatgtttaacaatatataggataaaggaggtaaatataaatctcactaaactgctaaataaacccacaaggcttatttaggctgggaggcttatcagctctggcttggagatagataataacctcagcagttaaatcggatagggtggagggggagaagtcatgagtttcaaggcagcaacactgcaggcttccaggaaatacttcactgggctggagtgagattttgtcttctgttcctgactttagacatcattttttaagttaaataatttttaatttcttcattagaagagtgttttgctctttatagcaaagccagtgtttatctatttagcttttccaaatatgtacattctctcctaaattgattattttaaataataaatcatgtgtctttcttcctatcattttttggcttcctcctgtcaactttttttgtcctgggctgttttgtcctttttccaagaaagtgtattcttgattacctttgctagtactttctgtctgggttttttttttttttccttccactctaggcagctttagagaaagtttcctttctgagcagaataaattttcgctttgcacaatattgggtgaagaagggatagtggcacaaattaaggatataatattatttggcctgaaaaagatgctctgaattgtatactcaattgcattaaaaagagattccattaaagtatgtctcccacacttctaccatctgctctttggaatccctaactttactctcagataggcacactttttaagaaattttaccaactttaccactaatgtacaaatggctgttaatagcactgatttagtatactttaaaaattctactctgctgtagtaatgatggaaatacataaatatcctgtttatctttcttccagacaaggtttgaatatcaaatgagcctggaacctattaagcagacgtgctgttcatctcggcagcacaattcatgcacaacagaaaacaaaaatgagccatgcggggctcgttttggaactgcaattgctgctgtaaaagacctcaatcttgatggatttaatgacatcgtgataggagctccgctggaagatgatcacgggggagctgtgtacatttatcatggaagtggcaagactataaggaaagagtatgcacaagtaagaattgaaacctacagattcccacccttcagtgataagtcggttcaatgccaggcattacctgtctaacttcatgagttatttaatttcttcctcctgaccttattgggaaactggatttaattctctttaagtgttttttatagattagttactatatatatatacacacacaaacaaactataaatatacacatagtatgtatatagtatatatagtgtatatataatgtgtatatagtatatatatatacacactatatatactatatacacactatatactatatatggtatatatagtgtgtatatagtatgtatagtgttccttatagattaattactatatatacacactatatatacaaatagtataaatatatagtatatatagtgtatatgtagtgtgcatatggtatatatagtgtatatatacacactatatatagtatatatggtatgtatactatatatagtatatacggtatgtatactatatatagtatatatggtatgtatactgtatatagtatatacactatatatactatatatagtatgtatactatatatagtatgtatactgtatatactatatatagtatgtatactgtatatactatatatactatacatagtgtatatagtgtatatatagtatatatagtgtatatatagtgtatatatagtatatagtgtatatatagtttatatattgtatatagtgtatatatagtgtatatagagtacatattgtatatatagtgtacatatagtatatataatatatagtgtatatatagtatatgtagtgtatatatagtatatacagtgtatatatagtatatgtagtgtatatatagtatatacagtgtatatatagtatatagtgtatatatagtgtatatagtgtatatatagtatatagtgtatatatagtgtatatagtgagtatatagtatatatagtgtatatatagtatatagtgtatatacactatatagatactatatatagtatagatacactatatatagtgtatctagtatatagatacactatatatagtatatatagtagatacactatatatagtatatatatctatatattagatacatatactatatatagtgtatctactatatatactatatatatagtgtatctactatatatactatatatatagtgtatctactatatatactatatatagtgtatctactatatatactatacatatagtgtatctactatatatactatacatatagtgtatctactatatatactatacatatagtgtatctactatatatactatacatatagtgtatctactatatatactatatatatagtgtatctactatatatactatatatggtgtatctactatatatactatatatggtgtatctatatacacacactatatatagtatatagatacactatatatagcatatctaatatatagatatatatattatatatatagtgtatctactatatatactatatatactatatatagtgtatctactatatatactatatgtatagtgtgtatctactatatatactatatgtatagtgtgtatctactatatatactatatatggtgtacctatatacacacactatatatagtatatagatacactatatatagcgtatctagtatatagatacactatatatagcgtatctagtatatagatatgctatatatagcgtatctagtatatagatacgctatatatagtgtatctagtatatagatatgatatatatactgtatctagtgtatctacaatatatattatatatagtgtatctactatatactatatatattatctatatactatatatctactatatactatatatttcatatatagtgtatccagtatatgtattatatatagtgtatccagtatatgtattatatatagtgtatccagtgtatgtattatatatagtgtatccactataggtattatatatagtgtatccactataggtattatatatagtgtatccagtatatgtattatatatagtgtatccactataggtattatatatagtgtatccactataggtattatatatagtgtatccactataggtattatatatagtgtatccactataggtattatatatagtgtatccactatatattatatatagtgtatctatatactagatacactatatatagtgtatctataaactatatatagtgtgtgtatatagatacactatatatatagtgtgtgtgtgtgtgtgtgtgtgtgtgtgtatatatatatatattttttttttgagacggagtctcgctctgtcgcccaggctagactgcagtggcacgatctcagcttactgcacgctccacctcccaggttcacaccattctcctgctttagtctcccgaggaactgggactacaggctcccgccaccacgcccggctaattttttgcatttttagtagagacggggtttcaccgtgttagccaggatggttttgatctcctgacttcgtgatccgcccacctcggcctcccaaagtgttgggattacaggcgtgagccaccgtgcctggccgtaattactttatattttatacatttatctagtttcctttctgttgttattttccatatctccaggatttgactttttgaaacagttaaaaaaaagaatactttgtaacaatgctgtttaacatctgttaaatttagaatgggacatttagtgtgtcccgttctaaatagagggcactgctttctgaataaggcaaaaataattgtatgacttaaccaataaaggaaattagattcttgattttatatttaatgtccatgctgttataataaattgcattaaatttatatttatccattaagttgatatattttcgtcaagtgaattacgatttctaaaggtttataattttctcgcaagtaatccttagaaaaaataaatctgaatattaagtttaagctgcagggaacttctgttattcctgtttgtaatttgttgtcagttaacagctctaatccataagtgtattttttttccttcattagaaaaataacaagttacaaaagtgcttaatgcactacactataaaaacaaaagaatttaaaggagtttgaatgtaattgtctgctctcaagtaatcatagttggttagatattgaacaactacttacaaataaaacagaattcactaccttctagcttatataatttgaaaagaaattagaatattaattatttcattttctatttgagtgttctctttggttctgtagtcaacagagctctcaaaatctattcatgtaatgcaaacatgagtgatttttcataaaaccataatgacaatagtgaacagaataaagggcttatttcaataagagcacttgtatccatttgataaataatttgtttctgttgaaaatctttatggcattatttacttaacaagagacaggcaatattaatgactggggcatgatggaattaggaaatgcaggaagagagttctttcttatattctaatactttattccttcagcatcaatcctgtaaatttaatggggtagcatttgaagtagaaaaggaaagctaaatcattgtcagatgaaatagatttgtcataaacaacttgttttctaaatggtggtaaatcaagatgcaactttaaacaaaaacaacaaaaagaatattagagttggatttgtttaattactggcaaaatgtttttccaaggaataggtgaagatgtgcttactcatttccatgagaaccagagatgctgcttatgtatgggataatccagaatcaatcaagcccatagaaccaaggagtcagatatctcctgaattcttcacttaaaaaaatgaggaggattgctgggtgcggtggctcatgcctgtaatcccagcactttgggaggccgaggcaggcggatcatgaggccaggagttcgagaccagcctggccaatggtgaaaccccgtctctactaaaaatacaaaaaattagccgggcatggtggcgcgcacctgtaatcccagctattcgggaggcagaggcaggagaatcacttgaacctgggaagtgaaggttgcagtgagccgagatagcgtctcaaaaaaaaaaagggggggaaatactttcaaacgagcctcacctgtttaaggatgaaaaatgtttccatttggtttgccttagtaggcttcttattttatgttatttatgtggaaaacaagaggctcagaagacttgaagtttagggagggtttgtaagtcctgactgcttgccatgggcttctgttaaaagcattagcttaagcttgaaccaatgctaagtcaggaagtacagatatcaaacatactatgtatggtaatgtgcacagatcagtcttcaagacatactcatttgtgccatctcaacgttgtgaatacatctgagtggaattgagtctcttgtgccctcaacttttaggacaatttttgaaagacagtagagattacatattggaaaatgtatttgatgggatgtgttatttatacccagccacaaagttcagtgaactccaaattgacccctaggacaatattatactcccctcccccctttgctgatatgatatgttttcaagatttccagtacctttagatatgtctgtgtgatgggattggctaggaagcagaaagcacagaaccaattactcatactgtttcctttgaggattagacacaatgacactatataatttttccctctctctggtgtcagtgaccttgtaatgattttgtctgtactataaaaacagcaatatcctctgggaacatctgagtatttcctcttatctccacatgagggacctcttgggcggattcccaaattaacaaaactgattattttgttaaacaatttaaattctcagatttatttgaaactgttttgaacagactcttctcatatgaaactcttttttttggattctcacagcgtattccatcaggtggggatggtaagacactgaaattttttggccagtctatccacggagaaatggatttaaatggtgacggtctgacagatgtgactattgggggccttggtggtgctgccctcttctggtatgtattttaataacatcctgttaatctgagactgggtcacttgcagagctcccagtgtgattggagctcatgtcataccaaatatctatttccttttgtgttccactatgcaaatacaagttattcagttgagtgagctggaagagtcaatacatcttaagaacaaagaagctatatgaaagaaacaagtagaatgaactcttaatttggtgtgtctattatgtggtttacactaaaataggtattctgttttaggagaggtataggggaagagaagatcttatagaggatgtatataaacaagaaaatatccctaatatttggttgcttacaaggttttagagataatcgactttgtattcatttacctgatacatagaaacagataatcgcgtagcactctctgactctgtttatattgttggtcaagcctagaggcatcttaagtaatatcttcgctcagcctttaaaatgcctaaatccccaaattggcccagttctttcagatacatacattcataatgctttattaattatgaataaataataatttagtaggcaaaaataattattgcttactaaatatcctatctcaaaaactaaatatcctatttcaaaaactgttctgtttgaaagaaattactaggaagtcaagaatcaacttaatgagaaatccacatgataattttgaaaaatatataataaatttcattaagaaatataaaggaagggtttcataaataaaatctatttatgccaggtgactttatgggaagtccgcatgttgattctcctaaattaatgcattggtttactgtaattcgggtggaaacatacatcaatgctctttttcccaaaaatctacctagaagagtaataaagtataaaagaaaggtgaagatagagaggtgaaaatagatgactttgctataatttaagataatgcttaagaactaatggtcaaattaaaatggtacagtaaattgtgcacatacaataatcactatttaaaaaaaaaacctttacaatagaggggaaagaagactgaagggtgatacctaagaaaagggaatattaggcagcacagtggctgggactttggggaggactcaccagaagccaaggctcaaaaccagaagtcagcagtgtcagggacaatggatatacttcaattttgtttgaaatgttaatcctgaattagtttattatgctccctttagctcacaaatatttattgtattaattctcatattaaaaatatgttttcagggtttttatgctccagttttgtttcaaggctttcttgcaaagctttgcaaacttatttatggcctctcctgccccaaatcaaggcattgatggcccaaaatgatagtcatttccctatcatagtccaggctccactgacagcagaatggaccaaaccgatatactgggacacgaagactaagattcacaatgcctaacaagaagtgagagtggatacaagtgacagatgataggaaaaacgtttggaagcaaatagtgagagtcttgtcatgagacctggactgactcccaagaaagatctggctggggcagagaggatgtgtggggtggacaatggtcgaggcagcttcatgcctggagaatccatattactaagcaggaaactaggcatgttcattcattgctgatgaaagggtaaactggctaaaactcattcgaaggtctttatcaataagtgtttaaaagcattccaatgttcctactttttaccaaggatttaacttcctaaaaatgtaaagatacaatctagaagtacaattaaaggtgtcatcacagcactgtatgtaataccatcttttaataatgttaaatttaccactatactcagaaaccttttttttaaattaagctaaatatccaatgagatgggattgaatgcatagattatggtatgtgcatatgctggtatagtctgcttccattaaaaataataaatcccattaaaaataatgttctcagaaaaatgtaaatattggaaagctgttcattgtaatataatgttttaaaaatttgtaggcatacatatgaagatgtgcttttgtatatatgtatgtatgcatgtgtgtacgtgtatgcatgttttcttctgtaaagaaaaaaccactgagtgtactaaatgttaatgatgattattgctgagtggtagtataacaagttatttgtgttttctttatgcatttctatgatgtttatattttctatgagtccattgttttaacagaaaaaagaaaaccacctttttttaatgcaaaagcataagtagtgacctcattattcacaacatacacagttataaggggctagctctggccacaaggcagaaaccaggtaaaaatgtgcagtaattgttccggcttggatctaagacaatgacctcagtatccatatattctccatgtctgagatcttactctgatctcattttggattagtagacattactgggctttcgagttaaaacgactgagtttaaaatcccaggtttttcctcttaatagcttttgacctggcataaaatatttaacttttcagagccccagttatcaaacgtaaaacaaaaaaatgatgttgcttataattaaccttaagaattaaatgaaatagcatccatgtctagcacaatgcctcaaatgttattttgcttttccttcctagaaatagaggaagagctgaactcacaaggacagacaatattacagtccagacaagagatagcaggggtctacgggctgttcagggacctttagacttctttcaaatttggaacaaactcgtaaatccccaaaatacagttgattctggggtttcacctggacacttgattccatctcttttccatcacaggaaaaactagatctttggtgtttgaaccaaaagccccaaatggtttccaaatataacctacatgtcttagaacatcagatataatctcttctgtaacaatgattaattaaagaaatggagtcctgagcgctgtattatacatgaagcagaaccctcttccatgcactcactttgcactcccaagttgatgacattcattaaatgtaaaaatgtgtgagtaatcccattgtttttgtttgtaggtcccgagatgtggccgtagttaaagtgaccatgaattttgagccaaataaagtgaatattcaaaagaaaaactgccatatggagggaaaggaaacagtatgcataaatgctacagtgtgttttgatgtgaaattaaagtctaaagaagacacgatttatgaagctggtaagcaaaataattatagcaagtacttttgggtagaggacaatatatttgctctagcatgatgaagtccagtaggatattgtattttccccacatggtgagctgcacgtcatatttgccccagtgaagatgcagaaccttgaaaaaaaattctgttgcaaaaggaataggttatggaacccagtcaattctggagcagaaattacatgtttgtatgcagtgccctcaacactccatagtttctgtctggctctcctacttgctatgtacaatgagacgcttaagaaaaaaataccgattcagaggtagagtttagaaattgagctacaaatgggcccagttttccttcctgtaggtttctaccatgactcttctctcccttctcttgccccctcttgggaaagactgatattgcagagaaccctaatactttaccattcccacatttccgagatcctttgttccattgaggtgaccctagtttccgagagtcagacttgttctgtgtgtgtgttctcaggtgcatcaggtcagcctgtgcttcctcttcctccctccgttctccactttctaaggcagctttttaatgatgttgaaatatgctcgaatcaaagctataaaggccattggctaaagaagagaaatttactctgtaaccaaatacaagcagaatgagaaaagccattaatccttaaaatctgtttttcttgatttgttccatatgtgcatgtatatgctctgaaatagcctcctgactagaaagatcaatgaggtataagaacataaaataatgattttgagttttatatgtaactttatttcagtcttatttaatttttgcaaagtaattaagtgatcaaataaggaatattgtagccttcatatacagtgtaagatttcatttattttctttattgtggtatgcttattttattgaaccttaatagtggtttgaccataagctgagataatgtcattttatatataaatagattaaaatgtatatatttgtaaataaataactaaagtatatttttgtccctattgaaatataacataatcaatattctaagcagggttccaacatttctaaacttaaaaagaatgttttaagtgaaaatataataaatacagtggtggcctggcaattagatgataggcaggtgtgcatgtgtgtataagaattataaacaataaatgtaattagacactgaaagcacagtgaactcagagaccagttctatagagttcctcaaggttatcttcatgactgctaatatcattgttataacagtgtggatatgctgaacaatagaatcttttttgattgattgccaaagagatttttctataatgctaatttaataatctgtacaatatgagaatcacttcaaataaacatttccatcaattattttttaaaatttttgtagatttgcagtaccgtgtcaccctagattcactaagacaaatatcacgaagttttttctctggaactcaagagagaaaggttcaaaggaacatcacagttcgaaaatcagaatgcactaagcactccttctacatgttggcaagtaaatcatatatcgttgctgccttattccaaatcaagaatacagtagagatgtcttatttcaagtcaatcaaattcttactgttttatttcaaaatgcacttatgatgtcataaaggaaatcttgtttgttcatttttatcataaaatcgcaggtctaattttctcatttccaaatatttgtaaaactatctctagtcttccctgtctgcattatcagacatccatatattatggaacggcaggaaaagacacagtgttctagttgacaagaaaccttattcatgtcttcatttctttcactcattcatttattccttcaacttgaaaacatttaatttctgtgggccttgtctgtcagttgtggttggtaagtgattaactgctctgggggcagactgctgggctgtatgctttctgggatccatgtaactacatatctcgccgtttgattttagagcgaaggggaaaattatctggtattttctatcatctgtaggctttgtgctacttcagttttttttttttttaattttagtggatgagggagttttggaaatcaaactattaatgtttagagatggctggtaagccagtgtgaatcatttaaaatgtattttgttgggacactgtgtatatggggaatgttcccaacagagggcaggagtttcctaaacattttcttaaaatgtacatgagagtgataaaaacaagaagcagcatgaaggtaatgaggaaactgattttagtaactgacattaagacttagagacttgacggtaaacttggagctttaaaggaaccaggccaattttcctacttctgacttatttctgtattattgatatattcatagtctgtattttgaaaattgtagttcaggggcaggggagtgacagaaaatgtgcacccttttgtgccacatttgttcttcctcagtgattttcatgttgatatgcttcatgatacttatcatgaagcttattctgtcaggaccaagatcaatctattatttggtaaaataacactggagttgcccctcctatttagttaatcagaactgaacacttaggaattagaatgtggataaaatttgaatgggtatgaaaccagatatggcattgtctccaacctgctaaaaatcatctcagtctatgtttgtccacaaattcagtgtctaagttatgtccaggtactggtgtttaaaggactgaaatattttcaaaatttcgaaaattgttttggattttgaaagaagcactttgaaatttgttctggagtcagccagtgtagaatttgtatcccaaatattccacattctgagagactttggcaacgtcgtttggtctcttagagggtcaatctttcatctgtaaaataaggacaataatagttactcatcttagaggactgttgaaataatttgcaataatgtatataaagctcataattttgaatactataaatgattattgttattggtggcatgttaacagtattaatcatattcacatcctttccaaataattttacattataaaattcttggccaggcatggtggctcacgcctgtaatcccagcactttgggaggctgaggtgagtggatcacctgaggtcaggagttcgagaccagcctggccaacgtggtgaaaccccgtctctactaaaaacacaaaaattagctgggtgtggtggcacatgcctgtaatcccagctagtcgggaggctgaggcaggagaatcacttgaacctgggaagtggaggttgcagtgagccgagatcgtgccgctgtactccagcctgggtgacagagagagactctgtctcaaacaaacaaacaaacaaacaaacaaacaaaaacttatagctgtaggtatatattatattaatgaaatgtaactcattttatagaaagtttgcccttctgaagttgggaaatgttcccggaagtgttacataatgatctttggcttgaggtctcaagaaaaactatattgtgatgcaggtagctcctatgttgacacagccaagtgtgatgttgccatcactccagcagggccctctgaggaactggaagtgagtcaacaggtcatactctgaaacctccacattcccctatgccccttgtcagaatgccaatccctctccagggaagcaaaagcctgatgagatcatatgtcagattagatgcacaagaatgctgcagtaagcctgacccttgggaacagaagaaggagacataacaagatcagaacacccggtaaatatgataccagtgatatattttatgtttcaccctctaggacaagcatgactttcaggactctgtgagaataacgttggactttaatcttaccgatccagaaaatgggcctgttcttgatgattctctaccaaactcagtacatgaatatgtaagtcagatttctttaaaatacaaaataccaacttgtgaacattttaatgtcactagtaaactgtgttttttcactactctgcattgatcacaaagaacgaacaactaactggaagaaagaaaaaaaaggcaagcagattttattcctggtcaggaatggagaaagagggagctcttgctctaaagaccttctcttcaagctgtgaaaacctggggaattttaaggagttagatgtggggcagggaggtatatgtaagcatgtccagagaggaactccagatgtacaagtacagctcataaacatgcttccttatacaacatatgttcaagaaatggtggccattttcttctatggcagggactttagcattataatgacatgttaatgatctaaaggtaacaaggggttgctggttcttgtttgctccgttttctcaatggctttatcttcctctggtaattggcaaagggtcctgaagctcccaggccgtctatagttgtttttcagcaagcttacctacagataaatagactagaaaaaaaaaaactgtttaagaaaaaataatgcactttctcagctatctactgtttaacaaaataatgaactttctcagttatctactcttcaagaaaatagtaaactttctcagccatatctccaggtttgccctggtaacattaggaaaaagcttgaaacccatgcacacataaccctaaatcaatttaaaatgttttaaaaaagaattaggctcttctagactttttccaatccttctaatttcctattgttggagtttaagaaaactaataaatgacactcatttttacctcatttgaatttaggaccaatggaaagaaatctcccccattattctaataagcactggattgcagtgtatggtttaggtataaagggtgtcctcacgctgaagcatggacttagaccaccagtaaccacctaggtcatcagcagtgctgatccatctctgtccttcttcatggagcccaccttgtaaaacttgtcaaatggagtagagccaaatgtgtgcttcctgtgggtacagctgctctgagaatagaaatgagagaaagggactgagttgtgttcacttagttcctgttcccaaagttagagtccatgtgccacccctgagagtggagtgaggggagagaagagggagggtgtcactagcgtggctccaatggaagagatatgagggatggggaattctttttccccatacacctatcttccattctcccttccttcctaccagatatattgattgtcttatacataccaggcattggagcttacagtctaacactggaaacaggtattaagtagtaattagagcatatgctatggaggaggatttcagagctctctaggaacttccacctaggctgagaagtcaggacagccctcctgaagttgtgccatttcagtggagccctgaaggatagggtgatttccaccctatttaggggagtttggggagcagaggggatgctaagtgtgaaagtcctgagcatgaaggaaacaacgacattcgctagtgtggctgacgctaaagagcaagaaaggaggtgacgtgaggtgaggccggaggtaaaggcaggggccgggtcattcgggacttggtgccactgcacaaattctaaacttttgaaagagcagtgcagtgcttttgaaggtttttatttggttcagccacacgacaggatgcagcagagtgaagagtggttggagggaaacaggtggatgtgggagccccgtgggaagctattactttagttcagggaggaaatgagaatgcttgggtgtgaggtggtggtgggactgcagaagcaagaaaggattggagagatatttagaagaggagtagaatggacagggcttggtgagttacatatggtggtggtggagaggcggtcaatgaagaagaatcaagcaaaactcctagatttgtggcttgaccgttttccaccctctcaactgagctttatgatattcctaagtatttgattaattttaagagaaaaatctcatgattagagttgagtagatttagatcttgcagtacttgactttgtatttcaaaactgtccttccctggcagacaaaagccagtgcaaagcacccatgaaaattgtgcgttcttaaaaggacaagcacaatttacatttgtaagtaaatgtttactcttctcccctataaattacagggataaatataaaatcccttaagatttttgcagggaaattctccttatgagttgcttaacttactttggctgtatgccatttttgttacacaaattgatgggtaattttcaacaatgcgtagctaaattttgaaaaattctttcctgtcatcatttcagattccctttgccaaagattgtggaaataaggaaaaatgtatctcagacctcagcctgcatgtcgccaccactgaaaaggacctgctgattgtccgatcccagaatgataagttcaacgttagcctcacagtcaaaaatacaaaggacagtgcctataacaccaggacaatagtgcattattctccaaatctagttttttcaggaattgaggtaaacttccagtttttcatttatttgttctcttaacatcatttacctggcctacttttcatgctactgagataattgcttttattagattgattttgaaagaatagaaggaattttttacattagtcctcaccaatggtgaaagtattaagctttttaaaaaagttttgctttatttattcaaatatgtatgtcttttcttagattctgtgtgagaaaaggatagctcatgtataaaaactgtgtgtttcataaaatccttaaaccactgaaactgaaacagagtcaaggaaaataataacaatcaaagccaaaacagttaacagacgtacagagaggtacctctgtgttaagcaaaaaaaatttacctgcaggaaaatcaagataccatatctccctttctatgcaaaatccttactttggcaagatatttgtattaaataactgtgtcttattgatttgtaacagaggtttcttttattacattggcaataaaatatattaatctgtgtaagatgctatatcagaggtaatcagtgtttccaaatgtgaactttgctcttaattctgatctccaaatgaatcccactgagttaaaattttgtgtatatttatattaattaatattacatacaatttatattaaaagcaatgcacttattaatattatacatagtattaaaacactattgtctactttctgtaaactcagatttcatggacgtttctctctatctgttaggatatcacttagagacatgatgactaagacaaacctaaaaataatgtcatatattactatattttggattcaactaagaatattaattacaggctgggcatggtggctcatgcctgtaatcccagcactttgggagaccgaggcgggcaaatcacggggtcaggagatcgagaccatccaggctaacacggtgaaaccccctctctactaaaaatacaaaaaattagcaaggcatggtggcacacacctgtagtcccagctactcaggaggctgaggcaggagaatcacttgaacccgggaggtggaggttgcagtgagccgagattgcaccactgcactccagcctggtgacagagggagaacaagactctgtctcaaaaaattattattattattattattataaatacaaatgtacaaagtaatcttggggaaaatattaccacagaatttttctctagtaaaaattattgcctgtatcctcctatgctgacttaatggcctggcagagaggcatagctaaaaaatctgacagtgcatctcttctgtgtatattaacagtaacaacagtaataatgatggcaaccatttcttgagtcacatcatggtttaggccctgtactaaggatttcacttatttcattttcattaattcttttgtaagtaggtatgactgtactgcagagatgcgaagataaaacctttttttcatgtttcaacattcttgtaattgcattttacaattgataacatgtttatttacgtggcagtgttatttttacttcttatgggtatgtaaaaataatggcatatctcatgttcaatggcattttaaactggaaaaaatagagtatatgactaaaccacttgatagaaaatcagtcccagagaggtgaggaatcttaacaaggataaagctaacagtggtgcagtcagggtttaaattctggtggtcacgggtcagagcctatgctcttatccactgcactaaactcctccaatgactagcattcactgaagactgctctgcaccagtcttgggtgtctggattattttatccagccaccgcaatcactctgtgagggaggtgctattagtacttccattttacaactgaaaacttaggtaggattgtgagatatgctttgtctttcaggcacccacaagtgatgttttaggatttccatgagtgtagaacagctggtcccagaattctgtgcctcttccagctaaatcgagacaaaaatagtggcaaggcagtcaccaagacacatctgggaaaattctgaaagaacacgtatcaatatttcacctgcttgtccactctgattctgtttgctttctcttcctaggctatccaaaaagacagttgtgaatctaatcataatatcacatgtaaagttggatatcccttcctgagaagaggagagatggtgagcagatcatacaaaatacatgtagaaattgaatatgaaaagtaatatgtgcaaagacaaatatataaatccttccaatggtagtttaggataatacggatgaaaaatgttcagttcaaaattgtgacagattggaatatgctatggtcagaatgtttgtgccccaccaaaattcatatgttaatacttaatccccaatgtgatcgtagtaaaagatgaggcctttaggaggtcagtaggtccagagggtggagcccccatgagggattagtgtcctcatacgagaggcttgagggagactgctcaccccttctaccatgtcagaacacatagcaggtgccatctatgagaactgggtgtttccagacactgaatctgttggtgccttgatcttggacttcccaaccctcagaactgtgagcaatatatttctgttatttataaaatgcttggtataaggtattttgtacaaggtatttataaataacagaaacatatttaacaaccttgtaacaattcttacacaggcaaactcgaacaccaagacaagatttaaaatttatactacataacatatctaatttatactacataacatatctgataaaatggagctgggaaattctgttattggagtctcctaggtagtaggtgtctctggccttcaagaaaaagaatgcttcaaatagattggtttagaacttaatcagaaattctccttccatctctctctttctaaaaaaaaattgccttattgagatataattcacgtagcatggagttcactcgttgaaagtgtgtatttcagtgggttttagtatattcaccaaattataaattgtacagtcattacgacaattgattttagaacattttcacacaccacaaagaagccacgtatgcattggcagtcactctgtttttcctcaacagcctttctcccaagcccaggcaaccactaacctgctttctttttctatggaacaaattgaatttccaaatatcaattgacttttattggcaattctagaatcaggcaacaccttattctgtaaaataaaatgaatggtggatgagctgaggagaggaagttgactttatagagagaaaagggctgaagaaagcagaaacagaacgaaaagttgattggtcatttcaaagttattttccttgtaaaagtgaaagcagaggggattttcttatcatgctgtttgaaactggcttgattggggatttggtgattatctctcacttttctcatctcccaaaaagtcagacaaatgacttaatttcggctttgtggtgtggaacttaagcattatttagtctgttgggcctagagcaagagctgtccaaaccaatgacctcctatatgttttacttaacatgtttcttagtctattctggctgctataactaaatactataaactgagtagcttaaaagccagaagtttatttctcacagttctggaagctgggaagtccaaagtaaacacactggtagatctagtgtctggtgagggcccatttcatgcttcatagaagatgtcttttcaatgcatcctgagatagcagaaccaggaaggcagcattctgagttacaagggtactaatcccactcatgagggctctgcccttatgatctcatcacctgcccaaaggccccatctcctaatatcatcacattagtgtttaggtttcaacacatgaattttgaggggaaacattcacattatagcaatatgtaaaacatggtagacattcacattgaaaaagaatatgtatattatatgttattctatctattttgagatacaataaggtttcattttgtaagacaatgtttctcaaataacttcataatttgagtttaggtaatgtcatttatggaaattgaatattttagtcaaagtaaatttcttatctgttactaaagacatatttttattttataggtaactttcaaaatattgtttcagtttaacacatcctatctcatggaaaatgtgaccatttatttaagtgcaacaaggttggtttacatgtgtataaatgtatgtatatgaatgtatattgcttcttctgtgtatgtcgaatattttgctctataaactcactgacagtttcttccaggttgtaggagatcagtagaagtggaaggcaattaaccactttgcttcacaaaaacacccttaagaataattagcaaaataaagaaattttcatttaatagaaataattcacctagattaaagcaatggttctatgagctatagaagataccataatcacacatcatttatatctgccaaattgcatttaaattcataaaaaatttactgataatttaaaaactttcactggctgcccatcaaggtcaaatgaatcattagatggacttaaagttttatgatatccttttgtaatttaatatactttattcaaatcagtcagtacttctgaaaggtatcatagaacacacagactaacaacagcaaaggctcaataaggaaagtgaaatagtggtctaactttcttctaattgtaattatccactgacctgtctgcagtgagatggtgtcttttactgttttattcacagtgactagcattgtgcctgccatattataatcactacatagatgtagacgaaatgaataaattagagaaatgaattaatggattaattaattctgtatgttcaagtcaactcaacaaatatttatttgacatctattatgcacaagatattgagttagtcactgtaaggaatataaaaattactaagggcatgaaactcctcatagggtaagtattacagtagggggttgagtctagtataaaattattgtaacctgggatagaataaaaacactccattatagagatagaaagctttgtcagaaaattaatagaagctgaaataatatctacttggcaatgggaacccaagaaagctttatcaaggaacttataattgagaaagaccttgaagggtagatagcatttcacagagaggtcactgaatagcaccaggtggagcatttcaggcaaaatatatagcttgattaaaaaggttatcaattttagctgaaatataaagaatacataaagtagcaatgaaaataaacagggagtgtgcattctatcatattacgctaggtactgaatgtcagtcaaggtattatttcttaattgaacagaccttgaaaagccagtaaagtttttgagaggtaaagtcatctgtacagagctgctgcttatggagatgaatttaggaaggctgcagtgtggaatgggtgagagaaaaggggaccattcatgctaagagctgagtcacacaaatacctataatccaaggcagcatgctgctttctctgtcctgctgcttatgagccactttatacatttgggaataagcagagccattaaaaagtactcttatgcccattctgtgagacaatatgttaggtgcttggtcagttggtggaggggtatgtgtaaaataataatgaaagctaacacttactgaatatttcctatgtcctaggcacaatcttaagcactttatacttattactaatttaatcatcatttattactcatttgatatcccattttatagatgaagaaaccaaaacaaagacagataagtaatttgaccaaagtgtatcagtgtccaagaacaatctcattctctggccccagagccagtgttcattactcgttatatcatttgtatgtgttttctaatacgaggaagtatgtatatgtgtgtatgcacatatatacatgtgtttacataatatataatttaaatgataaccaaaatcaagagaataaatcagtgtttaacaaacaatatgatcatcaagtacttagtatggaaagactattaaagaagaaaacaaaagattttagatttactctcagctgtgtgaccctaatcacttatctttactaagtcctcatctgtgataaataagcatcacctgggggcagatatgtggttaaaaacagaaattcctgcaccccaagttggaacccctaaatccatatttctaagggaagcccagtaacctttgtattttaacaattaaactgagggattcttatcaatattgtcatagaattttgaaaaacataaatcagtgtgattgtcaagtctagtcgcacatcagaatcaacttgggaactttcaaccataccaatcatctctgatctccttcttcaccccaattaaaaaaatgattaaaaattatactcttacatgcttttatttagttgccaggataagcttctctttcaaacacttagaaatgtctttaaatagtcaagattttaatggtttgtctgaatgtgccgtgtattttctagtgacagcgaagaacctcctgaaaccctttctgataatgtagtaaacatttctatcccggtaaaatatgaagttggactacagttttacaggtaggagaaaactacatttttatgtggatgcctttctattaacccagtggttctgaaagtgtggtccctgcctggccaagggcatcagcatcacctggaaacttgttaggcaaattctctggccccaccagaaacctaccaaatcagaaactcggaggatggggttaaacaagccttccaggtaattctcatgcatcctaatgtttgagaaccattatactaaataacccaaagtgttaggtgttagtgataccggattgcatttgctgtccagtcttaattcccgaatgcaagttgaagacccagaagtccttcgcaaaacacgatattttcttagaggccgccagcatatttcttggtcatcgttctcatcctgtggaagctgatcagtcttctcaatctggacacacaagattaaagcatttctcattgataagagctgtttatttcttccaccattcataaaccattctttctcttaagaacttcttatctatcccaacacaaaccatgttgacaaactttccctctataatttcccctgcttaagcagaactccaagcttttgccaaataaacatgtgcaatatacttaaaaggataagaatcagtggcaagtaggtttattctaaaagtcttatcattttattaattttttaataatagtggctaacatttattgagcctttgtgttctgtcttatgtgatcctcatgataacactatggttcaaatacaactactatctccattttccagttgaagaatttgaggttcagagaggctaatttacccaaggttatatattcaggaagtgttagtttaaaccatttcacatgcttttttttttcttttaatttaaaaactgttttaaattgacacgtaataattgtacatatttataaggcgcttggagacgttgtgatgcaagtaatatatagcaactaaacagggtaattggaacatccattgtctcaaacatttatcttttttttgtattgggaacattcaatatcttctttctggcttaataatttattatctatggcactctctctttactaaatggagactacaaaaatggcatgattataggacatacatgtagattgtgctaatatttctcagcctttaaattctgtctccacttttctgtatttttctgtatccacttctattggtgcactgacttttccccaagagttttccatttacttaaaatcaaattttggcaaacacttataaatattttttgtcttcccttgactgaagtgctgcttaaaaacatactattttactctaccaagttcatccaaagaacatgatgaagctgtgtagagaagattgaacttttaagtttagcagtaaatataggactttaaattatgaaatggtaaaaatttttaatctatttagaattcagcattacattttagtttcatttttcactaggtataaatggtattagtgaatttacagaaacttttcacttgttaaccatgaaattttaacttttaaaactcatattctagcattttggggtcaaataagcatcagtgactattgaactaaattacataatccttctcactctcctcaaagatttaattttacgtttcaaggtaaatgaattcccctatgatttgaaatccctacaagtatttttgtggaattacatgatatggagaaagaaaataatgaggccaaataaaagttaaactttgttatgttttatttttcttctaattaattttttaagctctgcaagtgaataccacatttcaattgctgccaatgagacagtccctgaagttattaattctactgaggacattggaaatgaaattaatatcttctacttggtaagaaattacctctaaaatagtattctaaaggagttatttgtaaatatataaattaaagtattaacagacacataaaaatatgttgcttcaatgtttaatctctatattccagcatattttctttataatttcataaatataaatatagacatataatatataaatataattttcaatttatatttttctttataatttcactgaagatttaaatttgttgtaattatattttcacatcagtttagagatctaagcctctaatttcctcaaaataagataccactagaatgactttctagaaaaaaaaaataaactatgggactagatagatgctaccgataaacctgtagactttacttacattattttatcagtgtgactgagaaaagcactttttcattaattatgactatatcagaaatttgttatcacaattgtcttggcaattttttttacttaacaaataagtatgtatcacattctccttattgttacctttcacatgcattgtactataaattactcatgttggtactaccacctccttaaatgatgttttctattacatttatttttccttttaaatccttcataacaaactctataccactatagcaaacaatcacggaattttattttaggtaatgcctagttactgacacagactcaagttaaaatcactcaaggaaaaaagagagcacaattcaaataatggatttaaatatgtattcaaaaatatgagataatgcaacaaaattataaatgaagacagcctcaatccttttgggaattgccaaccacaaaaaaaagttctctcatagagtataaataaacgtatactcccaagattaatttcattttttaaaatttgtactctttgctagaattcctatgacaatttatgctaatttccctggaaattagcataaatgccaatcactctactggattctaggacagatttttggaattcaggctatcagatttctccagccctattcactttccctgaactagaaaattcagcaaaaaaagaaagaaaacaaaaagactttgttgcagaactttatatattgtaacttattagggtccagatttgaaataggtactctctcttataaaagtgttgatatgaattacattgctaagaatattcctgagcataaaactttgtgtgtatctctgattattttgctgaagtaaattctagaattggaataaaggagttttttaaaagaactttttttaaggtgaaacccggtaagtttactgctcggaattttccctaggaaatttttggtgatagaaacaaagatttcagggatgttcttaacaatattatttataatagtttaaaaattaaagcctgggcacaatctaaacacttaacacaatgaaattacttacattatcatatatttagtgaagagattatcatatattcaatggagagacaacgtaatattttagaaggcacattttggagtaagaaaccataatgctgctatttactagctttgtgatcttggaagttcttaattttcattccaaccttcttacctcatagataaaacaaagataatatgaggatctgcttcctgcagttgttaacagggttaaaagcaataatgcatataagaagattagcacagcatgtggcacatagtcaacaatattgatattgtggttgttatgaacagtcatattctcaataaacttatacatttaaaggaaaatgccatagcataatacattttacagacagggtacaaaactgtattttattgtgttacaaattttataaatatgcatatatgcaaataggacaggtaacctacactaaaatgttaccaaggtagttgaagtataggaaacgtttattttcagtattttccaatgtttctacaaggaacattttttaatcagaaaaaaatggtaattacagaacacaggatttcttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggaccacaggcgcccgccactacgcccggctaattttttgtattttttagtagagacggggtttcaccgttttagccgggatggtctcgatctcctgacctcgtgatccgcccgcctcggcctcccaaagtgctgggattacaggcgtgagccaccgcgcccggccagaacacaggatttctaactgaatatcaggaaacagaatttgactggaaatcaagaagataagagttagggagcatgtttaagggtccaggtgcagctggtcaggaacctccagaattccagaattaaaggatgtatttcgtctttacaaacccaggaaactgcttcagatctgaggagctctcagtctggaaggctcagttgggtagatcactggctttccttgggtctatctatgtagatcaaggcgttccctacccagctaaagaagctgcacagggatgccataggtttcaggcctgcagattatgcttcagcagtaggaaggggacaactgcatctggttgtcccagttcagttgtaccttttaagcagggaaggacctctggatagtgagttcagtttcctgttgaactttatcctgcccacctttccctctgagctacactcactactggtagcagaacatgatactaagtggaaactttgggttagtggataaaatcgaatggagactgagatgaaagtaaatctgactctcataaaaccagattatcaacagccagtgtcacggtagccctagctgggggtagaattgtgaagggaagcagatgggagtctggttttcctgtatagtggtggcagatcccatctagccaggattagagatgatttatgggtttaaggaattatggcaaactgggtaaaggcaaccaaaaatctaaattgttccgtggtctcccttctttccagtttcaaaaagactggtatgttaaaaaaaaaaaaaagaaagaaaaagaaaagaatgagcatggcaagaacataataacagacaaaaacttccaattctggtcttctgttaatcctaggtctattaagagaatgggggatggaggaacaatatgattatagctgatacatacggctactgaccattaagtgtccatattttctgctggctgaattatgccaattctctgtacagcaccataaaggatctacatttgtttggggattcaaaatattacacaatttacttcatcagctagaaaacaaagccctacataagacagaagaattctattaaaagaggaagaaagattacatttccatttttttcttgtagattagaaaaagtggatcttttccaatgccagagcttaagctgtcaatttcattccccaatatgacatcaaatggttaccctgtgctgtacccaactggattgtcatcttctgaggtaagtcatgtgtgccttggaattatgtcattactgttatcttttccactttatgtttaagccttttgttctgcatgatacttgtaataaagaattttaccaaagtaacatggagaggtatttagataattaaaagcaaataataatagatgtattattccctagagctgctgtaacaaattatcacaaattgagtgacttaaaacaacacaaatttattctttcacggttctggagtccagaagtccaaaatcaaggtgttgacagtgttaattccctctggaggctccaagagagactctttctcatgctgttttcctagcttctggtgacaactggcaaccctagtcgttccttggcttgcggcagcatagctcctatctctgcctctgtcttcacctggccttctctgtgtttctatgtgttctccttctctctttgtgtttctgcacactcaccattagatttagggtccaccctaaatccagagtgatctcatctggagatccttaatataattatgtctgcaaagaccctatttccaagtaaagtcatatttactagttctagggagatttaggcatatctttggggaccactattcaatccactagagtagattttaaataattcattgttatgaaatgtttcttacacttttccttgatttgtggtaatcaaacaactctataaagtgacttcttaattgtacctaagcatgcacagctgcaaacaaaatagtataattgtatttactcacatcccaaataatagcaatattgcaccccctttatatttttagcttgaatgagactatatgatggttcattatggtttagtgcctaaaacaaaaaatcaccataagtattgaattaatgtgtgcatgatgtcagaatttggaaatctgtcttttcatgcattttttaaagtgttcccagaaatcaagaaatagcaacaatgctaattggcttgtgatcacttaaatgttttcctaagggcaaggaaaaaataagcctttggaatttccctctaatccaaaaaagcaggtttgtgaaaatccagaagagaaaaaaaaattgtacttttcatactgcttaggaaactttaatcttattaacttttgtcaaggatattgacagtactggggaagcaaaaggtttactaggttaagtctagaaccagctatcttataaatatagcattttaacataatatattaacatctatagggctgtctgcttacgtctacctcccatgtagactgagtgtcctatccttggtgtgtagggaatcaaaagtattactggatgaatacataaatacagatgaaggtctctcgcttttcaattgtttcatgagccataatattgaacaagtatttttgttgtttttgtttccttttttttgagacggaatctctctctgtcacccaggctggagtgcagtggcgcgatcttggcttactgcaacctcctcctcccatgtccaaatgattctcctgcctcagactcccaagtagctgggactacaggcgcctgccaccacacccaactaatttttgtatttctagtagagatggggcctcaccatgttggccaggctggtctcgaactcctgacctcaggtgatccacccacctcggcctcccagagtgctagaattacaggtgtgagccactgtggctggccgttgtttttgtttttatcagtagaatttaaatgcttttctctctctgtagtatagaatttataagcttatctttgattaaggtaataatgaatgtattaatcacgtaatagtaagttctattagcattctttcttttccattacaacctcactagtttccattacaattcaaaagtagcatggtaagagtacatattatcttggggtggatatatatgtatgtatggctggtgcataacaacctttcccatacagcacacttacaaagatggatctctaatatatggcaatggctgtcattcacagattctttacactactgcagcaagtcatgtttttcctctgatatctggcattgtctgataaatgtaatattttcatttctagaatgcaaactgcagaccccatatctttgaggatcctttcagtatcaactctggaaagaaaatgactacatcaactgaccatctcaaacgaggcacaattctggtaaattaagacaagtgctatttttaccttttgctttccaaatgaataaaattgatatcaatctagaaataaccatctgaagaatttaaatatagatatttgataaaacggcaagaatactgatatgtatctctggacatttaaacaggactgcaatacatgtaaatttgctaccatcacatgtaatctcacttcttctgacatcagccaagtcaatgtttcgcttatcttgtggaaaccaacttttataaaagtaagtaaatacatagttctatgcacttattgaataatatcaataaatattcatttaccacttagaatatgcaaggcactgtgctgcttttggaaagaatgtgcgactggaagtataagaggatgtgaccaagccccagctctacttaaccagctatgtgtgtctcatcttccttgtctgttaagaactaagatattaccaaggtcccctctggagagatatacttttttcaatctctcttatcctttttctttgtactttaagagataaatacctttccagtaccaaagcttgcacttatcttaatactttggaactcagttaatgtacagagtataataaagtggcaacccttgaccccagtaacaaaggaaagagctaacatataccatagacttactgtgttttatcagactgttattatatgtataattttataatatataggtatatatgaagccttttttcttttttttttttttgagacggagtgtctctctgtcgcccaggctggagtgcagtggcacgatctcagctcactgcaagctccacctcccgggttcacgccattctcctgcctcagcctcccgagtagctgggactacaggcgcccaccaccacgcccggctaatttttttttgtattttagtagagactatgaagacatttttaaccccttataaagccaaatctgtctgacaataagctactttaaaactttttattgtattttgtattatttatttctcaggaagtatttagttgaacatatgactttgccatttttgaatttgattatagtaagttgctatttttatgtcattaactgttaatattggcaatttcattttttaaatttcaactttaattttagatacagggagtatacatgcacgagtttgttacatgggtatatttgcaggatattgaggtttagggtacagattccatcgctcaggtagtgggcataatacccaataggtagtttgtcagctcctccaagtagtccatggtgtctactgttcccatctttatatccatgagtacccaaggcttaactctcacttatacgtgagaacatgtggtatttggttttctgttcctgtggaatttgcttaggattatggcctccatctgcatgtatgttgctgcaaaggacatgattttgttcttttttatggctgtgcagtgttccatggtgtatatgtacatattttctttatccaggccactgttgatgggcacctatgttaattccatgtctttgctgttgtgaatagcactgcaatgaagatatgaccgcacgtgtctttttggtaaacagtttctttcgggtatatacacccagtaatgggattgctgggttgaatggtagttctgttttaagttgtttgagaaatctccaaactgctttccactggctgaactaatttacatccccaccaacagtgtataagcttttccttttctctgctgcctcaccattttctgttattttttgacttcttaataatagccattctgactggagtgagatggtacctacctcattttggcttttatttgcatttctgtaatgattagtgataatgagagttttttcatatgtttgttggtcacctgtatgtcatgttttaaggagtctattcatgtccttcgcccattatttaatgtggttatttgttgattgattgcttgctgagttgttcaagttccttattctggatattagacctttgtcagatgcatagtttgcaattattttctcccattctgtaggttgtctgtttactctattgataatgtcttttgttgtgcagaagctctttagtttaattagatcccacttgtcaatttttgtttttgttgcaattgcttttagagacttagccaaaaattatttgccaagaccaatgtcagagagggtatttcctaggttttcttataatatttttatagttaaaggtcttatatttaaatctttaatttgtcttggttagtttttatatatggggaaagttaggggtccagtttcattcttctgcatatggctagccagttatcccaacaccattttttgactagggattcctttccccattgcttgtttttgttggctttatcaaagatcagacggctgtaggtatgtggctttatttctgaattctctattctgtttcactggtccatgtggctcttctgtaccagtatcatactgttttgattaccgtagccttatagtagagttcgaagtcaggcagtgtgatgggtctggctttgttctttttacttaggattgctttggctacctgagctctttttttagatccacatgaattttagaatagttttttctaattctgtgaaaaatgatgttggtactttaagagcaacagtgttaaatctatacattgctttgggcagtatggccatttaatgatattaaatgaaaggttttttcttttatttgtctcatctctgatttctttcagcagtgttttttaggtctccttttagagatctcttacctccttggttagctgtattcctggatatttcagtgttttttgtagcttctgtaaatggagttttttttttttttttgagacggagtctcgctctgtcgcccaggctggagtccagtggcgcgaccttggctcactgcaagctccgcctcccgggttcacgccattctcttgactcagcctcctgagcagctgggactacaggcacccaccaccatgcccggctaatttttttttttttttttgtatttttagtagagatggggtttcactgtgttagccaggatggtctcgatctcctgacctcatgatctgcccacctcagcctcccaaagtgctgggattacaggcgtgagccaccgcacccagccctgagttgtgttgtttatttgactctcaccttgaacattattggtgtatagaaatgctactaatttttgtacccctattttatattctgaaactttactaaagtcatttatgaattctaggagttttttggcagagtcttaagggttttctaggtataggatcatattaccagtggaaaaaagatagcttgacttcttctattcctatttggatgtctttatttctttatcttgccttattgctctggctaggacttagagtactaggttgaataggagtggtaagagtgggcatccttgtcttattccagttccccaggggaatggttccagcttttgcccattcagtatgatattggctaggattagttacagatgactcttattatttggaggtatgtttctttgatgcctgtctctacctagagttcttgtgctgattctttctcatcttgggggactgatgttcttcaactgtggtgtaagttgagtgtagtcatttgggtttgtttctggatgctttcagagggccaagtctctgtacaggatctttatttgtgggtgtatgctcacaggagtgtttattagcaaagtaatttttggtgttgttgtttgagctgtgatccagtagagggcaattaagggtaatgggcagtagataggctcttagtcttgccactcttgtatttgctcatgtttgcaggggtgctctgcagtgggtagggagaggcctcctccaatcactggcactgtacccatgtttcttttgttaggtgttctgggccacaggctctctcgggcagaggccatggcaggtagataggtgacaccttttccgaaccagccctgtggagggagtcatgccctactccagtgctggcccacgctggcccacgaatccatgtttgttacccatctcagtgctctgagatgggggctcctcccctacttgagtgccagccatagatctcagcttggtactcctgagacggacatgccatctctgggtctccaggacaccccgcagctcagagtcaggctctggttgctttggaggatccaaagtcctcccaggtcacagggaaagtactcaggtggggcgcagcacccaggctgggcggcagagactgcgctgtgcacatgctcctgtggggcagttaggcagggactctgggagggtctggcaggcgggagaggctgcagaacagacatgccccagtcccatggggaatgcctgctttctcctggcttgtggtcacctggggctagagcctctctgaaggagatggggagtccgaggggatgggcacctatgtctgtgctctgctcacaaaagctcctgggctccatgctagctgaagccctgtctctacctgctccctgggaaaatccacctgccagctcacacatccattggagatgttgggtactctgtagcttagatcccagatgtctgtggcaagagtgagctgtccctcagtcccctccctcaccccttctccaggagccatttagggccaggaagtagcccaagcattcaggtaccctacgcagggttcccagcttctccctcttcagcctcagcatctgtgttgcctctccacacacttgcggtgttttctccctagagatcagatctgcccaaattatattatttacttgataatttgggatctcttagtgggagagatggctgtgtctagttagccatcttgtccccctagatcatcaatttcatttttaatcctaaataagtgcctagataaacttcatcaccagaatgtagttgtttcatgtcttgctacattaaaggtaggcagagtttgaggtttgttttttctaatgataaatcaatacaaaatatttttaaaattttttttcattccataacgaggatctaagtaaggattttcagtggcaaatgagggaggacaagtgcacggttattatttgatactaccagttccatttggaagttaacaaaactggaatttttaatctctcagaaaaatcttagcttttataaatgtcctactcaaacatgactagctctcattttgattagcatcatatattaagaacaaatcctatttgcttttcagtcatatttttccagcttaaatcttactataaggggagaacttcggagtgaaaatgcatctctggttttaagtagcagcaatcaaaaaagagaggtaagtgcaacatgagttttgaaaacattatgcatttcactctgaattttgtgacataatgttttataattgttgatagtcccttaagcagtgactggtattgctctcggtaagtgacagacactatttgcttcaaattatacttcattagcttcaaatgtgattttagtcttattcatccttgtaagacactgggaaaatcatgatatttacaattcacatgccgcatttgactttatcacttataactatcacggtaaatggatgtttttactttcactttgataacaaatgatgcagttgtaactttcctccttaaaagctgacattataaaatgcagctgatatctgaagagcagccgcaaaaaacaacttctttataaaaagtgcctttatactgtacaggaaaacatgtacattttttaaagttttctttcaaatttcattgagaaatttgaaacaaaaaagtgatggtatttcctaatacaaattcagacttgagtcctcagtaaaaatagaaaggtttgagtttttaactcttgtcctttttataaattaataagccaaggtgacggagtaagaccccatctctaaaaaaataaaataaaataagtacttgttacacatgcaggcacttcagcatgatctccccccttctcatgggagactttaaatatcccatgtggataacagcaccatgtgaatcataaaattcaatttggaagctccctaactttcagatgttctttttaaattgcttatttcaaatttttccaatatcaatgacttctgataagtatacgcttttcaagaaaaaggaaaatacatgcatataatgtttacttatgtcataaagagcgcttagcataagcaatgcaaaatgcaaagttgttccttacatagaatagccaacatttcactaaaacctaaaaaatttgagtatggtttatgttggaaaagtacatatgattcctaaatttatgtgttaaaattttataatgagttttattttccctaaatattagttaaaaattcccctggaaatatttattctacattcatcctaaaggaaaaattatatctatattgataaaattactaaaagtgatcattttgtaattgtgtgatctgaggaaagtcactgatcttatctagattccggtttccatatctgtaagttcagggaattgttttacatatgtttaaaatctgccttgctgggcttagtggctcatgtctgtcatcccagcctactcgggagactgagatggaaggatcactttagcccaggagtttgagatcagcctgggcaaaatagtgaaaccccatctgtgttttgttttgttttgttttaagaaactgtcataatggtctgatgctgtatatgtctacattcttgccagctctgtcacctacctggagtgatttgagaggttttgattagtatcatgcatatacaaatctctcccctgttagtttctttttctaccctaatcttccctctaggtaaagaaattgaggtgttactgttaaaggcaaatacagggcttgaactattactagccattgatatctaccctaaattaatttttttcaaatcccccagggatgagacacagagcagataggtttcattgaggtttgagtgccaccctgagagagcttgagtagctggaacactaaaagcggtccattttacagctttgcttcagttaaaacctgatttatacatgtggacccagtgataagtcaagtagaagaaacattgtggtataatgaagagcacactgggagtgaatacatatgcaaacattcacttacccatacacttgacatgtatgcattatactttcaatttataaacaaaaaattatgcacactagaaataaaataaggagactttctcaggttcttatgacaacaaactgcgacattccaatctaaactaatgctattgtgataatacagtagtgtactaattaatctttaacacacataatactttggttctccctgagttaaacagaaattcactcctccccttgagcattccaatccattgacatttaaccctttatgtataaatttcagaaggataatattataaataccttttggtaataataaatttgacatagttagagatttagactagatgaagagcattttctaatgtaaatctaatgttttctcattatatagtaacgagattaatgcactggtagagaattgtagcctgcaagaactcaatgttccaggagttctaataggtgtttattatgttaacaatcttgtttaataattttcagcttgctattcaaatatccaaagatgggctaccgggcagagtgccattatgggtcatcctgctgagtgcttttgccggattgttgctgttaatgctgctcattttagcactgtggaaggtaaacaccaaaattcctttgactctctacttcaatcatcaacagcaaactggagaaataagctctgatatattcagactatgtaatatagtattattacagcaatgaaacaaacgttgaaatgatgactaagggaaagaaaaaagaaaaatgcgtatttcaaacactgcacacaacttgacccaatttttgtaaaggaaaaaaaacttattttaagttagaaatagtcaaaaattcacaaaagtatctttctagagtttagtatgataggggactttcacatgtgtaacaattaaaattttataataagtatgtatttcttttataaacagagaacaatgaaaactgtcttttatagagaaagaaaaaatgaattcctatgtcaatttaaggatatataagcagtagattcaaggttaaaataagccttgttttaatcacatctccatgtgtcttaaatatcaaataattctttaatgtttaaatatatatggcacattttatgtaataaattgtgtgcctgagtggaggataagggatcagctgatgtaggggagatcttaaagtttcacagactcctatttcaaattctgtggtaaatgtgagtaaccacctattttgtgtcaagtaactctggatatttatgtaatgttttgcttaggctgaaatagacatgatttttaaaactcttagcagctgtataattttcacattaagtagaattgagatgacagcttttgggataagttgaatagagaataacatcccatacagagttgaatgttttttcaattaaatatcaaataagcatttattctagcataatatccccctagattttacctattgttttgttaaatagttaaattatgttaaaaatataggttgtggctacatattaattgttctattacctgagcaacataattatttaatcaaatagtttaaatagcaagtttctctcccactgaaataccaactgttcctatcctttcttactctcctatgactcacttcctcttttgaggggcttagtctcagaggagatggtgaacaaagccagatgtaggtcagtggcatttaattcagtaaatagaatccatggcttttctctagcaaagttccccaaacaaaattctccactatagccaatgtccagctcttccttctactttataagggatcagtgttctctctgtaatacctagctttgccacactgtggtacccaaggcctggcttattggtgtcaaggttgtacttgaaatataggaagtggtttcttcatttctatgcacctctaatagagagtgttactgttgatttttttcagcatagtcttctgttctcagcactgcacttacctctatggttttagaacaccgctggcaggagaagaggaaaaccagagctgatatttggataggttctttcaggccttgtacctctgtttcagacaaacaaataggaaatttcagtcacctatttttcagtcagtagtctgaaaaagcataaatgtaaaactaagctcattgtttcatccagataatgatgtgttgatacattctgacagcttcttaggttattattaatattattattattgcaggcccaaaagaagatcatttgacaaactttgggctgtcttacccggtagaaatagttcagccacttcattgggaggcccagcaatcagaactgtgattctaaggtagaagggaagaaactagctcttatcgaatgcttactatgtgcagggagctattttaaacatttctgctttaagcattcccacttaatactcatatcaaccttatgaggtcgtatgaacctcctcttttaagtgaagaacataaaatttaagtatatttcccaaagacacatagtgagattcagagtaaggatctgaattctgtgccaaaaccactgactattatcactctgtgttctctcttgcttccattcactctggtgtccttgcaacaatcttttcgaccaagtattttaactacattttacacctgaggacattaaagcaaagggaggtaaagtgactctcccatgattactagctagtaaatgactggattcaaggaatgatctacagagctctttctttttccaatatatcctactgctgcaggctatagggtagggctctttactctggagctccaggagttgggttttgttcaagagagtcatgaactctcttaaacacataatactgtctttggttttggaatgagggtccctggttggattcagactttcggtagttccattatatcaagaaggctaatcccacttccccctactttaaagttctgttggaagctgcctgaagcatgagttcagttgcagtaggttcagaagagctactcttatcccagacatcttttttattctaactagatctggatcagacacctcaggactatcccttcttccttcctttcctgaatcccaccagtttggagttcattggaactcccaagtctgagtctctgtgtaagagacaggccaaaagtttctcttagagcagagattcactttcaaaagacacagtctttatatctttgtcttcatcatacacatggcaaaaattaaagcttgacaaagtgttagtagctgcttaatacacttcatgattgatgggaggaatcttgtaggggacgtaggtttaaataggtggagaaacttgtcctgaactgtggtaccacatgccgggggagatgccagcacaccaggagccatgagagactcagaacattcctctctcctaacttgatgtcataatgatgcctgaagttcctcaactgatgatttatttattaatcctaaagctttattcttcatccaatatacatgttctgggtgggtgtggatggggactggtgtctcaccactttttagtcttttatacattagtatgaatttattcattcagcaattattccatgttatattcattaagcacttacttttctgacagttatcacctcattagagcctttgccatagggttttgaacaagggatcatgaagcaaacacaggaaggaaaaaatgaaagccagtgctgcaaagaaagtgttggggctgaaaacaaactctattggtttcaaatttgggctaggattggcccagtccatcttgaagctataaactattttctcctaatctccactctttgccactcaacttctcttaaaaacccatgttaattggttgggtggagtgcttagataacagaagttattttaaaatagaacatttaatgtgtagaagccaaggagcattgtaaagaagcaaaaagagctgtgagagatcagaagcaaagcagagtgggaaggagaaaaagtcttagaatccaccacctgcttttgtgaaagccttgtctgtttatttttgactcaggacatgcaggcacaagttaagaagcctaatggtttgtgaatctggaacttttatacttggctcatatgaaaaagcctgagacgtgtaggagagctggcatttggggaagaaaaacttattgttttcatgtgtatttgttccgttaccgccttttcttcatctaccaccaactagatgatggcataatagaagacatgagccctgaataaaaattttccaacctaaaagtgcatatttttgagggtttatcccctctaagccctcagttgtttaataattattttataaacacatagttccctggcataatttgccataatttcgtgattaaaatgatgtagaggtgccacacttttaaagaattaactcattgcctttgctcgatctattatagccccctctcaaatttaaaaaatatatacaaatttgaaaaatcacttacctatgacccttaattttctttttttaaaaataagcattttaggttagataattgcaaagatcccttctatcccccatacttagttttgttattctataggatgggaaacaattgcagcacttataactttttatgatgccccaaattgcaaagcataatgaaatatggctcaccatccaccacgatgtgaaatttttcttatggtcaacaacttcattttttatttccaaatgatatagtgtgttttcaagaggctttttatatcaaatctatataagcagacgtcctgatgcatttaaagttaatacagacaactcagaaatctccctaacgccctagccataatatacctgtcagattccctaccatctctaatgacctcaacttatggtcatcgatcatttgatggaaatttctctgccacatccctgaaaaaaaagatgatggcaaagaagagacaatgctagctaattgcagtttgtctcccaaaatattttcccagaagcttttaattagttcaatgtgtatactatattttactaggggtcatggtgtatttaaccaatgaaaatattaaaaatgaaaccgcggcccggcgcgatggctcacgcctgtaatcccagcactttgggaggccgaggcaggcagatcatgaggtcaagagatagagaccatcctggccaacatggtgaaaccccgtctctactgaaaatacaaaaattagctgggcatggtggtgcatgcctgtagtcccagctacccaggaggctgaggcaggagaatcacttgaacccgggtggcggaggttgcagtgagcggagatcacgccactgcactccagcctggtgacagagtgagactgtctcaaaaaaaaaaaagaaaagaaaaaaaaagaaacagcaatttaataaatgtcattttttgacattgaatattaataggtcaatgagaaaatatttcttaattatattagttgtgtgcccagcattgccaatatactattaaatttaattctatccaaaggattaatatttgctacctaaattaaaatagttaattgtgttatgttttgtgttttctcaacagattggattcttcaaaagaccactgaaaaagaaaatggagaaatgaaatattttatgaaagaaaataataacaattattcaataatctatcctcaggtttgcctcaaatatgtgacaagaaatgtataattcatgacatagtcatgtaactatgtaatccatcagggattcattacttggaaaatgacaggtcatgcattatccaaaaacaataccaaaaagacatattttataaaatgacaaaaaatattttacataattactcatttttgttgagtaagcaaaattacaaagtgtttttaaaaaaacctgtacaaatatgtttatgtattaaatcaccatccaaaatatttaaggaatatataaaaagatttttatgatcatagaaacatctattttcaaaacaatataaattaagcttttccccttgattcctgttggatatccatgttcagcatgacagtcagcactcgtaaatgccaagaaaagaattacctgaaaaagatcatttctccctattcaaatgagaatattttcccttggtagaatccatatacaatatggattgaaaattaagtcaccaagaatacatttagcatctttgtgttgggttctatacctaaaaattttccctccctgcccaaggtgattggaaagtactgcaattgagctaaaattttatctaggatggaaaatcaggatagactcgtttaaaaacaagtatattaaatgggttaaattaagcttttacagaacatgcttaattttgatattgagctctaaatgcaaaactcttttatactgaaaaaacacttaaagtagttttgtgtggcatcacagtgatttgtcatgaaaagccatatatgggggacatgctaaaatggcttctgaatgaaatacgacagcagagaaagatgccactgaaatgctgaaattatctttgctgagcagcttttgaatgctaagggttccagtatgtgacccaaagaaagagttgtctcaactccttggtacagggttcattcaaacccccaagctgtgagagtgtgtttatttttaattttttaaaaggtatttaatttccaaccacacttcttatttttttgaaaagacaattttccatttcagtattacattttaccaagaagtcactgctttttaggtgtgttgcatcaatatttaaataaaatcccagaaatgtattttaaagaatttcaggtttgaaaactcaaaccaacaggaagatatc

SEQ ID NO: 38378 - DNA, 27455 bp, Homo sapiens
acgcgtggcgcgatggcggcggccccacgcgcgggccggcggcgcgggcagccgctcctggcgctgctgcttctgctgctggcgccactgccgccgggggccccgccgggcgccgacgcctacttccccgaggagcgctggagcccggagtcgcccctgcaggcgccgcgcgtgctcatcgcgctgttggcgcgaaacgcggcccacgcgttgcccaccacgctgggcgcactcgagcggctgcggcacccgcgggagcgcacggcgctatggtgagtcgagcccgctgtccccatcaggcgggtcacgcgagcccctgcttgctgtccccataggggtgggtccacgcgagcccctgcccgctgtcctcttctgggcgggtccgcgcgtgcttcctgctcgctacccccatcgggacggttctacgcatgcccctgcccgctgcccccatcgggacgggtccacgcgtgccccctgcctgctgtcctcccatggggccagacacagccctccccacaacacaagcgggaccgagttcctcctgctggctcctttggggtgggctgggcaccgcttctgcctgctggaccctactagggcagctccggcctcactaactggggctctaactccctctggggcacgtacacctccaaaggacggagcccagagcccccactggggcgttgccagaggccacatctaacagcaagcctttctgtgccggctgctgcccttaagcttgaactcagcctggctccaggccccagtcaaacccctgccctcagaccggcgtgggtggagtccaggaccagatggcccaggaggaagtggatgctttcttggtagggaatggggcagagctctgaagaaacctttgactggtgacttctcactccctgcctcagttttctcaaatggaaaatgggtccgggtgcagtggctcacgcagtaatcctagcaatttgggaggccaaggtaagcgggtcacttgagctcaggagttcgacaccagccttgccaacatggcaaaaccccgtctctagaaaaaaaatacaaaaattagccaggtgcggtggtgtgtgcctgtagtcccagctattcaggaggctgacgcaggagaatcgcttgagcccaggagttcgaggctgcagtgacctatgattgcaccactgcactccagcctgggctacagagtaagacctgcctctaaaaaaagaaaaagaaaagaaaatgagcgtattaatataattctctttttgggtttgtctctgaagattatccagttaatggatgtggagcccttgggtctggcatgggcttggctctcagtgattttattatcatgattactgtcattgctggtgttattgtcaacttaatttattgggcagaattagcttttggcactacggtcaaactaaactcccaaatgtcgcttttccttccacctgatttctcagtctggataatccaaatacacaattggtacttaacaaatgtttgttgaatgaataattgactgcagcccactgaagtggtgtggctcacaggagaagatgaaggcagggtaagggatttatgagatatactttgagatatacttttttttttctctcagacggaatcttgctctgtcgcccaggctggagtacagtgacacgatctcagctcattgcaacctccgcctccgggttcaagtgattctcctgcctcagcctcccgagtagcttgggattacaggtgcgcaccaccatgcctggctaatttttgtatttttaatagagtcagggtttcaccattgtggccaggcttgtgttgatctcctgacctcatgatctgcctgcctcggcctccctaagtgctgggattacaggcatgagccacagcgccctgctgagatatacttttttttttgatacagggttttacatctgtcgcccaggcgggagtgcagtggtgcaatcctagctcactgcaacttccccctcctgggctcaagtgattctcctgcctcagcttcttgagtaactgggactacaggcgtatgccactgcgcccagctaatttttgtattttttctagagatggggttttgccctattggccaggctggtctcgaactcccgagctcaagtgacctgcccacctcggcctcccaacatattgggattacaggcgtgagccattgcacccagctggtttctgatatatacatttcattttttaatattttttatttatttattttttgagactgagtctcgctctcgttgctgaggctggagtgcagtggcacgatctcggctcactgcaacctcctcctcccaggttcaagcgattctcctgcctcggcctcctgagtagctgggattacaggtgcccgccaccacacccagctaattttttgtgtttttagtagagatgggatttcaccatgttggccaggctaggctcaaactcctggcctcaagtgattcacccgcctcggcctcccaaagtgctggaattacaagcgtgagccaccatgcccggcctaatttttgtatttttagtagagatggggtttcgccatgttggccaggctggtctcaaactcctgacctcaggtgatacacccgcctcggcctctcaaagtgctgggatgacaggcgtgagccaccgtgcctggcctgatctatacattacaaaaattgccgtgtgcggtggctcattcctgtcatcccagcactttgggaggctgaggcaggtggatcacctgaggtcaggagttcgagagcagcctggccaacatggcgaaaccccatctctactaaaaatgcaaaaattagctgggcatggtggtgggcacctgtaatcccagctactcgggaggctgaggcaggagaattgcttggacctggtaggcggagattgcagtgaaccaagattgtgccactgcactctagcctgggtgacagagcaagactctgtctcaaaagaaaaaaaaaattaagtgacacatatttgttagtgaatgtggtttgcaagatcttagatgctcagtaataaaacagccaatcactaatgggtctttccaaaatcagcttgtttaatccttccacttcccagtaaactgggtcctgttcccacccccatgttacagatgaggaaactgacatggaaagggagaaatgggccgggcgcggtggctcacgcttgttaagtccagcactttgggaggccaaggtgggcggatcacgaggtcaggagatcgagaccagcctggccaacatggtgaaaccccgtctctactaaaaatacaaaaaaattagccgggtgtggtggcgggcgcctgtagtcccagctacttgggaggctgagacaggagaaggcgtgaacccgggaggcggagcttgcagtgagccgagatcgcgccactgcactccagcctgggcaacagagcgagactctgtctcaaaaaaaaacaaaggaaagggagaagtgtcctgtccagggatacatagctggtgggaggccagttggggatggtggtccttgacttgcctcactgctgcctggtcctgcctcagtctccccaagtacgctgcctgtcccctctccctgcagggtggctacggaccacaacatggataacacgtcaactgtgctgcgggagtggctggtggccgtgaagagtttgtaccattccgtggagtggcggccagcagaggagcccaggtgagcatctttcccctgctcctagtctgattgggctttgcctctgctcacacaccctctatggctccccattgccccagaacaattacaggccctcagtccctgcctccagcccagccaggcagcattaagctactctgagcctccctcagctttacaaataggccataatcctcttctcagacctttgcccaagccgttccctgtacctagaattctttcactccctttttcttctggggacgcccactgctttgttccctggctcactgactcagtcttggtcccagcactggctttgctgtttatctactccctaaagccctgggcagcatggactccctgcccccacccagttcctttctgggtttttgttttttttttgagacagggtctcactccctcacccaggctggagtgcagtggagtgaacacagcttactgcagcctttaactcctgggctcaagccatcctcccgcctcagcctcctgagtagctgggactacaggcacatgtaaccatgcctagctaatgtttttgtattttttgtagagatagggtctcactgtgttgcccaggctggtctcaaagtgctggcctcaagcgatcctcccacctctgcctcccaaagtgctgggatcgcaggcgtgggccactgcactggaccccactgagcttccttccttccttccctccagtgtgcctcgggctttcttccctccaggcctttgcacaggctgtacctccggccaggaacattctccccacttctctttcctcgtcgtttactttttcccatccctcagatcagcttacacgtcccctcctccaggaagctctctctgagtaccccgaaggcagctcaggccctcgctgggctttgatagtgccttgtgatgtccacatcacagctgcctccccataggtcctacccggacgaggaaggcccgaaacactggtctgactcacgctacgagcatgtcatgaagttgcgccaggcagccctgaaatcagctcgagacatgtgggctgattacatcctggtaagtttctcagccggccggatatggatcacaggcaggtctgggtatccccagggaaggcggagcagcaggatgccaggaccatccttaatgttgttttgcagaagggtaaactgaggcttagagaggggagatgagttgcttgaggtgatatggttggtcagtggaggaggagctgggattcatttgatcctcagcactaggaatgaatgggcttttctgtccccagttgtcccctgtgtttggacacttgggtcaagtccatttttatttttttatttttttgagacagagactcactctggtgcccaggctggagtgaagtgccgcaatatcggctcactgcaacctctgcctcctgggttcaagcgattcccgtgccacagcctcctgagtagctgggaccacaggcacccaccaccacgcccggctaattttttatttttatttttgtggaagccaggcatggtggctcatgcctataatcccagcactttaggaggccaaggcgggtggatcacttgaggtcaggaggtcgagaccagcctggtcaatatggtgagactccatctctactaaaaatacaaaaattagccgggcgtggtggcaggtgcctgtaatcccggctacctgggaggctgaggcaggaggatttcttgaacctaggaggcagaggttgcagtgagccgagatcgtgccactgcactccagtcactgggcgacacagtgagactccatctcataaataaatacataaataaatatttttaaaaaataacaaataaaaaatatttttgtagagacggggtcttgctatgttgcccaggctggtctccaacccctgggctcaagtgatcttcctgcctcggcctcccaaagtgctgggattacaggcatgggccaccgtgcctggccgtgtcacgtctgtttttatcaccatcatatgtaatggccaaacctttgggtcacttccaagaagcaggaggaaggggtcaggggctggggggtggtggccacattgaattgctgaggcctgacttgcacttcctcctcctgtggggacattgtctcatggggaagggaacagttgagtctttttatttttttctcgagccaagatcacgccactgcactccaacctgggccacagtatgagactctgtctcaaaaaaaaaaaaaaaaaaaaaaaaacagacttataggttgaatattactattattttttaatttgtataaacttatggagcacaagtgtaattctgttacatgcatagattgtgaagtggtgaagtcagagattttggggcgtccatcccctaaataatatacattgaacccattacacagttttctatgatcaaccccaaatgttatttcagccttcatacttttctatattctcctgattttcttttttcttgttttttgagacagagtctctgttgcccaggttggagtgcagtggcacaatctcggctcactgcagcctcctcctcctgggttcaagcaattcttctgcctcagcctcctgggtagctgggattacaggcccccgccatcatgcctggctaatttttgtaattttagtagagacggggtttcgccatgttggccaggctggtctctaaagtcctgacctcaggtgatccagctgcctcggcctcccaaagtgctgggattataggtgtgagccaccacatccagcccatctcttaaaacaaacaaacaaaaagcagaaaagaaaaagcaaagagtcaagtgagcaaagtgattacgatgcagtggtggctagaggtccaactacacaggccagtggaggcacttggtgtctacttggaggggaatggggagccatggagggtgtgtgagcaggggaggtctgtgttctgatttgagattttcagaagcctctgtggaccaggcgcggtggctcatgcctctaaattcagtactttgagtggctgaggcaagtggattgtttgacttcaggagtttgagaccagcctggtcaacatggtgaaaccctgtttctaccaaaatataaacattagcttggcatggtgatgcgcgcctgtaaccccagctacttgggaggctgaggcaggagaatgtcttgaacccgggaggcagaggttgcagtgagctgagattgcaccactgcgctccagcctgggcgacagagtgagactatgtctcaaaaaaaaaaagccacacactagcaggaagctggagtagaggcccaagcagggtatcagcgattgatggacaggcctgcatggggtgggggccgtggagaaaggcagggggttcaggatgcgtcacgaggtgaaggagacaggttctgctttgacactggatgtgaaggtgccagggagagaggaacggggacagtgccacatctagggaggacggatggagctcctgaggggaccctttcgcttggtgccttatcagaccattttataggtgaggaaacaggctgacggaggggacatcttgcctggtggggtgtcagaactggcaaggaggcagagaggtggatctggagccttccagagccttctgacacaaagctgccttgtcctgcctctaggattttgcttttgtggtttgaggttgcctggctttagcttttttttccctcagcaaaccggggtggaactcaaagtgctggttcaaaactcaaagtggcttttgacacaaaataatattttcgtgtttctttttttttttttttttttttgagacagtgtctcactctgtcgcccaggctggagtgcagtggcgcgatcttggctcactgcagcctccacctcctggggtcaagtgactctcctgcttcggcctcccaagtagctgggactacagatgcttgccaccatgcccggctatttttttttttgtgacggagtctcactctgtcgcccaggctggagtgcagtggtgcgatctcagctcactgcaagctctgcctcccaggttcatgccattttcctgcctcagcctcctgaatagctgggactacaggcgcccgccacaacacccggctaattttttgtatttttagtagagacagggtttcaccgtgttggccagcatggtctcgatctcctgacctcgtgatccacccggcttggcctcccaaagtgctgggattacaggcgtgagccagcgcgcctggcccgactaattttttttgtatttttgtagagacagggtttcactatgctgaccaggctgatctcgaactcctgacttcaggtgatccacccacctcgtcctcccaaagtactactgggattaccggtgtgagccactgcgcctggtcacaaaattatatttttgtaactggggactttggaacccatattggaatgtgaaatagtttgtctaatgttttaaaatgattgtttgaaggtccccctttctctctctttttacaaaagctatggatgttacttgcaggtaaaaaaaataaataaaaatatacgagctgggtgtgtctcacgcctgtaatcccagtgcttcaggaggccaatgtgggaggatcatttgaggtcaggagttcaaaaccagcctgggcaacatagtgagaccccccccatctctacaaaaactaacaaaaaaaaaaaattagccaggtgtactggtttgtgtctgtagtcccagctaattgggaggctgaggtgggaggattgcttgagcccaggagtaggaggctgcaatcagccatgattgtgtcactgtactccagcttgggtgacagagcgagaccctttcttaagcttcgtatatgtgtatgtgtgtgtgtatgtgtgtgcgtgtgtgtatacatatatacatatatacgtgtatatgtatatatatctatatatgtatataaacatatatacgtgtgtgtgtgtataatatagatatacatatgaaacaagaaagaaaaacatctactttttttttttttttttttttgagatggagtctcattttgtcacccaggctagagtgcagtggcgccatctcggctcactgcaacctctgccttctgggttcaagcaattttcctgcctcagcctccggagtacctgggattacaggtgcccgccaccatgcctggctaagtttttgtatttttagtggagatggggtttcgccatgttggccaggctggtcttgaactcctgacctcaagtgatcacctgcctcagcctcccaaagtgctaggattgcaggcgtgagccaccgcccctggccagcatctaaattttaattgtatctcctggagagattcactttctcctctttcttgtttgttttaattgaagtcagttcacatatatatttatttgttttgcaaccaccacctctaattctagaacattttcattccccagaaagaaaaccctattcccatcagcagtcactccccaactccccattcctctcccctaggctctggcagccactaatctgcttcctgtctacggatttgtcaatggaatgtcacactatatggcgtttcgtgtctggtttctctcactcagcattgagttttcagggttcattacagcctggatcagtgcttccttcctttgtatggctgactcttattccgttgtctgggtggaccacgttatgttgatctcctcatccgttgatggacacacttcagtcacttccaccttttttggctgttgagactttttttttgagacagagtgttgctctgtcgcgcaggtttgcagtgcagtggcacgatctcggctcactgcaacctccatctcctgggttcaagcgattctcctgcgttagtctcccgagtagctgaaattacaggcatgtgtcaccatgcccggctaattatttttatttatttttatttttagtagagacggggtttcaccgtgttgcccaggctggtcttggactcttgacctcatgtgatctgcctgccttggcatcccaaagtgctaggattacaggtgtgagccactgcacccggcctggctgttgggattctgacatgaacatgagcgtacaaagacctgtttgaattatctgggcatggtggtgcgcgcctgtatttaatcccagctactcaggaggctgaggcaggagaatcatctgaacctaggaggtggaggttgcagtgagccgagatcacaccactgcacttcagcctgggtgactgagcaagactctgtctcaaaaacaaacaaacaaacaaagaagctgtttgagtcctttctttcaattctcttggttcatacctaggaatggaattcctggatcatgtagtaattctatgtttagctttttgaggaactgccacagtgatctggctgtttgttctgcattaatattcaaaggtcacagattcaaacatccagagggaccggatggggtgtgtaacatgaccacagggcttgtcctaagacccagccacctcccctctgcaactgaaggttgccatgtggaaatggtattctcacgttgccaggggatactggaattctagtttttgttgttgttcatggcagttaatccaaatattctaaacgatactgcctgggtaacagaaagcatctctgtggaccagcagtaaaagaaaaaaaatccagaccgggcacaatggctcacacctgtaatcccagcactttgggaggccgaggcaggcgtatcacttgaaatcaagagttcgagaccagcctggccaacctggtgaaaccccatctctaccaaaaaatacaaaaattagcctgacgtggtggcatgtgtctgtaatcccagctacttgggagactcagggagaattgcttgaacatgggaggtggaggttgcagtgagccgagatcacgccgctgcactccagcctatgcaacaggagacgccatctcaaaaaaacaaaaacaaaaacaaaaaaccttctggtagttctgtgatatatcatgacttctgtgtctttacatcctggtagagggggaacgtccggacctaatcattttctatgtgtgattttatatatatatatttaattttagtctaggtgcagtggctcagacctgtaatctcagaactattgtaggccatggggaggatcgctttgagcccaggagttcaaaaccaccctaggcaatgtagagggatcctatctctacaaacataaaaataaaaatgaaaacattatctaggcatggtgacgtgtgcctgtacgctcagctacttgagaggctgagatgagaggatcacttgagcccagaaactccaggctgcagtgggctacgattacaccattgcacttcagcctgagtgacacagcaagatgctatccctttaaaaaataaaaaatgaagaaaaagtaaaatagtaggccaggcatggtggctcatgcctgtaatcccagcactttgagaggccgaggtggacgaatcacatgaggtcaggagtttaaaaccagcctggccaacatgatggtaccctgtctctattaaaaatacaaaaagttacccgggtgtgatggtgcacggctgtagtcgcagctactcgggaggctgagacaggagaatcgcttgaacccaggaggcggaggttgcagcgagctgagaccataccactgcactccagcctgggtgacagagcgagactccgtctcaaaaaaaaaaaggttttgctaccttcttgctcattggttgttcatttatttctcagggctatctcagtgcctagaattttctttgaaggaactgaagacctttgctttatttccatgatccaggggatcctgcaggcccccaaaacggggtccctgcttcatttcatccggtgtagggggtgcttccagaggtctttgccagacccccagggcactggcctttgccccagctgttctgaatggtagcctgacctggcagcccatgctgatgctttgtggggtgttctgcagtttgtagatgcggacaacctgatcctcaaccctgacacactgagcctgctcatcgctgagaacaagacggtggtcgcccccatgctggattcccgggctgcgtactccaacttctggtgtggaatgacttcccaggtagagtgagggcctggggactgtggggactgggctgagcaggggggtgccgtggctagagtgtaacttactgtcacacaacctcgtggtgtgtgttttacaaaaatcatcatggaagctgggcacggtggctcacacctgtaaccccagcactttgggagactgcggcaggcgggttgcctgagctcaggagtttgagaccatcctgggcaacatggtgaaaccccatctctactaaaaaaaaaaaaaattacagaaattagccgggtatggtggcacatgcctgtcctcccagctgctcgggaggctgaagcatgagaatcacttgaacccaggaggcggaagttgcagtgagccgagatcacgccactgcactccagcctgggtgacggagtgagacttggtctcaaaaacaaaacaaaacaaaaactcattatggtaatctttaaacagccctctgaggccagacaggagggaagaatagagggtccttgattgtcccccaccatgctattccagaggtggaaacagaaacacagagaggaagtgacttgcctaaagtcacacagctagcaagtggtggtgtcaggatgggacttcaggcatggcttgatccaggtgtttggataactgtctttctccatcctttgggtgggttcattctcagacagcttgagagtgatcccagcagcgtctagccatcatccattctgattgggccattgctagtctcctctccacactacctctgaactcattactgaagctgggaaaatacaaggctctttcttattggccatgcctggccacaggtcccacactgggcttgagtctggggtcctgggaccacaggcgcacactgctgtgcctggctgtctgtctggtcctgtttcatgccgcccactatcacgggtctccatcctcacctttcaagacccctacgcggaactctcgctctctccccacagggctactacaagcgcacacctgcctacatccctatccgcaagcgagaccgccggggctgctttgcagttcccatggtgcactcgaccttcctgatcgacctgcggaaggcggcgtccaggaacctggccttctacccacctcaccctgactacacctggtcctttgacgacatcatcgtctttgccttctcctgcaagcaggcaggtacgtacatgaggggtctgccatcgcaggggcatctgcctggttctttgggttttgcactaagccagttcagaacacactgaagattcacagaacccaaacaatgcagcgcagggctgacttcaggtgcagctgtatctaggtgttcagataatgtctccaggaccccgtttctctccagccctggctttgctggttagcttcattccctagctctttaagatctattggttggtcaggcagagtggcttatgcctgtaatcccaacaatttggcaggctaaggcgggtggatcatttgaggtcaggagtttgagaccagcctggccaacatggtgaaaccccatctctactaaaaatacaaaaattagccggacgtggtggtgctactggggaggctgaggcgggaggatcacttgaatatgggaggcggaagttgcagtgagccgagatcatgccactgcactccagcctgggcaacaaagtaagaatccttctcaagaaaaaaatacctattgattgcatgttactattattttttaatttgtgtaaatttatggagcacaagtgtaattttgtcacgtgcatagattgtgaagtggtgagtcaagagattttagggcatccatccccaaataatatacattgaacccgttacacaattttccatgatcaaccccaaatgttatttcaatcttcatacttttctatattctcccaattttcttttgttttttttttttgaagtagagtcttgctctgtcacctaggctagagtgcagtggtgcgatctcggctcactgcaacctctgcctcctggttcaagagattctcctgcctcagcctcccaagtagctgggattacaggcatacgccaccatgtctggctcatttttatatttatagtagagacagggtttccccaggttggccaggctggtctcaaactcctgaccccaggtgatccgcccacctcggcctcccaaagtgccgggattacaggagggagccactgcacctgggccattctcctaattttctacagttgagcatatattaattgtttaattgggaaaacaaatatttaaagagacagcacagcctcatgttgacttgttgtttactggaaaccagaggttggcaaactgacctgcaggccaaacctggcccactaattactttttttttttttttttttttgagacggagtctcgctctgtcgcccaggctggagtgcagtggcccgatcttggctcactgtaagctccgcctcctgggttcacgccattctcctgcctcagctttccgcgtagctgggactacaggcaccagccaccaggcccggctaatttttgtatttttagtagagacggggtttcactgtgttagccaggatggtcttgatctcttgaccttgtgatctgcccacctcggcctcccagagtgctgggattacaggcgtgagccaccgcgcctggccccactaattacttttatatggccacaagctaacaacaacttttatattttatttttatttttttagagacacagtcttactctgtcacccagcctggagtgcagtggtgtgatcgtagctcactgcagcctcaacctcctgggctcaagcaatcctctcatctcagcctccagactggctggggctataggcacctgcctacatgcccagctaattgaaaaaaaaaatgtttttgtagagatggggtcttgctatgttgcccagactagacttgaactcctggccttaagtgatccttcccacctcagcctcccaaagcgctaggaatacaaacgtgagctacggtgcctggccaacaatttttacatttttattatttatttatttatttgacacagggtctccctccgttgcccaggctggagtacagtggcatgatctcagctcactgcaacctccacctcccaggttcaattgattctcctgccttagcctccctagtagctgggactacaggtgtgcaccaccacgcctggctaatttttgtatttttagtagagatggggttttgcctgttggccaggctggtctcgaactcctgacctcaggtgattcacccgcctcagcctcacaaaatgctgggattacgggcatgagccaccacacccggccaatttttacatttttaaatcactggggaaaagaatcaaaagaagaagaatattgtgacacatgaaaactgtatgaaattcagatttcattgcccatcaataaagtgtcatcagtacccagccaagcccattcatttaagtgtcgtctgtagctgctttcaagtgccacaggcagaacagagtcattgagatagaaaccgtctggcacacaagcctaaaatacttaccacctggccctttatagaagaaattgaccaattaaaattaaaagaggccgggtgtagtggctcatgcctgtaatcccagcactttgggagggtgaggtgggtggatcacatgaggtcaagagtttgaggccagcctggccaacatggtgaaacccgtctctgctaaaaatacaaaaattggctgggcatggtggtgggtgcctgtagtcccagctacttgggaggctgaggcacaagaattgtttgaacccaggaggcagtgaacggagatcacaccactgcaatccagcctgggcgacagagcgagactctgtctcaaaaaaaataaataaattaaattaaaagagcatcattgagttttttagtctaaaaaagatacacacttggctgggctcagtggatcacttgaggtcaggatttcgagaccagcctggccaacgtggtgaaaccccacctctactaaaaaaaaatacagaaattagctgggtgtggtggcgggtgcctgtaatcccagctacttgggaggctgaggcaggagaattgcttgaaccccagaggcggaggttgcagtgagccgaggtggcaccactgaactccagcctgggcgacagaacgagactctgtctcaaaaaaaaagatacacactcatcaaaatttaaaccatccagaaaaggatagatgtagaaggaagtaacttaactcacattttgtcaaactttcctttttgtgcctcaacatgcatttttactgttttttttttgggtttgtttttgagacagggccttgccctgttgcctaagctggagtgcagtgtgccatcatagctcatggcagcctcaagtctcctgggctcaagtgatcctcctgccacagcctcccgaggagctgggaccataggcaggtaccaccattcccagctaattttaaaattatttgtagagccgggcgtggtggctcatacctgtaatcccagcacttcaggaggccaagacaggtggatcgcgaggtcaggagatcgagaccatcctggctaacatgatgaaaccccgtctctacaaatacaaaaaattagccaggcatggtggcatgtgcctgtagtctcagctactagggaggctgaggcaggagaatcacttgaacccgggaggcggaggttgcagtgagccaaggtagtgccactgcactccagcctgggagagtgagactctgtcttaaaaaaaaaaaaaagttgtttgtagatataaggtcttgctctgttgcccaggctggtctcagacacctgacctcaagcgatcctcctgcgttggcctcctgaagccgtgggatggaaggcatgagccactgggcctcgcctgtttttacatttgtctgttgcttccctgcccactgcagaggttcagatgtatgtgtgcaacaaggaggagtacggattcttgccagtgccattgcgcgcccacagcaccctccaggatgaggccgagagcttcatgcatgtgcagctggaggtcatgggtgagtctgcctgcacaccgccctgggaggtgccaggttgcctccctttcactgatgtctcaaatccgtcccatgagcactgactgagtgccaggcagatgcaagtccctgtggggggtgctgggtgcaacggcacgtgtgaacgaggtggagggttgtgtctgctctcacagagtgctggtttgcaggtagctgtacacagcatgcttggggttgtcgggtgggcttcctggaggaggtggcattaaggggcaggttgagtaggagttcaccataaaggggattgcagcaggaggtggtagtgtgggcaaaggccgggaggctggaagggacgtgaacctggggaacaggcaaggtcagtgatcccctggggctggtatccagggccagggtggatggcctcagagaccaggctgaggaagggaccttccccctgaggacagtcaggagctatagaggacatgaaaactgagaggacagcaagttttcactaaagaactgcatgtataggccaggcatggtgactcaaacctgtaattccagcactttgggaggccaaagtaagaggattgcttgagcctaggagttcaagatcagcctgggcaacatagtgagaccccatctctatattaaaaaaaattttggccgggtgcggtggctcatgcctgtaatcctaacacttcgggaggacgagacgggcggatcacaaggtcaaaagatggagaccatactgaccaacatggtgaaaccctgtctctactaaaaatacaaaaaaaattagctgggtgtggtagcgaatgcctatagtcccagctacttgggaggctgaggcaggagaatcacttgaacctgggaggcggaggttgcagtgagccgagatcgtgccactgcacttcagcctggcaacagagtgaaactccgtctcaaaaaaaaaaatttttttttaattagtccgacatggtggcacatgcctgtattctagctactcaggaggctgaggtgggagaatcctttgagcccaggagttggaggccgcagtgagccataatcgtgccactgcactacagcctgggcaatagagtaagtctgtctcaaaaataataataataaaaaataattatcccagctctttgggaggccaaggtgggcggatccctggaacccagtagtttgagaatatcgtgggcaacatggtgaaaccttgtctttaccaaaaaaaaataacaaaaattagccaggcgtgatggcacacacctgtggtcccagctactcgggaggctgaggcgagaggatcccttgagcccaggaggtcgaagctgcagtgagccaagattgcttcactgcactccagcctgggcagcagagccagaccctgtatcaataaataaataaataaaactttaaaaaaatccatgaactatgaaaccagcagccgtccctctaaaactggaggagcacgcagggctgagctgtaattgaggttgtctagggatgatgctcccatctcagccattgctaatgtgggcctcgccctgcactgggcgcagaaagccctgccaaagccactgccattcccaccactgcgtagatggagactgggtgggaggggtgaggcctctgtcccggggctcagtttccccagccttaccgatttctgaacgagtctatctgcggctccccctggtggctcaagatggaatagcaccctgccctttgtgttttggggagactttttttttttttttgagacggtgtctcactttgtcacccaggctggaatgcagtggcgcattctgggctcacttgaaacctccgcctcctgggttcaagcgattcccctgcctcagcctcccgagtagttgggattacaggtacctgccaccacacctggcaaattttgtatttttagtagagacggggtttcaccatgttagccaggctggcctcgaactcctgtcctcaggtgatccacctgcctcggcctcccagaatgctgggattacaggcgtgtgtcactgcgcctggcctgggggagacttttgagtctttttgaggtgacacctggagactgcacaatcactggggcaggccccccacaacacccaagagtggcatacttaggtgtccaggtcccacccggctacagttgggggtggtgggtctccatttatcaccaactcccatcagaaacgggcctgagaagcgtctctgtggctaccagagttttcccagtttaagttctcacatatatttgtgttgtcatttcctttttttgagacagagtctcgctgttacccaggctggaatgcagtggcaaaatcacagctcactgcagcctcaacctccttgactcaagcgatccttccacctcagcctcctaagtagctgagaccacaggtgcatgccactaccatgctcagctaatttgttaatttaggtttttggtttttttggtttttatttttttgagatggagtcttgcactgtcgcctgggctggagtgcaatggtgcgatcttggctcactgcaacctccgcctcccaggttcaagtgattctgccccaccttcccaagtagctgagtttaacaggcgcttgccaccacgcctggctaattttttgtatttttatttttattattttttgtttgtttgttttttttgagacggagtctcgctctgtctcccaggctggagtgcagtggcccgatctcggctcactgcaagctccgcttcctgggttcacgccattctcctgcctcagcctcccgagtagctgggactacaggcgcctgctaccacatccggctaattttttgtatttttattggagatggggtttcactgtgttaacctggatggcctcgatctcctgaccttgtgagccacctgcctcggcctcccaaagtgctgggattacaggcatgagccactgcgcccagctagttttttgtatttttagtggggacagggtttcagtatgttggccaggctggtctcgaactcctgacctcatgatctgcccacctcagcctcccaaagtgctgggattacaggcatgaaccactgtgcccggccttcttttttgctttttttggagatggagtctctgtcacccaggctggagtgcagtgtcaccatcatagctcgctgcagccttgaactcctgggcaatccttctgcctcagcctcccaaggagctacagatttccccttttaaaagcacacaagccatgtggattagggcccaccctaatgacctcattttaactcgatgacctctgtacacaaccctgtgtccaaataggatcatatcctggggtactggtggttggcactggggagacacagttcaccccatgacatagtgcatgatctcatgacatctctttgtgaaacctctcagtggcttattggcccattttatagatgaggaaagctgaggcccaggccaatcaagaatatacagcatgccatcatttcttggttcattctacaagcaattactgagtgcctgctgtgtgccaagcccctgtgttgggcactaggggcccagtgtgagcagacatacctggtgtccttcccaaagggctcacaacagacaggcacagggccagggggttagggcagcaaggatgcgagctttggtggtgcaagtccaggtgctgctggggcccagaggaggtgcctggctcagcctagggaggtgggagtggggagggtgacccccatgcccagggcatcatagctgagaagtaacgttacagagcagggaaaggaagggtatttcaagcagggatccagcatgtgcaaaggccctgaggtaggaatgggggttctttgggttggcaggggcatagaggtggggctggggggtagagtgaagctggagcatggggcgtggccagggcttagaggcagggttgggggcggagtgaagctggagcccagggcgtggccacggctgagagtcggggctgggagcagggtgaagctggggcctggggtgtgaccaggacttagaagcggggctgggggtcggagcgaagctgttgcatggccagggtttaaaggtggggctgggggggtgcagggtgaagttggagcctggggcatggccagggcttagaggcaaggctgggggaggctgtggggtgaagctggggcctggggcgtggccagggctgagtggtgcggctggggggcaggttgaagctgtagcctggggtgtggccagggcttagaggcggggctaagggcagggtgaggctgggacctggggcgagtccagggttgagtagcggggccttgggcgcggtgaagctggggcctggggtgtggccagggctgagaggcaggactgggggcggggtgaagctggggcctggggtgtggccagggctttgggctgctgtgcagggttcaaatgacatgggaggggctcctagagggcagcgctgatgtgggcggagccaggtcgactttgtgggccgagccagtctgactgggagccatggagtgggtggggaaagcgtgttggagagaggctggaggctccttaccccagcgactcctcaacgtctgtgccccacagtgaagcacccgcccgcagagccctcccgcttcatctcggctcccaccaagacaccggacaagatgggcttcgacgaggtgagctgggccttccctggaggcggggcgggggctggagggcccttgtttgcaggggctgatctggctggggactctccgggctgcaggtcttcatgatcaacctgaggcggcggcaggaccggcgggagcgcatgctgcgggcgctgcaggcacaggagatcgagtgccggctggtggaggccgtggacggcaagtgagtccgaggcctgggggtgggggggcgggtccgcacgtggatgtgggtgtagacctcgctggtagacggcaagtgattcagatgggggcgggcgtggtgtccaaacagatgtagacctcgtcagtgggcgtcctgaaggggaagtgaatgggaccctggggaaggggcagatcctcacagttgtagaccatggaaggcaagtgagtcctgacccaggggaatgggtaggtttgcatgctgccagtgtagactggtggggactgtggaggggtaagtcagtcagaccccaggagaggaggagagcaggtttgcccgcgagtgtataccatgtgcaggtgagtgaggccccatgtgcccggaaggggtgccagtgctacaagaggtggaccagctgctcaacgccgcagggggtggtggaatggccggggatggcagaatggcaggcagggtgaaccttcttcgtgaccctctcctcctcctctccagagccatgaacaccagccaggtggaggcgctggggatccagatgctgcctggctaccgggacccctaccacggccggcccctcaccaagggtgagctgggctgcttcctgagccactacaacatctggaaggaggtgtgtcctgagtgatgggcggggccagagttatgactctagatctcatcggagatttggacgggaaaggggttgaaagagttccccaaagccccggctaggcatccagcctcagccatgggacccatggcctctctttagtgaatgatgcgccacaccagctgtatcacccccaggtgtacctgccatccttccattgcgcaaatgtggaaactgagcctgggggtaggggtgagcccttttgagcagcaggtggtgtctggggcctgggacctgtaaacaaatcctcattactcccagcctggtctctgtgcttgatgtttagtactagaagtcatggccacagagccactttaaaccagcacctgcccagtgctgctgggggcactcaccagcccaggcatcctcatccaccctcagagggagaggctgtgattggaggagggtgtctgactaggcttcgaacttgggccatcagggccgggcatggtggcgcacacctgtggtcccaactatttgggaggctaaagtgggagagtggcttgagcccaggagttaaggctgcagtcagccaagatcgtgccactgcactgcagactggacagcagagcaaaaccgtgtctcagaaaaaagaaaaatggctgggcgtggtggctcatgcctgtaatctcagcactttgggaggccgaggcaggcggatcaccttaggtcaggagttcaagaccagcctggccaacatggtgaaacctagactctactaaaaatacaaaaattatctgggtgtggtggtgggcacctgtaatccctctacttgggagactgaggcaggagaatcacttgaacccaggaggcagaggttgcagtgggctgaaatcatgccattgcactccagcctgggcgacaagagtgacactccatctcaaaaaaagaaaaataaaatccgggcgtagtggcacatgcctgtaatcccagctgctcaggaggctgaggcagaattacttgaacctgggaggcggaggttgcagttgagatcgttccactgcactccagcctgggcgacagggcgagactccgtctcaaaaaaaaaaaaaaagaaaaagaaaagaaaaacttgttatcgaatgtgaagccaaatgggggtgtgcggctgcaaggcgggaggtgcatgaggcgtgggcatttgaggggctgggaggcctttctcttctgagatccattatggacggcagagggcagaggtttggatgtccagatgtccctggagctaggagaggcagggagatgcactggcttctctacgggtctttcaaaccttctcaaagcaaagctctgtgctttagggtcaggcctggccttggcctccctgtgatgtggcggggcttcctccctcaggtggtggaccgggggctgcagaaatcgcttgtgtttgaggatgacctgcgttttgagatcttcttcaagagacgtctgatgaacctcatgcgggatgtggagcgggagggcctggactgggacctcatgtgagtgggggtctgaggatggggtgaagctggggcctggggcaaggccaggacttagaggtgggggtgggggcagggtggagctgggacctggggatgggtcatggcttagaggcggggcttgaaggtggggtggaactggagcctaggtacatggccagggcttagaggtggggctgggaggcggagtggagctgaatcctacgggcgtggccacagcgctgcagctgagcctagagcctgtatgtctgggtgtggtcagggtggcaggcgtggccaacccttggaagcgtagcaggagggctcacgtggttcctgggcctgaaggcactgtcagggctgtagcctatagggaagggcgttggaaggatcacccagaactcaagggacctggccggaagcctgcaggcttggtcaaggcttagagacttgactgaggcctgtggaggtggatgtggctaaaatttgaccgggcagcctgtgggcgtggctgaagagcatgggggtgtggtcagagctggaggtgtggccgaagagtgtgggggcgtggccagggcgcctggtcttagacaagcccctggatgggagtgccaccaacatgtttccagcactggagccgtccttctcttctgtaagtgggctggtttgtcctctcccttcctccatctcttttttcccttccatgtgcagtgccctaatctgcattctgggaacactgccccatgtgaatagtaactgcacccctccattcctgactgcccccccatcagggcacctcgcccacctccacccccactgtcctctgaactcagagcagcttcagcctcagagaacgtctgcgtgatcctgctctccccagctccagatcctccatggctccctcacgccctttggaaaaactcactcttctcccccatgaccgccagacccctgggctcctgcattcactccatccagtcacagagctctgcaaacatgctgagcctgctcccatcccaggacctgacggggtaactagatccctggctttctgggcaagctccctccggagggcgggaggagagtgacaggcccgatcttgcaccccagctatgtgggccggaagcggatgcaggtggagcaccccgagaaggctgtgcctcgcgtgaggaacctggtggaggccgactattcctactggaccctggcctacgtgatctccctgcaaggcgcccgcaaactgctggctgctgagccgctctccaagatgctgcctgtggacgagttcctgcccgtcatgttcgacaaacacccagtgtgagaggggcaggcggctgctgggctggggtttcacggtgggtctgtcctgggagaatggggatgtgagactcacggcctccgagaagatgtctcttcttttgcctacttctccctccgtttgccccctcgcagatctgtctccatttgtatcccctgcacacttacgttttaatctgtccccgctgacttcttcacccccaatttttcctccagctgtcccgtcccctgaagccattgctgcccctcactcccctcctcctccccccaggtccgagtacaaggcccacttctccctccgcaacctgcatgccttctctgtggagccgctgctcatctaccccacacactacacaggagacgatggctatgtgagtgacaccgagacctcagtcgtatggaacaatgagcacgtcaagaccgactgggaccgcgccaagtcccagaagatgcgggagcagcaggcactgagccgtgaggccaagaactcggacgtgctccagtccccactggacagtgctgcccgggatgaactctgaggggtagcagccagaaagccaaagcagccatcggtggcccaggctccacgtgcttactgaggacatcaggtccacctctggaccccttggcaggccacagagggctctcgtgtggggtggtgtccagccagctcttgctaagcaatcacgtgcacacaggcagcattaatggagtgcctactgcatgccagcaacagggcttggccctggggaattgggaggaaccaagccctcttcatctgttcatgtgcccagcatttattaagcacctgctgtatgcaaggttcccatgttacggcagtgaatgaggcataattgttccctccatcagcgattgattcagtcatcaagcagttactgatcagattaagaatcaggcactagtgatacacattcatttttaaaattcattcaaggatttattgagtgcctactgtgtgttgggtgccattccaggctctgggatttttttttttttttttttaagagtagagtctgtctctgtcacccaggctggagtgcagtggtgtgacggctcactgcagcctgcgcctcccagcgtccagcaattcttgtttctcggcctcccaagtagctgggactataggtgcgtgccatcacatctggctagtttttgtatttttagtagagacggggtttcaccatgttggccaggctggtctcgaactcctgacctcaagtgatctgcccgccttggccacccaaagtgctagggttacaggcatgagccactgtgcccagcccaggctctgggaatattgagataaataagatgcttctatccatttattcaagcacatattggtcacctactgtgtgcctggcactcatgtcacaaagataagttcctgattcggtacacttactgagcacctgctgtgtgcagggagctgagctatgggatgggaatgggagtaaacaaggtactttttacttttttctttttttcctcactgctagacggtgtgggaacttctcactcattggcttctttcccacacacctgaagagcactgactgtgtgccgggcactagtgatacaaaagagtgtgacagttgttcagtctgcattttcgatcatgggctacatgccgagtgctggggcacagagatgaacaagatcggttccttcacttcttcatgccacaagtgtttattgagcacctgtgtgccaggcctcacagactcccagttgggttgaagaatggttgactgagtttgattcttcctgtaccctcggtcgtctgagctgtgtgcagacaacatccccccaccacccaagagggagggtagctcttccgccaccaggggcaagcacaggtcctggtggccccacgccacatgttagcccccctggagggggcgccagttggagacgggggctgggtgtccctggcccactcccggtcccctgtgctttacctccttgcccttgtgtctcaggtgtggtccctgcctgcttgatgaagttgctctgttcaagcctttggtgggatcatgtgtttgggggcttttaggggacccagctgcactggggcactgcccgtggcctgggtaggacatttcccagcaagggctggaggagttgccgtgccttcagcctgaatcgaatgtcagaaccagccagcggtgcttcaccctcttggggataacttgcttagttttttaataaatgttcctggttggttttc

SEQ ID NO: 38379 - DNA, 15482 bp, Homo sapiens
ttgctcagcgcgagacggctgggcgccgagtgggacagcgctggtgcggagactgcttccggactccaggtaccgcgcttggcggcagctggccccagacttctgtcttttcagctgcagtgaaggctcggggctgcaggtgagctgtgcatcccgcaatggagaccttcctgctctgaattttcttacaaaactgcagaaatataaggggcgttgcttagcgggcatcccctcccccgcgccaaacctgtacagcaaacgatgatgcagaggaccttgaggggattttgcagggcatcggtcttacctccgcggtatcatttttctcctcctcccgagtttctgccttctggtatccctaaatatcccacctatcctgcctcctaccttcctggatctggggtggtggggtgggctcatggaccattgcaaaatgcttggcaggattttaaccttctcagcaccacccagaccccactcgaaaatgtgccttttgtgccctccaagagctcaagggtaggtaattgttatatctttagcatgtgaaaatgctttttatgtaacagttcaccgaaaatctcttaattctccgaattttggaggatttggggcgggcagcgaggctgtcccctgtcaccttgttttgtacctggtatggtaaatcgttttgctgcattgcatccaagatgcgttttagtccttccaaggcttgagcatcacatttgtgatgagagcgtgtgatgtgctgtgcacatcctctcccaccttatcccttccatgttaacacagcctctggctttaatgtgtgcttctggcctggccacatggctccgtcatggaataggtgattcttttgtctgaatattctctgtgagaacagaatcttcttgcaagcattgggagtagatttattttgcctctttagaacaacagtcagttcgctaaggagattaaggggctacctgtttcctggcaataaagctgtattgggtaggtcagttacagaatgtcttcaggcagaagctgttcctttggttcactcactcatttattcatttaacaagtattttaagtacctgccttgtgcatggcagggttcttggtgctgtgaggaggacaaagataaactgaaccttggtttgccctcaaggagcttggctggctgagagttgagagaatcccaaccaagtaaaagggtatgggtcctcaagagaagatcgcaggaagagctggggggctcaggatggagtggaattaatctttcacaacagctacttagctttaggagaaaattaggtctagaagttacacctgataatgaaagaactctcataagcttcagatctgtatgtaagggtgttttccggactgtgtgttgggcgtctcagactgaatacattctaaacaggtcccatcattcctagccacctccctcttcccaccgccacacacctgctgctgttcccatgttctctgtctcagggaatagcatgaggctccccgactccctacttctcctaatggtctaagccagatacctaggggtgagtcatctctgattcacccctgactttcccttcccgcctcaaattcaattctgattctacctcctgaacttctgaaatctgtccaccttctctccattctcattgccatttctctagataagcctaccgttatcaactaagctcttgcttactttactgcaacagcttcccgatttatctccctgcctcacttcacaacccatcttcactactgcaactgggaagtgcttgctggaatttaaatctgattgtgaggctcccttcagtgatccttcattgcccttaggacggaaccagactccctttacggggcttatgtgggtgtacagccctgtctttctcaccagcaccctctcttttcacaagccccttgcacttttcattttgagaacatgctttcttgtgccattagggccttgcacatgcgctcccttctgccaggaacacccttccctgcaccctcttcacttgacttattcatgctcccctgtagggtaaatgcacctgacagcaataattaaagcatacccttagaatgaccctgtgtggcagatgaacctgaatgtgttttctgaactagggaacccaggcctgcccaacccagagatttatttcttgtctatgaagaacatctgagcccctgccccacctgtcccatagaacaggggccatacggggaattgaggccttgaattttgagttaaatcaagttgccaggtagaggtcattgaggggagggtgttaagtgaaaatgctgcataaattgcatgatgtttgcaagcggttgttttcctgcccagctcaccaccactggactccctcctctgtttgtaagcccctaatgggtctcttttggcctcttgaacctgttgccttccttattgaggttaataggggtttggcacaacatctctccaaggtcccagctgggaccctgtttgatctgggcatccttaggctcccagtccttgctgggtgccactccttgttatggtacccacacctctcctcttagggctcattcacacatctgcctcctacagctgtgttgtactatagttcctggaggaccaaggccatgtcttagcacttaccattgcttcctgctgccttgcctaaagaaaatgctaaataaatagctgttaagtcgaattgactacaaatatatgttataatactatggtatgattcattaactaaattacaaattcaccctacctcagttttctcagtgtgctgaaatagtaatagccttacacatgtcaagcttaaaataggtgtaagggtgaatgagaagagtaatcattggagcagctaatatttgttgagtgctcagtatgtgcaggcactgttctaagtgctttacagtattaaatcatttaattctcagaacaatcctataaggtagatatttttgttatccctattttaaagatggagaaactgagttattgaggttccacagctagtaagtggtggtatcaggtttgaagataagcatactttatagcatatggttagctcctttagaaagataataagtaggatcaaacatgagaagttcatggggctgaacattgtaagttaccagatggaacacagtgccctgtggtcacaactttaagctatgaagagcatgtgattgatccagaattgaaaactctgaagaacatgtttggtttacatgttcgctttttttcagcagctaactcagttatcagaggtgatgttgcatagaggttaggactgagacttccctaagtcagagatctttgttttgctgtataaccttcaggcattgcttgcattctctgtgtgccactttcctcatctggaaaatgaggataatcatgacagtacataccatagggtgtggtcatgattacatgagttgatacacataaggcacctagaatgccttagaatggcacctagcacatagtaattgctcaaaaacattataacctctttattattattatttgtttagccatcattcagtcagcaaatggtttttggacccaggttctccctacatgctacatcctactgtaccacttctcggccacagatgagctctcctgttttaattctccttcctgcagatgatgagcatttttcagtgttgcctcctttttggtgctgtcatctcctgtgcctcagcttccctcccccatacccttcctcatagtaagttctagtggatgactctgagatcagctcaaaattcttcttctttttttttttttttttttttgagacgcccaggctggagtgcagtggcacgatcacagttgattgcaacctctgcctcgcaggttcaagggattttccggtctcagcctcctgagtagctgggattacagacatgcaccaccatgccacgtccgggtaatttgttgtatatttagtagagaaggggtttcaccatgttgactgggctggtctcaaactcctgacctgaagtgatccaccagcctctgccttccaaagtgctgggattacaggcgtgagctacctcgcctggcccctttttatgttctacattaatttattaccaattgataatgggagataaaaggcccattaacctaaatgataagcaatgagaaaattgtaaaaatatgcaaggaatctcacttaccattcctcacatttacaaagataattaccttccctgtggaagaaatatagacgtgagaaagctcagaaataaaggcaccactaggggtcttagaacttaaaaagctgtaaagaactccagaactcttttcatctattctcctaacttgcagggagagttgagggtgagggaggggcatggtctgaggcccagtggccacatctctagcctgtggctggcacgctatctactgcatctgagagaattgtgggcagggtttcagtggaacttctcaccactgggtatgtttcagctgctgctatgatgcacagtaggatgtcattgtcatccatttaacttcatgctggggctatattgtattctttagtgatttgccattgattaagtgtggatgtctctgctaccacagaagagctatcttgcaaggaaactaatgacaaagccattgtttaaactgaattagtcaatctccaagaagacatccatctgtaaagaatgagaggactaatatctgtacagacatgaaagaattataagatggaattgtggaagttaaggaatttagaggaggaagaaggcatttgctccagatcactttgatagtacagactagagtcaaggaaattaggaggtaattaataagggtagaagtcaggggagaaggtttaaagggaggtggcatacaggggatagtcgggcttttggaggtggacagggagggaggacatttcaggcatggaagtgaaaagtgaagattgtagtgtcacagttcagtgaagagacctggctgaccagagcagaagttttatttgggtaagtggaaagaattgaacagctgagagtatggcagatcttgaagacaggcagaggagaatcagcttgaggtaccccccagagtgtgcttaacagtgatgaggatgaaggggaaagtagagggttgggagaggtgaagtttgaacctcttttttcccttgagacagggtgtcactctgtcatccaggctggagtgcagtggcacaatcacggctcattgcaacctcaacctccagggctcaagcaatcctcccaactcagcatcctgagtagctgggatcacacgtgcatgccatcacacccagctaattttttgtatttttactagagatggggttttgccatgttgatcaggttggtctcaaattcctgggtttaagccatctacctgccttggtcttcccaagtactaggattacaggcgtgagcaccatgcctggccgaacttccctttctttagtagactagagaaattaatttctgtaattctgtggaatgtctttgtattagtcattctcacactgctctaaataactacctgagactcggtaatttatgaagaaaagaggtttaatcaactcaacttccgcaggctgtacaggaggcgtggctggagaagcctcaggaaacttataatcatggtggaaggcaaaggggaagcaagcatgtcttcacatggcgacaggagggggagagcacgtgaagggggaagtgctacacgctttcaaacatccagatcttgtgagaactttagatcatggaacagcactagggggatgttgctaaaccattagcagccacccccgtgatccagtcacctcccaccaggccccacctccaacactcaggatcacaattcaacatgaaatttgggtggggacacacagccaaaccatataagcgtatcatttttagatacattccctccccaaaacttttttattttgtataatttgtcctttcccccttgctttagaattgcaaccttgccaatggacctgatcggttttggttatgcagccctcgtgacatttggaagcatttttggatataagcggagaggtaagcctaacccaaattttcatgaaagggaattagtgggggtttggaggttgtgctaggtcatgtgaggctctgtaagtaggatgagaagctaaagatgccttagaggtggctgaagaccagcgtgtcttggaagggactcatgaaaggaagaggcttccgtggggctgagcatgacagagtgttccaacctgggggttctgggcctctcttccaccacaaaactctcacttcacttcatcatcagttgcatagttaattgatttaatctccctcaggaccactgcttattattaaatgaggattttttttttttgctttacataatcgtggtaccaaaaaactgagttatattgatcctgtgtgttgtaatgaaaacattgttaaatattcagttatcatatccaaagttgtctcttcacctttgtccaaaagaggggggaaaaaaactcaggtaatcaattaaagagttttcatggagaaaaaggaaaggtcaaatttttttattttacttttattttagaatcatttatagttatgatgtctcctagttatgtttcatatatatacacaacctttagtcatctttctgacaaactgtctcttacgttttaatgacattttttaaatgaagttttttatttcaaagggtattgtatttgtggcagtggttgacttgaatttgagtgaaaaagccaggtctacatggttaccagttagcttccttccttaaaggctgctaagaagtcaaagaccagaagcaccgtatagctcttgtagctggggggctggcaggtagaattgaccatcatctacgattccttaaagcctgtaattcaccttggatttttgttcgttgtttctgtcttaatgtatgtattagagatgtgtatttgaaggaaaaaaaaagatgatggcaccaaagtaagacctgtaaaccaagtactcagaggttgatgtttcacaatctactttagaaagaactcagtttaaaatgctaagattgtttttgaaaaaaaattttcactgtcaaagacaatgtctaaataacttctattacagaacagaaaagaacatctgggcatttttgcctgcctttatgagaggtggaaagaaagtggggagagagatatagagagtgtgtgtatgtgtgtgtttgtgtgtgtgtgtgtgtgtgtgtgtgtgtgtgtgtgtgtgtggaaggaatcattttattctaactcacatctcttcattgtttaccagctggtgggaacaaatgaaattacattagctgtgaggtctctgatttcaagggcttgttgtccacctgcacaatatggtttcttggcctcctgcaagagccccctactaagtgatcctggaagcccccaagggtattatgggttcacaaggaagctcactttgtagtataatgtgggttaaaagcatgggccacagaatcaagcattcctgcattccagtcttgacgctgccacttaccagcactgatactcaggtgagatgtttcaacatctgggcctcagttcctcacctgtaaattaatctgttaggattaaataagatgatgcatggtacacatttcacatggtgcctggcatagaataaagttttaatcttcttgtttttttctgctgctactgccctgccagtgggaggtctgtgagccatgaggcataatacctttttctagttttgtactctagttttgtattatgttctaagctgccagtggctcgaatgtcttagaatgtgtgtgtaaagtgagttaactctcctttgacttagagcttccctaggtatgagtcctatgtagctgggccaggagacccttctacgggacagttattgagaataatcttgggtcggtgaaagatgtgatgtcgaaatggtgtttagtgggaggacacagatgtatccaaatcctaaactagaccagctgtgagacacaagttgggttaaacggagaagctgatagatttttattttgatgggggtacagtggggagagagggcagccagtggcgggacacaggatgctgagcactgtgcttgcctgggctcacccctcctcccaggtaggtctccagagaggtggatgaccaagaagatgctatgatatggaggctcttcctaggccaggtaacatcgagtgcccagagtgaaagagggccagatggcattccctgccttgtcccacactagggctgaaccagaccttacaccttcctactccagttgaagggaagggcactgacacagcaatcccttcagagaggtgcaggtgtgcttgctgggcaggctgctatttggacgaccataagagcacctgcagggaagctcccagatgcatctttcaactctttttaaaactcctcttccaagactgccccacccagatcaggcatcccaggaagtgggaaggaaaagagcttagagctccttttcttgtagcccccactatgggtcactgagcttgttctcaggatctttgctttcttccaccagcgtggttttcttgtaaaacagcccacagtcctgccaccttcctcaggcaagatgaaatgtctcaagaaccttcctggttcttgctgctggtgagcctgcccctgctgtttgctgtctgatctcatcaagactgaagtgtagacactgccactttctccacatacttaagtgtgcgtgtttggtggtggtggggagggtggggtggggtgatcctaacagtaaataaaccttcagggtatacagaaaggagcatcatagaatctctaggtgagaagacaccttaatggtcacctagttgtgcatttcagaaagtgttttaatctccttaatatccttatctggtatcttctgcttgaacatgacccataataggggtgcattaaatcagtatttatcaagtgctcctatgtacctggccctgtgtctcgccctggggaaacagcaatcgctcacaagtgagtaagggcagactgacattcaatccatgaacagcatataaacatatgatcaggaatagcggaagactatgatgggggcccttgttcagaatggtgggttggagaagacaacacttaagcagacatccgaaggtgagctacacttggccaagtgaacagtgcagagacaagcagtctgcacaaggaacagtatgtctgaaagccatgacgaatagagtttggtatattcagagaactgaaagaaggccagggttcccacaatatagcaaactggattatttttcctaagagctttgggaagcactaaggtttttaattaggagagtgacctgtccagatgtatgtttttaaaagatcatcttactgtgtttgaagaatagcttttgggggaaacaatgtgtaatttaacattatctccaactgtaacattctaagccactatatatttatatatttatatatatatatatatatgtatatatatgtgtatatatatatgtgtgtatatatatgtgtgtgtatatatatgtgtatatatatatatacatatatgtatatatatatatacacatatatatatggcatggatgattaaccccgttttacaactgctaaaacttagagaggctaagtgacttagccagagtcctttagccagcaagtgaaagaattaggagtagaacctagcgtgtttgtcttctcattcagaatgctgctctggtgtgtgtgtgtgtgttgtgtgtgtgtgtttgtgtgttgtatgtgttgtgtttgtgtgtttgtgtgtgtgtgtgtattgtgtgtgtatgcatgcatgtgctgcagtggttcttaaccctggctgcacatttgaatttccaatggatattttaaaaatgagatgctttgaccctaccccccagggattttaacctaacagattctaaatagggtgagttccatgaagcaaggattgtgtgtgtcttattcatagtgtcactgccatgtaacccactgtccagtgcacagaaagtgcttggtgtttgccacagtgctctggggtgggtatgtgggttgggggctgggagtgtactggtggggtgagtgcatgggatagggactgggtagctggggtcagtattctgattcttcgtctttcttggtagggcctctattagtccttgagtcctgacatcttgaggcatgaaggtttgttaattattcaggatggaaccattgcttggtttgtatagcacttctgtctttacctctataaactaaaactacctttgcatcttagtttttatcatcacaacctcattgcaaaaaggaggcaaagagaataggaaaaattaaaaaagaagggcttaaggaagttaaataattgtccaagatcatgtaatcagtgtccaagccaccagaacaaggcaggttttcttatttccccaagtgacatctaaccccactgcactgctgtgccctcagggctcctctgccttgcatttgggttcagcaggaaacagtcatctcctagaaagtatccatgaagaggcctattcttaatttggctttgtccagttactgtgcccaagtaggaatacatttgaaggtgcctgtatcatactagaagtaatggaatgaattcctttccttttgggattctctttgtgatctcatatttttttccccttccaggtggtgttccgtctttgattgctggtctttttgttggatgtttggccggctatggagcttaccgtgtctccaatgacaaacgagatgtaaaagtgtcactgtgtaagtaaggcatttttcctggttacagagactcaaacattggaggtgatctttttgataccctatgctagatatactagaacatatttagtcaaatggcaaatggccatatgcatgtgttgaggctgaatacaacacttattcctttctagaaagacctgataaaaaatgatggtactgctaccaggccttccaactcagaagaatatttctataaaaactcgttactagaaaaattgaattaggaaaagcaaggaattattttcagattttctgctaactctcctaaatgcatatttagcatagtttttacattgctgtggaaataactaaaaaagagacagccttgcattatttcatttaattcacaaacatcttttagattctgcactgccttaagacttaacctaaaaaagcaaggctgacgcttttttagctacttcccttgttaagtttaatgggagaatatccacagaaaaaatggaaacctgtgtgtttaaagtcaccaggacacttgactttcatctcacttgaaagagatacacagtgaagatttagaaaaccataccaaggacattttctctagttgatttattattcaaagtgccttggtcgtgtatggaaaaaaatataaatgaagacaaaattgttctatatttgaaggagagtgagagatttggggtttttttttttttttagttatttttataaggggctagggatatttttagtaatgaggttgtgttagatgtatcagccagatgtagtgatattaggatttttattgatatgcatttaaatagttcacaagtatttattgtcagtcattttattttttatatcaataaacagtttttctttgaaagctgtttttaaattgtggcattgatgtcctaatctcttacataaaactacctctcccttcatagatacagctccaaaaaggctgacatgatgcttctgaataaaatactattgcttagactattatttagtctccaggcatcaaattctccaaaatgggatgctacaaaacaaaaccaatcagccttctttttagtattttttttttattaatcagatcttacttgtaaaagatacattaactattttctttatattcagttaactgaacattaatgagtgtctcctgtgggtccaagtgtgctacttagtgtttctgagggaagttgaataaagctcagtgctagccttcaaggcgtgttctttgaatagaaatttaggttagaaaaagactttcttagctaggcatggtggctcatgcctgtaatctcagcacttttggaggctgaggccggtggatcacttgaggccaggagttcaagaccagcctggccaacatagcaagaccctgtctctactaaaagtacaaaaattagctggatgtggttgtacatggctgtaatctcagctactcgggaggctgaggcaggagaattgcttgaacccgggaggtggaggttgcagtgagctgagatcacgccactgtactccagcctgggtgacagagcaagactctgtctcaacaacaacaacaacaacaacaacaaaaaaaaaaaaaagaaaaagaaaaggtctttctcttttgaagatatttcaggaatggattttaacatgtttgtttacccagaaaccttttcggcgaggtagatgatgatgaagtgtttctttgtttgttcttttgttgtttttttgagacagagttcgctcttgttgctcagtctggagtgcagtggcgtgatctcagttcaccacaacctctgcctccccggttcaagcaattctcctgcctcagcctcccgagtagctgggattacaggcatgtgccaccatgccctgctaattttttttgtatttttagtagagacgaggtttctccatgttggtcagactggcctcaaactcccaacatcaggtgatccacccatctctgcctcccaaagtgctgggattataggcgtaagccactggcccggccatgaagtgttttaatagagcactttatcttttcaagacaatggcaactcagtacctatccataatagttgtaatgttagaaagctttaaatggtacccgctgttttcccacaagcattgataacatgtttgaaactctggttcatgaattagtttggttttcagttacagctttcttcctggctaccataatgggtgtgagatttaagaggtccaagaaaataatgcctgctggtttggttgcaggtttaaggtaagtaaaactattttgatcaatactttcctctgctgttgttttgaagtgctgaatttttgggaaacatcaattttaatttgaaagatcaaagtcctttttgttataataagcatgacagtaaaaaccttaagatagcatggattcagtgggtctttgatattgatgtacccatgaacattcttattggatacgcatagtgttgctgtagtatctggtcacataggcatacttgcctttttcagaagaaagagctaactaaactcagcctcatttttcctcaagattcacccatctgcaacactaaatgtgttcatttaaatctaatactcagtcccttttagagagtttgacagagtgacagtgtgatacagttatttcaagtttttaagggacagaaatttaatatttttaagagtttttaagagagaagttttaatattttttaaaagataaacagagggcctcaagtttctcttaatttgatccagtaattctatccatgagattaagcatattaccaaataaaaatttagagataacattttaaaaatttctccagaaagctggctttatatgttgaaagccataaacatgtttatttcctttgatagacattttcactttttggaatttattccaaagcagtgagatatgcacaaagactgatgttcattgcaactttatttctagtgaaaacacaatagactgaaaaattaggaacaacctaacagttcaccagtaaggagatgtttgaaaaaatgttttgtccatttaatggaatattgaatgagcattacatttttatgttttcaaaaatgatttggtggcattggaaaatcttagtgacataataaggtataaaaacaggatgaaaacaaccacatatagtgtgattaaaaaaagtttgtgtataaaaaaacaggaaggaaatatttcaagctgttagtgtttttctgtgggtgatagtgtgatgaataattgtaatgttcctctttctacttttgtgtagaattttctagtgtgactatgtattatgtttcagggaggggaggaggagtgtgattacaaaagacagctttccagttatagccctgttctaaaagtgatacttggtggtgggaagaatcagaagtagggtttatgggctgggtgcggtggctcatgcctgtaatcccagcactttggaaggctttggcgggtggatcacttgaggtcaggagttcaagaccagcctagccaacatggcaaaaccccatctctacaaaaattagccaagtgtggtggcgggcacctgtaatcccagctacttgggaggctgaggcaggagaattgcttgagctcaggaggtggaggttgcagtgagccgagactgcgtcactatactccagcctgggtgacagagtgagactccatcagaaaaaagaaaaaaaaaaggaagaaaaaatgaagtagggtttatggatccggaagaaggcctcagttaatagaaagtagctgagattgaattagtaactgccccaagttggtcctcgattattttttcaagttgctttattttactagcttctgaaagtttgtttcttcccaaacctttctcttataaaccctcatccaaggttttcagaacaacaggttctgatttttccttattcatttagcgaacattttaaagtggctaattcagttatgtctgggatgttttaatcctccaaggggttgagctgggagagcccccaagccaaggattagtaacactactgggtaggcgagtgcatggccctttctgtcttatgccagataaaagtgactctccctttgtctttgttttattttaaatccagcctcatgatgatcctgagacttgtcttgttgctgctctgagcatctggaggaacagaaaactaagttcatgtcatcctgctgtaatgggcagagcatattttttttgtatttaaaagataaacttcaatatggaatgctagaaacacaaatagcactgtcacctctaatatgaacattagtttgaggtagtttttttctaaagcaaaaattttaactgttttctaattgtcaagcactattttcattaaaagtgtctaatgaatcatgatatactcttccatttgttgtgtctattttttatatatttggtattttttgaaaattccaaatactcatgtctcaagtaagcttaaactacaacttgtcacataaaggaagtcttaagtggagttcacagaatgataatgtatctatttgtcatttgtgttatatttgaaattattagaaattatgctttttccattttaattgtattgctgccagtgctatttttttctttaaaaaattttattcttagcacactgttatgtcctaactgaatgtattcagtattcaaataaaagacattttggttcaaa

SEQ ID NO: 38380 - DNA, 11107 bp, Homo sapiens
ggcggagccagattgttggtaaacgctaagccacgtgcggacgcccaggaggatggcccagcccggcgcgtgcgcactggttacgcagcctgtttgcggcgcgcgctgccaggcggaagtgacaactgcagccgcacgtgggctcggcgcgatggaggaggagacgcatactgacgccaaaatccgtgctgaaaatggaacagggtccagccctcggggtcctggctgcagcctccggcactttgcctgcgaacagaacctgctgtcgcggccagatggctctgcttccttcctgcaaggtaagaacttcacccaggtctttcttttggagagggactaccgtgtactgtgcaaccgagtgcccacctcctcacgataccagctggtaaatgtcactcctgcgttgatgcatgatttcttgtccgattgaatactactaaatacgcagggatacacacatctctccctcacgactagaaaggagaagatagttccatctttgtaactatctctgagaatgagaggaggggcagactgtccgcccaagaattgatatttcagaatagggaaaatcacctcgccagggtaaatatcccccttaactcgattcctcctccaccctcccacccccaccccccacacacacaccctctaggtccttgcatcccggactgaagcaaacctgtctatttgcatactgtggactgtggcggatctttcacccacgtaaatactcctcaaattgaagataatgtcattgcgctgggttgagaaatacatccccaccgctacctcactgcatctctccacacaagtaaatatccctaagattagggcaagtcaaaaaaaaaaaaaaaaaaaagattagggcaagtcttacctatagagcaaatatccccttttcctagctaaataactctcagaagtagattaactccaagaatatttctctttaacgtttgagacgggaggccgggggcggtggctcacgcctgtaatccccacactttgggaggccaagacctgtggctcacctgaggtcaggagttcgagaccagcctggccaacatggcgaaaccctgtctctactaaaaatacaaaaactagccaggcatggtggcgggcgcctgtaatcccagctactcgggaggctgaggcaggacaatcacttgaacctgggaggcagaagttgcagtgggccgagatcgtgccattgtactccagcgtgagcgacaaagcaagactctgtctcaaaaaaaaaaaaaattgagacagcgtctcacgatgtcacccaggttggtcttgaactcctgggctcaagcaatcctcctcccaaagtgctcatacaggtatgagccaccacgcccagccccaatacattttaacaaaatttggctgctgtgttgattgtggggagtatgggggaaaacagggaggtgatggtggctccagccagagcaggagtagtggaggtgatgagattctggatgtagtttgaaagtaatacggacaaaacttacgtatagtttggtttgagtgcgaggaaaaagattcaggcataactaaggtttctgcccagatctgtacaagtctggaaatcagaagagagacccaagctggacataggcaatttggaactctctggctatatagatggtatttcaggctattgcctgaacgaagtgagtgtagatggaaaagagaagaggtcccaggaccaagccctaggccttccaacttgagcagtcagagacatgtgacaagctagcaaaggagactcagaaggaacgcccagagagttagggggaaaccaggagatggtggtgacctggggccaagaaaagagcatgtctgagatgtgagggctgaccagctgtttcagccttactgacagccgggtcatgggagggttgatcatttggaggtcagtggtgacgatgttgagctgccgcaatggagtggtggggtcacagaaaaggaagaagaggcagctgttcaggagttctgctgtaagaggatcagataagtggggcaggagttgtagattgttgtggggtcaacaggggagagaattgctggagccacgtcttcaagaaggtgagaggggagagactcttgtgctcgggcaaaacacaggcagttcatctggagccagaggcaagttctgttttggtaacttctccagtcctcagggcagtttctcctggaactaagcataccttccgtgtaagggcaaattgggcttcccaggaaatacggccttaaccaaggaccttcccaggccctccctcaggcttagcgcttatgctgaattgagatacctaaagtttcttcgaacgtaagaattaagaagaggccgggtgcagttgctcacagcggtaatcccagcactttgggaggcctctgaggtcaggagttctttttttttttttctttttttttttttgagatggagtctcgccctgtcgcccaggctggagtgcagtgaagtgatcgtggctcactgcaccctccacctcccgggttcaagcaattcttctgcctcagcctcctgagtagctgggaccacaggtgcgtgccaccgcgcccggctaatttttgtggtttttagtagagacggggtttcaccatgttggccaggctgatcttgaactcctgaccctgtgatccacctgcctcagcctcccacagtgctgggattacaggcgtgagccacctcgcttggttgaggtcaggagttctgagaccagattggccaacatggtgaaaacccatctctactaaaaatacaaaaattagtcggatgtggtagcacgcacctgtaatctcagctactctggaggttgaggtacaagaatcacttgagcctgggaggcggaggttgcagtgaactgagattgcgccactgcactccagcctcctgggtgacagagggaaactctgtcccaaaaaagaaaatagagacaggagtcttcctatgctgctcaggctggtctcaaactcctggcctcaagcagtcctcccacctgggcctccatagtgctgggattacaggtgtgagccaccatgcctggcctaaaatgtatttttttttttttattgagactaagccttgctgttattgtccaggctggagtgcaatggtgtgatctcggctcactgcaacctccgcctccccggttccagcaattctcctgcgtcggcctcccaagtagctgagattacaggcacccaccactatgcccagctaatttttgtatctttagtagagatagggtttcaccatgttgactaggatggtctcaaactcctgacctcaggtgatccacccacctcagcctcccaaagtgctgggattacagcagacagtactagaagccaggctgtttatttcttaggttttacctcctgtaccccgttcatagcttctggggaaataaggaatcaggattcattccagatattatccctttctcaggtgtccagactgatgcaaaatttgggggccagtgcctaagggaagagctgggctggggaagctttggaaagagaagttgagagcagctgcagtaagagggaggatggttagctttcaggaagaacttcctgttaaaagttactaataccagccgggcacagtggctcacgcctgtaatcccagcgctttgggaggcgggcagatcatgaggtcaggaagttcgagaccagcctgaccaacatggtgaaacccagtctctactaaaaataaaaaaattagccaggtgtggtggcgcgcgcctgtaatcccagctactcagtaggctgaggcaggagaactgcttgaacccgggaggcagaggttgcggtgagccgagattacgccactgcactccagcctgggcgacagagcaagactccatctcattaaaaaaaaaaaaattactaatatcagggccaggcgtggtagctcacgcctgtaatcctagcaccttgggattacagttgcccaggagttcgaaacccgcctgagcaacatggcaaaatcccctctctactaaaaatataaaaattagtcaggcatggtggcacatgcctgtagttccagctacttgggaggctgaggcgggaggatcacttgagcccagaaggtcaaggctgcaatgagccgtgatggcaccactgcactccagcctgggcaatgagagtgagaccctgcctgaatgcctgaatggacgaatgttactaatacagctaaagtctgttgcacattcagcgtgagccccgcagtgttctaagtgttttctgtgaattgtgtcctttgatcctcacaagacgctagcggggagggactgctattttccccattttacaaatgagagaaatgaagtgagtgctcaaagaatcagtaccaacaaatggcgggggtgacgtggggagccctggccgtcaggctcagtgccacaaatggggccccaggagcagggaagctgtgagtgaggccctccctgctgtctcctcaggtgacacctctgtcctggcgggtgtgtacgggccggccgaggtgaaggtcagcaaagagattttcaacaaggccacactcgaagtgatcctgaggccgaagattgggctgcctggtaattgggccctgctgaacctctgagtggtgcccagtttgtcaaaatcacccccccagctcctccctaccagctgccccgagtctccactccccgcttgggtctccactcagctgtttctgtctttaactctccgcctctaattaataactcatcttctgttgcttctctctctgcctctaatttctccctccctcttttctccctctctctgcctccactctcattcattccattaacctgtttttcttttatttatttttatttatttattttttttttggagacagtgtctcgctctgtcaccccggctggagtgcagtggcacgatctcagctcactgcaacctctgcctcccagattcaagcaattcccctggctcagcctcccgagtcgctgggattacaggcacgtgccaccatgcccactaattttttgtatttttttagtagagatggggtttcaccatgttggccaggatggtcttgatctcctgacctcaagtgatccgcccgcctcagccccccaaagtgttgggattacaggcgcgagccactgtgcctggaccattaacctgtttttccacccttttaccctcatatccctcagtccccactgactggacctgctagggtgggagtgggcgtgggtagcagcacagacatggaactcccaggtcttcttcccttggatggttcccttggtggatgctggaggtagcaggggtcagtggatggcagtcaggccttgccttcttcccactggaatcttccatcatccctgcaggtaactgcaccatcccaggctgagaccgtgagccctttctgggaatttgggtgaggcgtatggaggaaggtgagtcaaatgaaggggaagaccctgaacctctcttcaatttccccaggtgttgcagagaagagccgggagcggctgatcaggaacacgtgcgaggcggtggtgctgggcacgttgcacccccgcacctccatcaccgtggtgctgcaggttgtcagcgatgccggctctgtatcctttctgccaggcctcctcctccaggaagtctcctgattgcttccctcctggcggatacatataccctcactgctagccagaaagccttcaaacacttgacaggtaccagctcactgaagaaggagagcaaacagcctgggtgcttacttatgtgccaggcactgttctgtgtgccttatgcacattaactcatgtaatatagcacatgcccttatgatccccgtggaagtggcagagccaagacttagacccagaccgtctagttctagagcccacggaccctggcagatgagtgttcttatgttcgcatgtttcaggtgacaaaactgaggcccagagaggggaaggggcttgcccaaggtcacacagctggaaggcagcacaggcaggactcaagcccaggccagtctgactccagagcctgtgccaatcacttcttttgttttttgggtttttttgtttgtttttgagacaggctctcactctgtcacccaggctggatgcagtggtgcaatgtcagcttactgcaacctctacctcccgggctcaagcgattcccatgctttagcctcctgaattacaggtggaattacaggtgcctgccaccacgccaggctaatttttgtatttttagtagagacggggttttgctgtgttggccaggctggtctcgaactcctgacctcgagtgatcagtccaccttggcctcccaaagtgctggggttacaggcatgagctactgtgcccggctggcaatcacttctactcggcacctcagtggatttcaggccctcagtgctgggggcgccctgagcagacagcagctgagtcaggagcgtggccttgtaagatctccatgtctgaggtgcgagaggttgaggttgaggactagaattagacactgtagaaggctttactggaacgtggccctgaactggacagacattttatggatgggcagagagagaaggtattgtgaccccattttacagaagtggaaagtgaagcccagaggaaggcgtggaggatcagcagcagagctggaaccggttgactaaagctgtggtctttgtctggctgctaggcctggagaagaaacacattaggaaactgaggcagagccagctgactcccaacctgtgctctctttccactgtgagcttcctgcaggcagcagcgaggtggctcttcctccattgccctgccagctctgtcaccggggagtggctgctacccaagtttcgggcctggctttgccagtgcctccccctcgtgtctttggaaggtttcttcccctctctgaccctatttgccaacaaatgtgtggtacgtacttcagtacatacctattgaatattattatattccccatctaacagatgaggagattgagactcaaggagtaagtcacttgttcaaggtcacacagctgagcaaaactaggtctggaacccagggctacttgatccccggaccacttttaaccactctgccatactgcccttctgtgaccgattagtgatgtctgccataggcatcagcctggtggagggaggcatggatctgctctgctggccaggcctacagtagaaacttcttaggctgggcgtggtggctcatgcctgtaatcccagcactttgggaggccgaggcaggtggatcacctgaggtcaggagttttcagaccagcctggccaacatagtgaaaccccatctctactaaaaatacaaagattagccgggtgtggtggtgggtgcctgtaatcccagctactcaggaggctgaggcaggagaattgcttgaacccaggaggtggaggttgcagtgagccgagatcacaccattgcactccagcctgggcaacaagagcgaaactccatctccaaaaaaaaaaaaaagaaacttaaccatttcctgtggtgctcagctcctggcctgttgtctgaatgccgcctgcatggcattggtggatgcaggtgtgcccatgcgggctctcttctgtggggtcgcctgcgccctggactctgatgggaccctcgtgctggatcctacatccaagcaagaaaaggtaggtgtgaagaccagggtggctgaagggcagaggccagacagctgcccgtcccttcctccaggcctcgcttctctacagacagtcggctcatgccacctcaatcccacttagcaagggctgctctaatcatcatggttcatttagcagcaagtgctggaaacccagctcagacttgcttaattaggaaggaaatgtggggccgggagcggtggctcacgcctgtaatcccagcactttgggaggctgaggtgggtggatcacctgaggtcgggagttcgagatcagtctgaccaacatggagaaaccccatctctactaaaaatacaaaattagccaggtgtggtggcgcacgcctgtaatcccagctactcaggaggctgaggcaggagaatcgcttgaacccaggacgcggaggttgtggtgagccgagatcgcgccattgcactccagcctgggcaataagagtgaaactccatctcaaaaaatataaataaataaactagaaaggaaatgtatggccaggtgtggtggctcacacctgtaatgccagcactttgggagtctgaggcaggcagatcacctgaggctgggagttgaagaccagcctggccaacattgcaaaaccctgtctctactaaaaatacaaaggttagctaggcatggtggcacacatctgtaatctcagctactcaggaggctgaggcaggagaatcacttaaacctggagggtggaggttacagtgagctgagatcgcaccacttcactccagcctggatgaaagagtgaaactctcaaaaataaaataaaataaaaccaggactttaaacaccatcaggatgtccttgcttcacttctcgtccctgcctttctctgcacatcagcttcattctttctggccagcacctttcctgaggctgggactgaccccttaagctccatttccatcctaggaggctcaaaagcaaacgagaagagagttttcctcatcggctcaggtgcagtgtcctaagctcaagttattctgagttttctgcccagtgctataatggtcccctctagtcaagaagacggaaaccacttggagggtttcagatggagggagttaaatgcagggactttgtaacaacagtgttgaggaactagaggaggaaaaaggaagcaggagtgacacccagagatgagaaacccctcccagacctggactgaacctgcgagccacctcctgttctgtcgtgttggagacatcatctcaattggttctggatgcacatagcatgtcctgcttctgccctggccactgaggtccagaacccaccccacctccatggctgtcacacagccacagccatcagcacctgccattgtccatgaggaccagggtgctgcttttcttccattctcccacctcattactgatggaaactagctggtaagggagtctgggaaatacagcttgctggcttccagcccctgtgggacagagcatggaagggggactgggaggccgagaggtaccagataagtgagtggcactatggctagccccttggggcaggaatactgagcttggaagcccctgtcagaaccacgtggttggaataaggggcatggagtacagttctacaaaggaaaggcagagggctatacccagggaagtagggaaggggtagcgtagacaaaaaatggctgcgcttgatgcttgataggtgagcgcctggctatggaaagggagaggcctggaggccaagggtccggagtcccctcagtgggactggctgcaagtgtgtggtgggaaggggagcgttgagacagggtctcactgtcgcccatgctggagtgtagtacgatcacagctcactgcagcttcaaactcctgggctcaagcagtcctcccacctctgcctcctgagtagctgggaactcagacatgcacccccacacccagctaccttttttttttttttttttctgagatggggtctccctctgttgcccagattggtcttgagtttctggcctcaagcagtgccctgccttggcctcccaaagtggtgagattatggtcatgagccactgtgcctggccaaaggactggctgagattttatctgaggggaaggtcctaggtcccccaccgccttctaccccttgtccctaggaggcccgggcagtcctgacctttgccctggacagcgtggaacggaagctgctgatgtccagcaccaaggggctctactcagacactgaggtaccagcatggggatgaggggaaaagccagaaccttccttcccactgacatacggtcttgtcccaactctgccctggattctgagaggcttcaggagagcctcttaaatttcttcttgtaaaaagggagttttcaaactttgtggacccagaaacctttgcggaaatgtttaagggaagcccaatttataacacaggcaaaaagaggatgagctcagtttgaagtcagaagagggcatgtgatggtcccccagctcccagctcagagtggtgagccatgggaattccaggtctcaggctaaggggcagagcctggaaactcttggacatgactgtctgcaaaagcatgtccaacctggacctcatgaatctaggaatacatggcagtgaagactgggagtctcttgattccatggctcttagattatttgggctgaaggggactgtggctgtaaaatcccaagaccactccaattctgtgcactctccagttccatagctctgcacagctggggcctcctccaaggtgtgaggatgcctgataggtctgagtcctgttgctgtcagaatctgatcctgaagtccttctccctctttttatttctcctgatctctaagaaacagttcatgaaatgggaaataatcccttaccacttgcctcacttgggggcaggggagtgatgggaggttaagggagtcaggtggggtcagcagaacctcctgggtcagccaagtcgtgtgtgcatgaagggctcggcccccagcaccgaccagtctctcccccgcagctccagcagtgcctggctgcggcccaggccgcttcgcaacacgtcttccgtttctaccgggaatcgctgcagaggcgttactccaagagctgaggcaagctggggcaaggggccgctcccattgcctccacccactcaccccctacagcctgaagcaaaccagcagcccagccttgcctctctgacccatgggctccttgagcctgcagctctgtaaccacagggctcctgtggggaggccttggcctgtgacagcccccaggcctgggggcacagatccccccagcaaggataacattcaaaggagctcacatttatggaatggatgaatcaataaattaattcactttaac

SEQ ID NO: 38381 - DNA, 14999 bp, Homo sapiens
gcttccgggtgagccccccccgctcttacgcggtctgtgggagaccggagcgggagacagcggtgacaggagcagcggccgggagcccttagggaggcaggtgagcgggggctggatgcggggagatagcgggcctggagggcggctccagggcgaggcggggactgtggcaccaagagtcctgcgtccccagattgtgctgtgcgcctgaagccctggcggtgcagccgtgcacggagtcccgtggagcgtttgtttgggctggattatcccgctgcagccgaggttgggggcccgggttcggggctccgcacctcttctctggggttcaccctctcggataccgcctgggcagactccatcgatgcagaacccgaggtgcgggtggtggttggtgggggggtagggaggtgaaaacaataacagccgttttgtactaagcgttgcgtgcattgaccattcatttattttatttatttatttatttttgagacggagtttcgctcttgttgcccaggctggagtgcaatggcgcgatctcagctcactgcaacctccgcctcccgggttcaagcgattctcctgcctcagcctgccaactagctgggattacaggcgtgtgccaccacgcctgctaatttttgtatttttagtagagatggggtttctccctgttggtcaggctagtctcgaactcccgagctcaggtgattcgcccacctcggcctcccaaagtgctgggattacaggcgtgagccaccacgcccggcctgacccattcatttcttacaacaacccattgaggtcggttctagtccccatttactaaacgaagaaactgaggtcacacaactagaaagctacagaactaggatttgtacccacatctatcagactccagagcccacatacttaaccatcctgctaccaacagcagccaggcccagagtctggctcacccaaagctctccacaagcccaacctgctgggaaacagatttgatatctatccttaaagtatggaggtgtcatggtgggcactgaggactgggctgctggagaccttcccccagatctgccgctgacccactgcgtgatcctgggcctgtgtctacccctctctgagcccagtttcacccttgtttcagtgatacaatcagcaaactttaagaagactcttagccaagatattctaggattctgggaatggcagcttctcctacgtctaaatggctaaccccagaggcgatcaggctcttcaaagccccagggcaaggctggggtctcattcttctctttaatccctgtgtctagcacttcagcaggcccatagtagatattcaagaaatgtgggttggctgaataaacacttcatctcttttcagaactgcatgacagctgctctcctgggcctttgtggggctttggatttctcagttctggccaccttctatctagctggctctcctgactgcctcctccctggccagtggcagagcctgccagggctggcagcaggtcctaagcctctgtgcgaagacccacagcctctggaatcctcagcatagtacaacttgcaggggtggggggtggcacatgaagctcatagcccctcctggtagcagtgctcagggcccaacttcagttactcccagtttggggatgttgccttccatgggaggagatactttcatattaaatctgaaacacttcttatccttcactgtcccctcttccatgaaaccacccttgactcagagacacagtccctctgacagcacctggtccacccctctactctggcagcccggtggtgattattttgtttttcctccaccacataacctgctggaaggcagggactccacttcagaaatcttggaaaaccctgtggcccacaagggtttgagctcatattcccatctggtgaggtgcagaaggcacagagctgtgccaggacatctcgttccaacccagccccactcctaatagtaataaaagtagctacatgtttactgtgcagctacttggtgccagacacctaccttatccctatcaataatctccacagccttgcaagttagagatatcatgcctattttgtagattatgaaatgaacactgaaaggtcaattactttgcccaaaattacacagcagagcatagaccaaacctgggactgtctgaccctgaaacatggatctttctgcaccgccctatactctgcgtcccagcaaagctaacctgtctgatgtggttgggcagaggtgctggacctcctggcggctcgctcctgtcttcagtgtggtaatgtcacaggcatttaaattgtggtttgcaagctcgcttgatttgggagaagtgccctcccagtctgtgaaattctcccaaactctaagggcctttttgcaaagcaaaacccaccctgcatttggctctgccaatatgtgattcagggggtgttttcccactcacagaatggagtgggaaactccacttattaagtacctcttacaatggaatgactctatggtgtaggtatcagggcactgaaatagaagccaggagctgcagggtcagtttatagctctgtatgtcactcactgtgatctccaaaagtcccgttgcctctttataccccattttccacattaaagtgtaagggattaaacaggattggcaattttcaagcttttaatattttcagcactgacagccgtttctcaaatcaaatctgtctctgaatcttaaaattcaaaaacagatcaaagtggactgctgtagtgagactgttccctttactctaaccctgccccggtctcaggctcctaggcagtcctgccccagggtttctgctaagcaggagccagttgttccctcagcctcctaaaagcgatggggagttgaggccagtggaatgcagctttggattcagaagccagaaaacaacagagattgtttgtgggaagtgagtcagagagattagacctctcttcaacatctgactagactctagaatggcattaagcaagtcactgaaccgctcagagcctctgtttccttatcactaaaagttaggacaattcttgcaatgaaatgagatactactaccaagtacttcagtgctgtgcccagcacagaacgaatacactcagtatgtttttcttttgtttcttctgtctctccagcacccaaagcagaaacagtatgggcagagagacgcctactgaatcaggtgtttatcagtattatgaaatacagtatataaaacccagcatttggagtccagaacaaattcaaattctggctcagtcactaagtagctatgtggtcttgggcaactggcttacattttggtaattctctcaatatgcaaaaatattctctcggccaggtgcggtggctcacgcctgtaatcccagcactttgggaggcagaggcgggcggatcacttgaagtcaggagtttgagaccagcctggccaacatggcgaaaccctgtctctactaaaaatacaaaaattagccaagcatggtcatgcatgcctgtagtcccatctatttgggaggctgaggcaggagaatcacttgaacccaggaggtggaggttgcagtgagccgagatcgaaccactgcactccagcttgggtgacagagccagactctgtctcaaaaaaaaaaaaaaaaaaaaaagaaaaggaaaaaaaactcctggcagacatgagagcaaaatcgagtacgaaatgggcagctgggacctcatatctactgaataattgtctgtttggaggttgagacatgactggggaggcctggcctgcccctgtgttaggtgatggggctggcccacccaggggtgtggcagcagggctggcccctgtgtgacttgtgataaccccaccctaccaaggaggaagactggataaaatgggcccctgagatggctgaaggcagctaaaggggcctaagagactatggggagaagggcagccagttcctaggcagccctgccccactgtttctgataagcaggaggcagttgttccctcagcctcctgaaagcaatgaggagttgaggccacgggaatgcagctttggattccagaagccaaggacctgttacaaaggtggttttctgggaagcaaattagagggattagacctggcttcgacatctgacttgactccaacctaccaaaggatctcccagttcacctgggagttaacacaccagggttctagtccttttgctcgctgtgtggctttgggtaagtccttgcccctctctggaccttgaggtcccattcatacaaaaagcagttggactcaggcctgccagcccccatttttgtggctcttccccgcccctccccatcctttggctatgggatagtctcccaggcacctccaaaaggaagtgtctaaaacagagctctccacctcctctccaagcccagctccccactgccctcttcctgccctgtccctgtctccgctgccctttagatcaggcaggcaggcaggcctagagcatccgccctgagacactgcctgttggctgccttaagacgccccttccttctctgcccgcagcctccccagcctctgcattcctctgcttcctgtctgctctgctcagcctgcaggattgatcttcccaaagccaggtgtcaaccaggccactaaccctacccactgctcagaaatcttcccacagcctcagcctggccccctcttatccatcccctccatacacacttgcctcagctcctcaaaacagtccacagccatcctccttccccacctttgcccctttcttcccttcctaaggaaatattggcccccttctctccaccaggctgaacccactcatcctgcaaaaccaagttcaacgccctgtcattttcttttttttttttttttttgagatggagtctcacactgtcgcccaggctagagtgcaatgggtgcactctcggctcactgcaacctctgcctcctaggttcaatcgattcttctgcctcagcctccagaggaactctgactacaggtgcacaccaccacacccagctaatttttgtatttttatttttatttctatttatttatttattgtgagatggagtttctctcttgttgcccatgctggagtgcaatggcacgatctcggctcattgcaacctccgcctcccaagttcaaaggattctcctatctcagcttctgaagtagctgggattacaggcatgtgccaccacacccggctaatttttttttatttttagtagagatggggtttcaccatgttggtcaggctggtctcaaactcctgacctcaagtgatccacccacctcggcctcccaaagtgctgggattacaggcgtgagccaccgtgcctggcctaatttttgtatttttagtagagacggagtttcaccacattggccagcctggtctcaaactccagacctcaagtgatccacccgcctcagcctcccaaagtgctggggttacaggtgtgagccactacgcctggcgcctgtcttcttctaatatgcctcttctgacctcctcactcccattggagccatggctcacttctggtcaggctccatgcactcaatcagccctgcctgccaggactgtagtgcccacttgatgagaaatcacctgtgaaaatgccaggcatggtctggcacacagtaggtgctcaagaaacaaatgttaatgccccagcttccttctgtcttgtgtccactaatttggcatttggagcatatttttgtacttcacgtaattaaatatttactgtgtgccaaggtcagtgtgtgacagagcactgtaggggaggcaaaaatgaaccaactctggaccttgccctgcagaagctctgtctactggcatgaggtaagacaggtccacagataacttacataagagagactgcaatctggacaagacagcctcagtgggagagggaaggagaaccctgtagatttgggtgcggggaggctgtggggagagcacagcctttcaggtaaagggacaaggttaggaaagcaagaaggtgtagcttgtgctcgtggagcccaggaaactccttgggctagaaaagatttggtggcactctatacagtgtatgtgtctgtctgtctatctaacatgaatggtactattttctcctattggtgtgcattgtacctaacaaaaaatccatgtcccaagtacttttctcttttctttctttctttttttttttggaatgaagtcttgctctgtcgcccaggctggagtgaagtggcgctatctcggcttactgcaacctcctcctcctggattcaagcagttctcctgcctcagcctccccagtagctgggattacaggcacgcaccaccacgcccagctaattttttttgtatttttagtagaggtggggtttaactgtgttggccaggctggtctcgaactcctgacctcaagtgatctgcccatctcagcctcccaaagtgctgagattataggtgtgagccgccatgcccggccaacagtacttttctctagaggtagaattgcaggggatttttctctttttgcttatctgcacttttctaaaagttctgccatgaacacgggcattttttgtggaataaacaaagtttaaatgttggctagatcagtgcttctttatgcataaggaaggattagttcttttttttctatttccaatttattgattctttgataaaatgcaatgcaataaaattattatttttttttagagacgtctccctctctcacccaggctggagtgcagtggtgcaatcatagcttactgcaaccttgaactcctgggctcaagcgatcctcttgctttagcctcctgagtagctgggactacaggtgtggaccaccacacctggctgatttttaaactttttgtagatacagggtctcgccatgttgcccaggctggtctcgaactcttgggctcaagccatcctgccacctcagcctcccaaagtgccgggattacaggcgtgagccaccatgcccagctagaaaattacttttttggctaggcaccgtggctcacgcctgtaatcccggcactttgggaggctgaggcaggcagattgcttgagcccaggagttcgagaccatcctgggaagcatggcaagacctccatctctacaaaaaattcgaaaattagctggatgttgtggtgcacacctgcagtcccagctacttgggaggctgagttgggagaaacagttgagcccgggaggtcaaggctgcagtgagtcgagattgcaccactgcactccagcctgggcgacagagaccctgtgtgaaaaaaaaaaaaagaagagaattttttttaaacagtcattgcttgctcagatgtttactttaaaagataataatgaacaagaagcagtcacataaaatacaagcccaaattttatatcattagattctgattgtcatgaaagtttctaaagacttactttcatttctcaacttaccttgttgaccagcagggattggtgaaccatgctgtgagtagcattgggctagagagaggggaggcaggaatctagaagagctgttttccagatgtgaccatctcctgaggacagggaccatgtctcatgtgccacccatcaccccccacagacagagcctgcagccaatgccccaggagccctcggttccaaccaactgatgcccctgtgcccactggcccacgccatgcagccccagtccgttctgcacagcggctacttccacccactacttcgggcctggcagacagccaccaccaccctcaatgcctccaacctcatctaccccatctttgtcacgtgagtctccaagaatgggccaggcctctgctctgctggttggggttggggttggggagggagtgttgactggagcgggcatcagtatggctgggggtggcaaagtgagctgtcagcttgaaattcaaggcactggaagcaggctacttggattaaggacaggaatcttaggaacaaaacaaactttgaaagaactcattcatcccatttggaaaattagaagaataacccttgcctgccatcctgagctcttgcagtaagacagaagctgagaaggtgctctgtacattgtaaagtgctatgtacctgtaagagatggcagtcattgaggctgggcacggtggctcacgcctgtaatcccagcactttgggaggctgaggcaggcggatcacgaggtcaggagatcgagaccatcctggctaatatggtgaaaccctgtctctactaaaaacacaaagaaattagccaggcgtggtggcgggtgcctgtagtcccagctacttgggaggctgaggcaggagaatggcgtgaacccgggaggcggagcttgcagtgagccgagattgcaccacttcactccagcctgggcgacggagccagactccatctcaaaaaaaaaaaaaaaaaaaagagatggcaatcgtgattgttaataataatgcagacatttactgagtacttactatctaccaggtactatgctaagcacctacacacattatctcattcaattctgagagcatttgtatgaagaaggagtagctatcctctagaacatcagctccatgagggcagggatgtttgtctattttgttcactgttgtatcatcagggcctagaacagtacttggcacataataagtactcaataaatatttgttgaatgaatgaattaaccacgcatgatatagatgaaggcctaaggctcaaagagatgatagaacttggccacggtcacccaggcagtaagtggctgggatagaaagcaaggacctgccaaattcagagtccaagttcttaaccacttaattccttcctgtaattaccgttcttttagtacagttgctagtgttgtcactgttattcttgttgttcctattattatttcaggccctgggcttggccaggcagggaagccagacactggatcccatcctcctcccaccatctccacttccatatttctttcctgcttcccaaccatccctctcagtcgcccccgcaccactggcccttcccacagctaccaatccatatcccacccccgctcttgcagggatgttcctgatgacatacagcctatcaccagcctcccaggagtggccaggtaggagacgtggagttggggggccagcgggtggtggagggagagattccacaggtggaagtgctgggaggcagaagcagacctaggaagtagaagatgcggacagacagacattagctcagtagaggaaagggtttccccggggccagagctgttccacagtggaaggggcagccccataaagtaaagagctacccatcacccgagacgtcgtggcagaggctgttgcagaagggagctgaactgcagatgggagttcaaaaagagggcctcgaaggagccttccacagccgaattccggagctctgctactcagggcctcagtcttccctcctatttagtggatgcatccctgccccttctgtcctgggggcttgagccctcctggtgccatatgcagcttggtttctaacagaggcacacagtgtggtggggtccggaggaccgttgcctgggacctgccttccttcaacccctctacccacacccacacaggtatggtgtgaagcggctggaagagatgctgaggcccttggtggaagagggcctacgctgtgtcttgatctttggcgtccccagcagagttcccaaggtgaagaatcaaaggaagggctaagaagggaggttgcgctcacgcccgtaatcccagcactttgggaggccaaagtgggtggatcacttgagcccaggattttgagaccagcctggacaacatggcaaaacccatctctacaaaaaatacaaaagttagctgggtgtgggggtatgtgcctgtagtcccagctactcgggaggtggagaggtgggaggattgcttgagcccagaaagtcgaggctgcagtgagccaaaatcgcgccagtgcactctagcctgggtgacagagcaagaccctgtctccaatacaaacagaaaaaggaagggaggttgggcaaaggtggactgagggtccacactgactgcaccctcactcccacattgtgctggccctggggccacaggtgaatggacgtggtctttgcccttaagtcagcacccatgtagggtcagtcctctgtgcttccttatccaggggctgtgatgatgaaggaaggagaaggccagggctatgctctgtgatggctgtcatcctgccttccaaagctacatgtaatagacacactgctttgtccctcccctgcccctaggacgagcggggttccgcagctgactccgaggagtccccagctattgaggcaatccatctgttgaggaagaccttccccaacctcctggtggcctgtgatgtctgcctgtgtccctacacctcccatggtcactgcggtgagttccctccctcccaccagccctgctgccacccacactcctactgcccacttctcaacagggtggggacaggccagggcccaaggtgctccccaaaacccagtcatctgtcctgaagggctcctgagtgaaaacggagcattccgggctgaggagagccgccagcggctggctgaggtggcattggcgtatgccaaggcaggtgagtgaaccaccagcagggatgggcacctctgggtcaggaggtggcagagtggctaggagggccccagagttctgaaggccaccctctgccccccaggatgtcaggtggtagccccgtcggacatgatggatggacgcgtggaagccatcaaagaggccctgatggcacatggacttggcaacagggtaagggcagggaatgcagcacagggctggcaggagatagtctgcaccagccctgcccccgtgtctgctaagaatcacagaactgccgggcgtgttggctcacacctgtagtcccagcactttgggaggctgaggcaggtagatcacttgaggtcaggggttcaagaccagcctggccaacatggtgaaaccccatctctactaaaaacacaaaaattagctgggcgtggtggcaggcgcctgtaatcccagctactggggaggctgaggcaggagaatcgcttgaacccacgaggcagtgagctgagatcatgccactgcacttcagcctggatgacagagctagactccatctcaaaaaaaaaaagaatcacagaactgaagacagtgctggatgaggctttggggaaccatttaaacctctgggcctctgcagggaaatcaagcccagcactccaacaggaccagaacacaggcagtctccttcccagcctaggttctttctctccctgccacatcaccctgggatacctggcaagggccgaataagccaagacctccattgtctccccataggtatcggtgatgagctacagtgccaaatttgcttcctgtttctatggccctttccggtgagcaggggtgggcaggggtctgctgtgaatccctggccctttggcccaaagctggagcccaccctgatgactctgctttgcagggatgcagctaagtcaagcccagcttttggggaccgccgctgctaccagctgccccctggagcacgaggcctggctctccgagctgtggtgagtgactaggacttgagccccaccctcagccccctcctaggcaccacccacattataccctcatcccttaggaccgggatgtacgggaaggagctgacatgctcatggtgaagccgggaatgccctacctggacatcgtgcgggaggtaaaggacaaggtgagcacaggtacgaggcaaagggggctcagggggctgggacagagttttccacagactctggaatctcagagttggaagcagtttgcccttaagcatgcatcctctcctccccttccctgcccaggaaccatcgtggccttctatgtcggggcttgcacgagcctcaaacagccctgctttaacagttcaagagtgggccaggctgccagccgcagtaacccaggacacggggctcaagatggtcacagattgagcaggggggaagggacgcttccagagccacatccaccctccatttcagcctgtctccctgtctgcttccctgcagcaccctgacctccctctcgccgtgtaccacgtctctggagagtttgccatgctgtggcatggagcccaggccggggcatttgatctcaaggctgccgtactggaggccatgactgccttccgcagagcaggtaggcaggcaagggtggggtgttttgacctgcgccacagggactgataagcactctgcctagattggggaacgacgtcctgagagcttgggatcttattccgggaattactagtgatctaaacagacacacactgaggaagagatatggaactgcagcatagaacacggcccggtgaagcaagcagagcccttcatttttggttgtgagaacgtgggcaagccacttctctgaacctcagtgtcctcacccataactggataactggggataagatacctggtgcgtggttgtcctgaggattaaatgaagtaatatcactccataaaggggactcattttgttagaattgcacaccagcatgggaaggaacttgcctcttacctatttccttcactgtgcattttattctttggtaaactgaggccccaaaagaggaaatgacttgcccaagaaatagagtttcccaaagctgggctccgtctcatgtggtgtgcccacaggctgtgcttcttcatggtagccttcttccccgcctggccttcccatcgcagaaggtgtgctcagagctgatcagcgtccccccagcaactttctgcatctctcccaacacaggtgctgacatcatcatcacctactacacaccgcagctgctgcagtggctgaaggaggaatgatggagacagtgccaggcccaagaactagaactttaaaacgttcccggggcctcagacaagtgaaaaccaaagtaaatgctgcttttagaactgtgccctcatgccctcttcctgctcacatgctagcggggcccagcagccctgggtggttttgccagcatgctaactcttgtaactcgcagctgcatcctatgagctctcccaagcttccccgcccctcccctgggtcagccgtgaggcccacctttgccaccctcagctctttcctctggtgtggcttcagcttgaaagcaacctggagtcgggggcacagcctttggggcctggctgggagagggtcttggagcattaggggaagaagagagcagtgggatcttggggcctgagaagccttggaacgcttctggcagcagagctgggtgtgggaatgaggcctagatcgatatccctgggttagagttgaaatttgccgcaattccactggaaggcatttcccacgaggccagaggttgccaggctgcctgaggtctcctattctactctgaaccataaacccagagaagaattactcattaaccagcataaatactgcctgaggatcaaaactcagaggcaaagagggagttcctgactgctagaggtgccaccaccacaaacactttttattcaggagatactttttgagaatctctgctctgttcctaggttcagtgctgggtcctgggaatacagcaggacagacctcagcttatctcttcatagaaattatacaaagagaattggggagacagctaagaagaaaacaaagaaataaagcagttacaaattgtgataagtgctttgaaggaaagaaggggtctgagacaacaacagggaaggggcctctcttgaaacagtagttgggaaggaggcagacatgcaccagtgatgtggtgacaggtgctctgaaggaggtcaccaggacctgacctctttgaaggatcagaaaatacttccctgaaggactgacatttgagcctagacctgaagggtgagccatcaagctaagacaattggggaagagcattccagggagagggaggagttgtgcaaaggccctggggctccttctagctggaggaatgcaaggctagcttgtctggagcactgagaggatggcctgaactgagtggagagagacagaccaggaccaaaccatgcagaggtcaagggccacattcaccttttcagagtgactcaatcaaatttgtagtttgtaaaagtattttaacagctctgcggcaaagtgcaaatgaaaagtcttgatggcatggactggagcggggacagtggggatggagaaaggggaatggattgtggatgtgtttagaaggtagattcgatgtgaaggatgaatctggcttgaccttctgggtggctgatgggccatttactgagatggggcagcctggaagaggaacagaagcagggtcggggtggagggagaatactaaacttagcttgagacattttgcaataaggaagctatatctagagtgcttatgtgactcacctaaggccactcaacaagtttgtggcagaactggattagaactgcacagaaaacagccaagctgggatttgaacccatgtagtccaactccaaggcctctgcccctaaccactgtgccataccacctcccaataatcaacagcaaaattataggtctaacaatgttttatagacacccctccatttatgtgatgggtttgcatcctgataaacccatcataagttgaaaatatgatcataagttgaaaatatgatcataagtcaaaaatgtatttaatatacctaacctaccaaacatcatagcttagcctagcctgccttaaacatgctcagaacacttacattagcctacagtgggcaaaactatccaacacaaaatctatattgtaataaagttgtaaagaattttgaataaaaattcaatatttgaagtac

SEQ ID NO: 38382 - DNA, 4192 bp, Homo sapiens
cgcgtcctgagagtcagccctcgccgctgcagcctcggcgcccggccggccggccatggagcgccccccgccccgcgccgccggccgggaccccagtgcgctgcgggccgaggcgccgtggctgcgcgcggagggtccggggccgcgcgccgcgcccgtgacggtgcccacgccgccgcaggtaccgggcgccggtgggcgggggcgccgaccaagtttctctcgctgcaaagatggcgtcagtgctgcccaaacttcgggcccccgggggcggggcagcggggagggcggccgcgtcggtccgcgcgtgtccgtgggtcccgccggggctgcgccgggcggccggggagcccttcccgccgcgccgggctgggggcggggccgggggcggggccgcgccgtccacaccggccgcagccggttttcgaggcgggcgccgagcggatccgcggcggaggttgagggacccccctcccccggccaccgcctccgctgagtctgccccctccccatccgcagggctcttccgtgggcggcggcttcgcgggcttggagttcgcgcggccgcaggagtcggagccgcgggcctcggacctgggggccccccggacgtggacgggggcggcggcggggccccggactccgtcggcgcacatccccgtcccagcgcagaggtgagcgggaggcccggtgcctcgggactcggtgtgcgcaggggcggtgggtggggtgcggagacaccggccccgacggaggccaggtcagggccccaggtttgtaattaccagccacccccaagctcttcagccctggaggagctgagcagaaatgatcgatgactgggagtccctacacctccctccaccgcagttcctcggggctagagctcagaacccggagcgggtggctgtgcgtctctgtgcagaagaggctgcgcggtcggcatggggcgactgtccaggaatccctggggctcctgaccgccacctcccaacccctgccaggccggacacctcggtctggctgccagggcaggggcgggccctggcctggctcgctggggcctggggagctgcccgtgcttccagcccagtctccccctggctgctgccggctgctggccactcccacctcccaggcctggcgtgaggcccacagctgctgttgcacaaccctggttaatgtgtgatggggggaggcctgggcctggcccgcccctctgccagggcttcagacccctgcccagccccagtatctgaaggaaccacagtggagccaagcccgcgatgtggagaactcaggcttcaggagaccctggccctgctcctggcggctccgggtggctttcagctctctctgcaacctgagctgggggaggagccaggcctcatgcccagggctgggagtggggagcctggtgtgcacgcgtgcccaggcctgcacgtggaccgaccaggggaggggcccagagctctggctgggtcacccgcaccccgcccccatctcctccagagccaccccaggaaaagcccggctggacgaggtcatggctgccgctgcccttacaagcctgtccaccagccctctccttctgggggccccggttgcagccttcagcccaggtaagactcagatgtctgcatttaggggtgtgggtggggacagggctcagaacctacagccacccagcctctgtggggcaagcagagccctcaaacctgggactcctttctaaaatggactcccgcaccctcagtgccccctactgaggccaaagcggcaggacccaggccttctggcctccctgacctgctcacctccacgcggctggccacacacgtctgccaaccctttcctgtgccgggggggtttctccccaagccctggggccagctcctccaagacgctctgcccaccagtctcaccggacttggtgaacaggggcagctcaggattagggactccctggacccacccgaagttctaaggcggggggcccgtgtccccacagagcctggcctggagccctggaaggaggccctggtgcggcccccaggcagctacagcagcagcagcaacagtggagactggggatgggacctggccagtgaccagtcctctccgtccaccccgtcacccccactgccccccgaggcagcccactttctgtttggggagcccaccctgagaaaaaggaaggtgagcttgggggcggcccccagggaggggcgggtgtggcggctgagcctgaccctggcccctgttgctgcagagcccggcccaggtcatgttccagtgtctgtggaagagctgcgggaaggtgctgagcacggcgtcggcgatgcagagacacatccgcctggtgcacctggggtgcggcggggcctggggtgcggcggggcctgcgggttggctggggttgtgaggcccggccaggccaccccttcagctcccactggctggctgtgtctcccgcaggaggcaggcagagcctgagcagagtgatggtgaggaggacttctactacacagagctggatgttggtgtggacacgctgaccgacgggctgtccagcctgactccagtgtcccccacggcctccatgccgcctgccttcccccgcctggagctgccagagctgctggagcccccagccctgcctagtcccctgcggccgcctgccccgcccctgcccccgccccctgtcctgagcaccgttgctaacccccagtcctgtcacagtgaccgtgtctaccaggtgggtgaggccacgggtggcagctggggcgggtctcagggctctctggaggggagtgaagccctggctgtgtctccctgtagggctgcctgacgcccgcccgcctggagccgcagcccacggaggtcggagcctgcccacccgccttgtcctccaggatcggagtcaccctgaggtgcgtgtgggctgagggcctgcggctggcaccaggtggggagggtcctggtctcacagcaccccatgtcctgtgaccccccgcacaggaagccccgcggcgacgcgaagaagtgccggaaggtgtatggcatggagcgccgggacctctggtgcacagcctgccgctggaagaaagcctgccagcggttcctggactaagtccggctcgttcaagaacataagctaccaccttctccctccccaccccctccaggcccggggctgaaacagcccgaggacagccccaggggctggctttcaccagctgcagggtctgcttttacttggggtgggggggcggggctgaccctgaaccctcccccccgccaggtcggggaggggtcccaccactcaaagtgcctctaaagaaaccagctttttgcactaaagccaaaccacaccgctgtccccttagccccaagggccctgggggcagccaccctcccgcctgtcggcccgtagatttatcaagggtgttatgggcccagctttggggggccagtcccgatgcactttgaggggtgttggagaggggactcccccactcgcacttaactcaacggctctcgggccctggggctgtttttaccatgtttgtttttgaagctcaggtgtctcacgtctgggctgcaccaggcgaagagagaaattaaagatttgaggtttttccagaagctttgtctgcctctcgggaggaaggccgtggggctgggaccctgtggtgggcaagtgggtggagtctggcagctgcccacagagggccgagggtcacccgtcggccgccgccaccccaggcgaggccggaggaaggatcatctgagacgcaggaggcatctgctggagcagcaatttcccaatttattgaaagtgatcgctttgcaaggatgtctaagctaatcccgtcacagaaaggaaacgcacaggcgcctaggcagaaacttggagactcaccgcagaggccacgtgaacccacggccacagagaggcaggacggcagagccatgatttcccaccgagcgattacgagaacctcttcccccaatagtagacacatctccaatacaaacacaggtttataataagtaataggaagtcaatataatatagattatccccagaaaaaaatcaacaatcttcaaacactgccctttttttgtgtgttttgtttttgttgacaggttgaaagcatgttgaaaaaaataaatatttaagaaaagc

SEQ ID NO: 38383 - DNA, 13558 bp, Homo sapiens
gccggtgacggaagtgcggtgttgagcgccggcggctcgcgcccacgctgggccgggagtcgaaatgcttcccggtgccgggagtgagcgatgagctggcttctgttcctggcccacagagtcgccttggccgccttgccctgccgccgcggctctcgcgggttcgggatgttctatgccgtgaggaggggccgcaagaccggggtctttctgacctggtgagtggcccgcccgccgaggcgcctccctgccggcatcggggtcgagggaggccggagcccggctaaccccggcggcgggagcctggcggtccgagtctgtgccgcgcgctgtggctgtgggtggtcgggggaccgcctcgttttcctgctcggccggcggggttccaggaggctcatggcctgggactggaacgcaccgaagacttgtttgaaatatcagaaacgtcgcgtaaaggttaggggtggcctaataaaccctgtgtttaatcctccatctttgttgcagttaaagtgcaacaaaaagtgacacgtaatcagaacgaacccccgttaccagaagactttccgtaccagctaaattgggattggaactcagtacctaatcttcccttttaaaaaaggcaaattctaataagccagtatttgcagttggatccttgtaacaacccttggaggtgagagggattattctcactttcaggtatagttcttggggtcaggaagttcccagggcatgtaactgacagagaaaggacttgagcccagctgttctgactgtaccaccagaactcttcccactacaagataccaaagttcgttacctgtgtttccccatgcacggcagctacagtattgaggaagaagcatctcagaagttgacctttttgttgtaaagaaatggttaatatttttttcaaagaccgcagtattttgttatgctttgagtttgacgaaagccttatggtgctggtgtgctggctggctggcatacagtagaacacaggtgtagagtctgacgtgcaggataaaactataaggtgcgactctgcccttttcacgcaaaaattggtcctctatatccagtttgcatcctcagtttcagctaaccatagatcaaaaatatttggaaaaaattaaaatagaatacagttttaaaatacgcataaaaagacaatacaactatatagattgtattaggtattataaactagagatgatttaaagcatgcaagaagatgtgtgtgggttatttgcaaatacaccattttatgcaaaggacttaagcatcctctgatgttggtatctgtgatggggtggaggacttcctggaatcagtctccctcagataccaagggacaactgtatttccaaccttaagaatctcaataaaaaaggggataagttagagaaggaagaaggaaataacattgcacatcttttccaggaatgagtgcagagcacaggtggaccggtttcctgctgccagatttaagaagtttgccacagaggatgaggcctgggcctttgtcaggaaatctgcaagcccggaagtttcagaaggtagtcacctctcatatcagtgtgacattttaacctattcaaaggctttcatatgccagatggcatttgatctatatagctaccctctaggcatgtagggaacctcgtgtgattgttttcattttacaaattagggaacagactgaaagcagttacaaatagtggttcatattacttacagtattagggataagccaggactcagctctcctgttccattcagccttttatgccataattccttgtctttttttaaaaaaatacttgtccagcctggccaacatgatgaaactccatctctactaaaatacaaaaattagctgggcatggtggcgcacacctgtaatcccagctactcgggaggctgaggtgggagaattgcttgagcccgagaagtggaggctacagtgagccgagattgcaccactgcactccagcctgggtgacagggcaagactcgtcaaaaaaaaaaaaaaaaaacttacatagttattggactggatgggctacagtttacaggaatgagtgtggttctttccatggcatgcccctttgtggtgttgcctttttattgagaacagagtcacacaatctgaatttcttctttttttttttccttgagacagagtctctgttgcgcaggctggagtgcagtggcacaatcttggctcactgcagtctctgcctcctgcgttcaagcgattctcctgcttcagcttccggagtagctgggattacaggtgcgtgccaccacgcccggctaatttttgtattttttttagtagagatgggatttcaccatattggccaggctggtcttaaacacctgacctcaaatgattcacctgctttggcctcccaaagtgttaggattccaggcatgagccaccacgcctgtccaatttcttccaattttatgtgttatagaaagtacggttattcaaagtttaaagcccaatataagattaattcccaatataattggaagtttaaagcccattatgcagactcagatgagcagggtgacgactttagagcgcaagattttaaaaatatttctggatctacactgaggaggtgatcttacgtgaatgttacttacaaactttttactatagcaaattaagactgagcagagcatagttttaattaccttatcttgaacagcctctctagaggccactgagatgcttgaacctgaacaactgctccttcgaatcatcgtaacaatcctggacaaagcacaattcagagcgaggcaggttgtgtccagaatggatccctgaagagttagtttgcaaagcagggtcgaccctcactcagtgcatctgcttcaccctctctctcttcaatagcttttaaaggagattctgtttgagaatgaggacacgtgaaaaaggctcatcgatgtgacagttcttactgcttactgcatgacagccaataagctgagagacaaggtgttggggcaaggaaggcgacttttttccgagagccagcaagtcaagaagatggtggactagtgtcctgaagaaccatcttaagttaatagaacttgagacttcttttatgttaagggaaggggaaagaaaggcggaggtgagatcaggaggagaccgatgagcacagacatctggatggcagcgagggtccaaggggattgtgaaacttctctgtccttggtcaggccatgatgctcctcctataagtcttcaacataacattgttatttgtgtgtactccctctttatctccttgggggttagttttgggaacggaccactgtcatccttgctttaaactataaattcttcccatagttcactcggcctatacgataccactatggggatgttaagggagaatggaggcagtaatgctgagccgcctcctcgctgttacagctgttcatttttctacccagatggaaaaatcagtttgagacagaaagcaggtttgaaaatatggctttttccttctttgctgggttcctgatacttccttttcttaattttccttttcagttttccttttcacaaattttttgtttttaaccaatcagtaatttatttgtatctcaagtcttccaatataagtatgtttctgtttttattaagtactctgactcttaaagcaagctagttcttttgaatctacttctttaaactttagagacctcctagtcagtgacttacgtctataaattgagatttagtgcctttaatgattcagatctgtatcaaaaagtcttagccccttttacagttttttgttttttaacattacatttatccttattttagaattattgagctatttactggttcttatggtttatataagctgatttaaggttaatttacttaaaaaccacaattttgtgaagtaaaacttaactgacaagtgtgtttttttcctccaagtcttatctgttctgtaaagtgtccatctctgttatagtaagtaaaaccagtgtttatatccgtgttaaggttctacaaaatgacactttaacctggaccacagtatctgcatttacttcagtagagtacctagaggaacgttttggagatgagtgtgtgaaaacaaaatgtggcagtggaaacgccagctgttgctgacgtcgtgctgatcacagtcaagtgttgcccggcgcccttagggttccgagaggtgtgggttgagaagctccactaggctggacattttcttgttcctttctagtaggcgttctgtgatgttcgtgccccatttctccatccctggtttaggagttgagagctggaggtgaatcctgtagtgttgggttagggttgttagtttgcaggtagttggttgctcctgtgtccttattttcactccatgtaaggaaaagtcgtttgagatcatctagcccagggcctcgttttacagaagcccagagggtttaattcagttgacggagttcgcagctgataaaaggtatagcacaaattgaaactggttttttgagtcctggtctaatttagctgttctacttcagctgccatagtattacccagtgagtgagatatgggcccttcccagataaccctgaggtggtattaagaatctctttggggccgggcgcagcggctcacgcctgtaatcccagcactgtgggaggtcagggcagtggatcacaaggtcaggagttcaagaccagcctggccaaaatggtgaaacccccatctctactaaaaatacaaaaaaattagctgggtgtggtggtgggtgcctgtaatcccagctacttgggaggctgtggcagagaactgcttgaaccagggaggtggaagttgcagtgagccacgatcgcgccactgtactccagcttgggcacagagcaagactctgtctcaaaaaaaaaaaactatttgggattaaccttgaggtccccctgaagaaaaacttcgttgcagaagaaaaactttgttgcaaaagaaaagctgcaagagtactgaccctgaagggacccagttgcttccttttagtttctggtttctgtttcctttttttttttgagacagagtctcactctctcgcccaggctggagtgcagtggcgcgatctccgctcactgtaagctccacctcctgggttcacaccattctcctgcctcagcctcctgagtagctgggattacaggtgcccgccatcacgcctggctaatttttgtatttttagtagagacagggtttcaccatgttgaccaggctggtcttgaactcctgagctcaaatgatctgcccgcctcggcttcccagccctgttttcctttcttaatatgtcccattatctgtttattcaagctagatgaacctgcaccctctgagccctcctaggggttcttaacttcgtgtccatgtagttgtatttgaggcagggagaggctgaaccatggacacaactcatctttttttagatttatctatttttaagcaaaggggtctcactatgttggccgggttggattcaaacccgggctcaagcgatactcgtatgtcagcctcccgagtagctggaactataggcacacaccactgcgcccagcaacaccactgatgttatatacacaattttgggccatgtttttcctggagaaagagccccttgagatgctgtggaggggattgagatgctgtggagggggtggaggtggtgtggaggggagggggtggtggtggtgtggaggggagggggtggtggtggtgtggaggggagggggtggaggtggtgtggagggggtggaggtggtgtggagggggtggagatggcgtggagggggtggagatggcgtggagggggtcattccctcgtttccctcgttgtagggccacatagagagggtgtttttaagtctgatttaatgatactaaataatttactgaatgtcttcattctctagcatttcgtgttatgttcattgtttccagctcacgagtggactcttgtctttcagggcatgaaaatcaacatggacaagaatcggaggcgaaagccagcaagcgactccgtgagccactggatggagatggacatgaaagcgcagagccgtatgcaaagcacatgaagccgagcgtggagccggcgcctccagttagcagagacacgttttcctacatgggtacatcttccttgggttttcagattttaataccacagtcaggaaaatgttatgtgtaaaaggtgtttcccacttgatggggggagtttgagctggtgtttatcatcttcattcttatgtgtaaagattatttagaaatcactaaggccattatttataatcaagtagtgcagaattaaacttttggatgttcttaggaaaacccttacatgtaaatgaacaactgtaatcttttgaaatactagtattccctgtgcatgcagtacttaacgttaagatgaaatgcgaagactccagctttttcaaataacacctcacacgcagctgcttgttataattgattagcaccagcattttaacctttcatattcaatctttggaaaacaagagattctattttatcctgagaagcaaggtagtagtgaacttttctgctacctttcactccaggaatcagttatgtatttagtgactcacagaatagaattctcctttgtgtcttttacacatatgagcagaaagtagaaataagcattaaaaaatataaatcagtatatttataggttctaatttaattcaagggaaaccagtagaaaatgttttgccaagctgtattatttatagatatgttttgcagttacgtaaaaaaagatcaaacaagtattctttatttggtgatttactagtaggaattgaagcaaagatttgtggagttgcagggagatgagccgtttccagacactgaccattgctggaggcttggtggcctggaacatggcggatagcaggtgctggctcctgagacagttcagtggctgggtgggaagcttgtagtcatgctgatacagttaagttccagctgaacggaggagccctgcccaacacccacactccccttggctctcagccccgctcctgtgaggagcacatccccatctttgccccttcgccactgctgagctcagtctgccgtccttcggacaagtacttccacttcctgcgcgtaccacctctatttgccctctcgcccagctcttttaacactgtgcaacctgacctctgatcccaccacactactgaagtgtcctggtcaccagtggcctgagaatgcccccgtcagtccttttttaccttgttctttacagcctttgtgtgtcaatcataccctctatctagagggaaagaagcaaagacgggaaccacacttaactagcagcaaatatgccagggaagaaattagaccagcactggtcaggagactgggccctctggcaggcagggtcaccgtcatgctgaggcgctgctcgtctctggaggatggctccctgggagtgaaggtgaccctgccgtggagacagcgccattgtcctctgaacccacagtgtgggatgtgaacagtagtttttactgcagcaggctctagttttacaaggtgattgccttcaccccgaacttgcctggcctgcaagatcaaaatgtaagtggattccaagcataaatgttaggtgcccccttgtaaggaatggagcatgttttcctagagagaaaacgtctgcagcgttgtaaaataccctctcggtttaaaatgctaagtcgacctagtggatttttgaggtgaatttcagtttttagtaaggtcagcccagcagcatgtacttccttttcccacaggagacttcgtcgtcgtctacactgatggctgctgctccagtaatgggcgtagaaggccgcgagcaggaatcggcgtttactgggggccaggccatcctttgtaagttaaacgaagctgagttttactgaatcatgttccacaacttgtgaaaagatgaggcgggatctgctcattgtttgattattgggaaaacctgcagataagtagctctggcaggggtggcagaggagcagctttggttcgtgttggggctaagcggcattgcttttcagaacgtgaggtacctcagctttacttcctttgctttttttttttttttttttttttttaagacacggtctcacactgttgcccaggatggagtacagtggcacaaacacagctcactgcagacttcaccttctgggctcaagcgatcctcccaccttggcctcccaaactgttgggattatgggtgtgagccactgcacctggctttggtgtttctttcttgccctggggaggagtctttttttttttttttcctgagacggagtctcactctatcgcccaggctagagtgcagtggcgcgatctcggctcactgcaagctccacttcccaggttcacgccattctccttcctcaccctcccgagtagctgggactacaggcacctgccaccaggcccagctaattttttgtatttttagtagagacggggtttcaccgtgttagccaggatggtctcgatcttctgacctcgtgatccgcccacctcggcctcccaagaggagtccttttttcagtagagatgaagtctcactatgttgcccaggctgggctcaaatttctgggctcatgcgatcctcccaccttgtcctcccaaagtgccgagatcacaggtgtgagccaccacccctggcccaaaaattgctcattcttttaggaaactctggatctcctggtgaccccaaattttaaataacttgtctaagggtttttctggttccttgatttcattttcctcttttacttcctggaggtttttagtagtttcaatctgaagtctcactctctccattcttcttcccgagttttctcctgggattctttctgctgcagccatagggcctaacccagggtccgcagagaaccagcttttacttcctttgccctagtggaacccatgagagtcagaaggtgcccaagtgtggaaacctgtgtgctgctctctgctgggagtctgttagtttgatttttatatgatgcttttatatttcaaataagaatacacactagtttatcgttatccattaagaagaatcactttgagaattcactttatacttttattttcttttgtactgttttgaaacagaaatgtaggcattagacttcctgggcggcagacaaaccaaagagcggaaattcatgtaagttatcagatacgtttaagcctctcttttttgagcattgagtatgaaattatcaaataaactaattctttttttttctacctatacatataagatatttgaagagagacgggtttaataacaattttgaaaaataggaattttgtagaaaaattctaaaaacttatttcaaatagatgtctacacaggagaattgtatgtatagtagtgtttcatacagagaatataatcagtacagaggggatgtttcaatttcgaagtacttttgaactttagtaatgtcagagttgaacattttctgtagcatgactatcgacttgtcttttcaaggcagcctgcaaagccattgaacaagcaaagactcaaaacatcaataaactggttctgtatacagacagtatgtttacgataaatggtaagctttcacatttgatttcttctgtttttccagtaactgtgaagggaaattggtaggaggtgttgtaacagggcaggacccaaatgggaacggggggatgacattggtttgtcaggtaccgagcaaagagtgaggattttggagtctcccttctgctgctctgatgttttccacatgcttatttctttgccaggcactggagatgcagtcagaagtggaagtggctcttacttctagtctgtgtgtgtataagtcacttaagatggcgtgttgactgcttctttgggaaatgccctgaataggagcatgtaggggatgcttacgaggctggggaaggctcctgggagaaatgacatcttaagctgacagctgtaggtagaatacaagttaggggaaagggaagagaggagggtatttcaggctgtgccaaaggccaaagcaactaaggccagctaaggaagtgaagagtcaaggatggtgactcagaatacaagtgggatcaattataagaggtaagactaaggaggtgaaaaaggcaggacactcaagattgactcaccagtgatcgtgcatttttgtaggtataactaactgggttcaaggttggaagaaaaatgggtggaagacaagtgcagggaaagaggtgatcaacaaagaggactttgtggcactggagaggcttacccaggggatggacattcagtgggtgagtatcttaaatgttcatgtcctatggccattatgaccaaataagctaagtttactagagattaatggtttatgtaagtggtttaatgacataacaatttccatgatattaatatcataatgtatattacaacgtatttgaggctgggcgtagtggctcacgcctataatcccagcactttgggaggctgaggtgggtggatcacgaggtcaggagttcaagaccagcctggccagtatggtgaaaccccatctttattaaaaaatacaaaaattagccgggcatggtggtgtgtgcctgtagtcccagctactcaggaggctgaggcaggagaatcacttgaacccaggaggcggaagttgcagtgagctgagatcgcgccactgcactccagcctgagcaacgatatgagactccaagaccccgtctcaaaaaaaaaaaaaaaatatgtgagcctgggctcagtggttcacatctgtaacccagcactttaggaggcccaaatggcctgactacttaagccaagaagttcgagaccagcctggataacatggggagactctgtttctcgaaaaaataaaaaattagccaggggtagtggcacatgcctgtagtctagttactcaggacactgaggtgggaggatgacttgagctggggaggtcgaggttgcagtgagccaagattgtaccactgtactctagcctgggcgacagagtgagaccctgtctcagaaaaacaaaacaaacccacccacatacacaaatttgattattttccttatcatacaagtaatacagttttttggtttggtttttgagacaggtctcactctgtcaccccaggctatggcgtgatctcattgcaacctctgccttctgggttcaagtgattctcgtgcctcagcctcccaagtatctgggattacaggcatatgccaccacgcctggctaatttttgtatttttagtagcgatggagttttgtcatgttacccaggctggtcttgaactcttgatctcaaacattccacctgccttggcctctcaaagtgctgggattacatttgttttgtgtcacttcctatatgtttttgttttatgacaaaaaggtttacaactaaatcaataatcatgtcaaacttttttttattgttttgagatggagtctcgcactgttgcccaggctggagtgcagtggcgcaatctcggctcgctgcaaccacaagtaatacaattctagtgagagtgtcactaggcatagaatacacaggcagtgtggtttgagggatgttctacaatccttatattttgttaagaacacgaagtaacacccaacctgggcacatggcattactatgacagctgtatgtcaccctgttcatttctttggaatgcatcataatgttaaataaaactatcagtgtattttgtttcaaacaatagtaaggttgtatgattaaagccttggtaatagaacttttattccaagatggaagcactttttaaaatcatagatcatgtttattaaaaagtttttttcaagcaatagagaacaaattacactgcagccactgtctcaaccctgccttgttctgccttcctggaaccactgataatagtttggtagcctgatgtgtaaatttgctttggcaacataaatgtaaacagtggttaaataagtacattatttctgacagcactgcaagggaagcgtgtgtgtgtgttgcatacatatccgtccacccatctgtacatacatgtgttttgcctggaaagcttatcaagtcccattgataagtggggaggaaatagcaacatgaacggtaaaatccaatttgtgaaaaaacaaaatggaatgttcgtaaatcacatccattgcgtaaacgcatgaagaatggacagcgtgctgttgaggatcatgtctggggagaggagcgttgaagttgagcttatgctgtgcagtctgttctgaatggttttttatgatgacaatatagtcatgtgttgcttatgtaaagatgagtaaaaataaaaggaaaacatttatcttaacagatgcatgttcctggtcattcgggatttataggcaatgaagaagctgacagattagccagagaaggagctaaacaatcggaagactgagccatgtgactttagtccttgggagaacttgagccagcggctgtcttgctgcctgtacttactggtgtggaaaatagcctgcaggtaggaccattgcagtgatgggcagatgcgtctttcacacggaatcaggcacagtggccttctgtgacatgtgtttataaaaaatggttaagtatataataaattgaacatctttgagattggagaattatgtgagatttccacattatgtttactgggttcaatactgtccttgcttgttttattgcaggcaagcaaggcaaatggcctaaaatgctgtggcttatattttgataagaaatcaaaaaaccattggttaaaagatgcaactcagaagtctggaagtattctgaaagcatccatttaccgtccagttgacaggtttgagtctcctgcttgtataggtgacttgtgcccatgggtacattaaaggaacatgctgcccagggcctgggcggacagctcagtgggcaggatgtgtgctgggtctcagccccatgtgcctgcttgctgggcagttagtatagggcaaagcctgcctgcggcgaccctggctgctaggccattctctaggaacagctgcgactcataaagaccaagaagcataaataaactttcaaaaatttatttggctctttcgttaaaaactgtgcaaattaaaaaaaaaaaaaaaaaagtaagacaccggctgggcacagtggctcacttctgtaatcctagcactttgggaggccaaggcgggcagatcacttgaggtcaggagtttgagaccagcttggccaacatgacgaaaccctgtctctactaaaattacaaaaattatccaggtgtggtggcacgggcttgtagtcccagctacttgggaggctgaggcacaagaatcacttgaacccaggcggcagaggttgcagtgagccaagattgcaccactgcactccatcctgggcaacagagtgagactctgtctc

SEQ ID NO: 38384 - DNA, 13558 bp, Homo sapiens; identical to SEQ ID NO: 38383

SEQ ID NO: 38385 - DNA, 52649 bp, Homo sapiens
gagcggcatcactcgagcccaggtcccagccaccaccactcacagcgctcggcgttcaggaagaggagcagcagcggaggcggctgcttcagcggcgggcgggcgccagaaaggtagactgagtcccagggagctgcgccgctaacagcccacctcctagccccgggctacgcgccgccagcccagtaaccccacttttgtgtgtcctcccaggccccgatcgaaaagcctgggagggccgccgaactacccccggagggaggagccagtccgaacccaaggcgccaccgccgcagaagcggagcgaggcagcattcgcctccatggcccactcgccggtggctgtccaagtgcctgggatgcaggtgaggaagcgcaggccgcccccgccgcccacgtgactgcttgggagcccggtgcgccctcggtgctgggcaccggcgacaagggacggccccagggctcccctgagggcagggccggtcactatggccaggtgacctgggagtagggctggaggtgtttcctggtgtgtaggctaggtagtgctcttcgctgggaaggcgaggcgggactggagcgcgcaactaggtggagattgagggcggttgggggtataaaaataggccagagccacagacacctgcgcctgctgagcttggcacggttggggatgggggggcggaacttaacctgggagagatggaagtgccttggaatttgtggggtataacgcgagtagtgagtgccctacaccccccaccccaaacacacactcaagttggggcggggcaacaccaggggtggcggcggcggcggcttgaattgggctcttcctgtgtgcgtagggctaagagagaggtgacctctttctccctttcggtactgctgcttaagggcaaagttgtagcttgctccccgacctagcccagcccatagtgtggcgtgagaaatgctggttctgttcagagtcactgaggtgatgacttctcagccccctccgtgcctttcccacaagatgactgttacatgtggttaaaggaagctttttgtcttggacaagggactactgcatgggacccaacttgttactcgaagtctacccagcccaaccccctcccattatattttcattttattaaagataagctatgtcagaaaactttttatgctgttatgtttttaaatcggtgcattttaggctatctgctaagtgttatccaaatttactaactttttaaagcattcatgttctatttttttttcctttgctagatggcctaaacaacccatttaggggctaaaaccactgaagcctcagtctttcatgatctaaaatgtgaaaacaaacttttttgaagttcaaaaataaaatgtttatagtaaatagcttatatttctagtagaaatcaaagagctgtagactggggcctcaatttacttattgatacatggagtttttttttttttttcagtgttctcattttatgaatgtccacaaaagtgatttttaaattctttcccaaaatgggatttatttgtgcacctagaactcttggtgtgtcctaaacaccagacatttcagctgcatttagggcaagtctgggttgagtctcaggaagttagtgtatattaaataaagagagagagagaaagggaaataggaaatagtagggcttaaaaaaaaagattaatccactcaagccttgcaaaatgccttaaactttcttcctctcaggcggcctcccctctccttccctccttcttttccccacgcaccctgccccacaccccattcattcagttctgcctttgattgtatcaagggaattcatagttcacaatactaagtacagttttgctgtttgatctgggaaaaagtgacattttctcaccgtgctcttctttccattctgtggagagtaaaacgatgcacatgtgaagtttgtctctgagggtctccatgcttctcgctccattgtgtgcgcgagcctgcgtgtgtgcgtcagcagagtgagtgcctccagttcatcaagtttgtgattctggggaactctgtgtgctgaggggaaaatggtttctgatttttattttatttgtcttgaacttattgaatttatatggtttaggaactgcttgctgttcagtatttctgattgctccctgcttttaattatctgagttgcctatctcttgaatttttaaatcttaattaatgtggattcgaatgtgaatcatatactttaaattacaaattctgcctttcactctgtgccctctgagttgtgattactttgtcccacctaatttgagtagggcaaacatctcaacgttagcaaagaagagaggaatcttttttttttttttttttggtcattctcttcatcttaatgaaatggtaaattcttaacttcttatttccattttatttctaatgtagttcttaagcactttgtgcagcacacagttttttccatagttgaaaatgtacaataccttaataataaatttgatagcatgcagtgtgactcttgaagctagactatttttattattgttatgtagcaaaatattgcagatgagatgcagaaatctatcgtgagcttgtaaaattctcctagagttttatgaaggcgttaggagcaacttttagacctttagaaaacttcagttagccatgtgttcttgaaattactgtatagtgtttccacaaatcagggtgaggtagccgaccagcctataactttttaacagtttattttagagaattatgaagattgatgggaaaaatgatttttccagaaatacaaagaaaattactttatccacaattattttctccctctgaggagagacgtgaagtagaagcccagctacctgttctatcacttaagatttccagcattcctgactttcaaacaaagaaattgctgttgccactagtttaaaatagaaaagaaacttggagtgaagaaagaaaacccaggatttcgtccagttcaaactcttccttatgaattagttattcaaactcatattgttgatatttcttaatattgtggtaacgaacattttttgccacgttacaccaaatgttgagggtatgaagttttttgtacttaatttgtgcttacttctttagtgtgtaactagaggaattttccataccagtagctgaactcttgaaaatatttaaagtacaacttaaaaaaaaaccaataaacctgtttctttccactcaaatatttactctttaatgattcaaaccctgttttctttgaagttttcagttataaatcatacttaagtttaagatatttccccttagagcctacaatagtatttttgaggacaagtttcatttagaatattgttgattgttaaatctttcgtaagatgtaggtggaagaataaagttaaatgttgagttagagtactaaatgttatgctttatgctgtgcctcttgttaaagaacttttaaagcttctgctaaagaactttaaaattagccttcatgtatctttaaatatgaccaaggtggtacagtttaaatctagttgtcatttgagatgagaagtagaaatgaagtttaacgattaatgatcactttattgaagacttttatctaagtggtgggaaacactgcccgacattggtgaacataatcactgggttctgggaagcatactgacgtatattacatgttccacccttaaagatcttaaaatcttgttgagttgttaaaactagcacatgaaatatcaaataatgcaaaatctgtgaactcactgtaagtataatagaagtttctcactggaagtgttgaaggcttccagaaagtaagctgaccctaaagtcttgttaggatgcacactgggcagggcatttccaagcaaggaaaaatccccagcagaggtagacagactaggattttttgactttacaatggtactcacacaaccattctgtttttcgctttccatacagtattcagtaaataacatgagctagtcaacactttgttataaataggctttgcattagatgattttgcttaactgtaggctactgtaaatgttgtgaacacgtttaaggtaggctaagctatgatgttcggtaggttaggtgtactgtattaaatgccttttcaagttacaatattttcaacttatgataggtttattgggacgtaaccacattttaagtcaaggagcatatgtatacaatatagataaggaaaggtgcactgcatttgtgagtgcatgcacacacacacacaatctttgagaacaggataaagtcatttgggctgtcatagagaattcctctagaaaaatgatacatgataaggtcggaaaactggattgagtacagatcatgattgtccttaaatgccagggaaggattttggcctttgaactagccattaaacatttctgagtaagggagactcaatgtaccaagttatatatcgaaagagaaatctcaaaattggatgaatgaatcaactggaggattgagaggggaaggcagtttgatctacagaggctatttcttcttttttaattttttttttttgagacacggtctcactctgtcacccagactgtagtgcagtggcgcgatcacagctgactgcagccgccacttcctgggttcaagcaatccacccatctcagcctccagagcagctagaactacaggtgcacgccaccatgcctggctaatttttatggttttttttttttttttttggagacaatgtttagtggttgtccaggctggtttccaactcctggactcaagcaatccatccacattggccttccaaagtgctaggattacaggcgtgagctactgcgcctggctacagaggctatttcaatgggtcaatcatagttatacagatgcaatgggccttccatggacaggttccatggacatatgtttagtactatgaagaaaaaattaattaccaggcttaataattagctagtttcagaaggaaaagttaaagactgtggtgtttaataggagggaactgggagacttatgatacatctgaaagaaattggaatgtagtggggaagagccagatctggtaggaagttaaggatttctgttctagacttgtgaattttgtggtaacaatgggatgacaaagtacatatgtccaataagtagttgaaaatgtagaactgaagctttggtcattcatcagatatttactgagcatctactctatgccgggcacttcacttgaaaatgaaggactagagacatcaaggagggagaggttcataatgccagaaagaatatgtggaagtgagggccctcatgagacaggaaaagtaaggttgtaagaaaagtaagggttgtaagaaaagtaagggtgtaagaaaagtaagggtggctttaagatgtatgaaaggatgagaacgtgtgtcaagttagagagagagttaactggggtgggggatggggggattctttacttaacagtcatccggaaacctacattggagaaagaattcaggttggtaccagagtccagtatgtggagttcttacctcccttacacctccctaaggggataatcagatttgcaatttgaggttgaaagcattgctttgcattggtgaacccgaattattgtccttgttattgagtagttaatgcagaggtgttgaatatgctaatgataatggcagaagaccagctggaacaaaataatcaaagactgttagctgagagaaggcggggttagttagaacttttgacactaggggagtagggactgtagggagaataaacaggaattgggtatgataggacatgtgccttcaacagtaatcagagtttagaaatggcacttgagtacaaaggtccgtcatcatgtacttctcttgcttgagtcacagcaaatgagagaatataatttagctggtacttaggaacaattgaacattgtgatattgtattttttattctgcttttcatattcagtgaccttgagcaaatcatctacaaaatggggaataataaaagctgcatttcctttgcctcaatgagaggttattaggatgaattaaccatcatctgtggagttggagctcctttgtaaaaggtgttatgatgtatggggggcagttcatcctgcaaaacaatgcttggctaatcacatgaaaacactgccattatctcatctctctcctgcttgataacccacatttttcttttgaaacccaatcaccaccccacaccaccccaatgagacacaaagccctctgctcagctttccatactttctgttatatggctcctctctgtagatctatacttagttcccactacatcccaacaagaaatccctttaattctaccatgccagtcacagttcaataaccagtgattggccaaattctacctgattttcaaggtcctccatcttagcttcttcatgaactctctctgaatgtcccaggctatagaaatctcttctatttccaagcacctattctgtctattgtcagtagtagacagtcttgtccttaatgtattatactgccttagattttctctaattatatatgttatacttgcctcccaaatgaggttgtacatttcttgaaggtggggaccatgtatttcacttttctttataccattaggtatgaattatatgtaaaatcttggctaatcactatactgtacagtggacttttctaactgtttaaaattctgtttctttaaaaatattgtacaacacctgaactctgtacaccttaaagactaatttatatgtgtacaatgtagactctatacttatttaaatgattttcatgtattatgtataatatgtctagcaaaacattcttgtaactaatcatctgtccacacacactgaagctttcattctcttgtcttccacagactttgagagaaaaatgagcttcattgctttcttggtaaccatggctgatttcaggcaaatttgtttctcccctcatctcttctccttttctccttccttctacttgtactttcccatgactcttcagggtcctctcactggtgatttggacctatctacctcttgtttcttccctcttccctcccactccccaaaaaacaaacataaataaaaaactgttttacttcctgtctgaactgtcacattagaaagaatctgataatttcactcacactaagatgtttttgattaatggctcagtgctttacttctccatggatattcacattttacagagaattataccttaagaaatggaaatctaatagtagaatttcagacagcttgatagcagtttttgacaaagttctgtgttctgaaagagtggtggttctactgttttttttttgttgctagaaaaatggtgttaggcaaacaaaaaataatagtattattagctatagtacaacaaactccttttcattccttgtaattaagactcgaagaatttccaccacaggtacatgtaaaacaatgtctctgaaggagtggcagaatgtaactcattttaaaaaaatcaattaaatacacagaactaaaattttgaccccttctttttttcttttattttagttgacatgtaataattatacatatctatgggatacagagtaatatttttttttgaggcagggtgtcactctgtcacccaggctggagtgcagtggcacaatcacagtttactgcagcctcaacctcccaggctcaggtgatcctcccacctcatcctcctgagtagctgggattacaggttgtcgccaccatgcctggctaatttttgtatttttttgtaaatttggggtttcaccatgttgcctaggctggtcttgaacccctgggcccaagcgatcccccatgcttggtctcccaaagtgctggattacaggcatgagccattgtgcccaaccgagagtaatatttcaatatatggatatgatgtgtaatgatcaaatcagggtaattaacgtatctatcacctcaaacatttatcatttttttgtgctgtgaacattccaaatcctcccttctagctttctgaaaacatacaataaattatggttaaccatattcaccctacagtactgcagaatagaatttactcctatctagctgttaattttgtgttagttcaccaatctgtccacatcttcccctcctgcttcccttctcagcctctaatactcacaattctactatctgttttctcatatgagtgagaacatgcagtatttgtctttctgtgcctggcttaatataatgtcctccagttccgtccatgttgctgtgaataacaggatctcatccctttttacagctgaatagtactgtcttgtgtatacataccacattttctttatccgttcttaaccctatcttctgtgcatttcttacttggtcattcgccatttcagactaaagtgttagatggcaggaaccacatctttgaattaatgtttgtagaaatcaaatatttattgaagatattaactaatttctctcaatactcctataacatagagtgattctgtaggaaaatgccttcaaatttggatttaaacattaaactaagggcacattgacagccaactctacccacgatcccctttgttgtccctccctaaaaccacatatgacttaggaaaatcacctgacgcgaacattcagagaaaccagaaaacctatatatggaacatatcctgtcctccattcctgcctgcctctccccaccacccctcactagcttataccttgctggggatagagctacaggatgcatctaaaaactccccctcaggcttttctggacttgttccagccttcccctgacagcagcctgctggcctttcttttcctccatttatcatagcatcgtggatgagagtgatttgtgtctcaaaatatcaggttaaccattggtatgtcttagctttggatagtctggcaaaattagaacaaaactgtggttcatacttcctgggccccagagtaaacaaaattgtagattgcttagatgaaagagttgaagatagtctaattatcttttttatatgttcactttctcttttttggtcaagcatcttaaaaaatgtgccattgaagaaatcgaagccattgtgtttttgcattttccccatgaaaaatgtttacagaaaaagttttcagcctttctttgtgatccttgtaacagagattgtgtgttgtcagcagtgttttaaatttttccctctccttctattacctcttaaagaaaaagtggggaaaagaaatctgtacaagtacaaccctattaacttaaaatacaaaggactgaaatgcattgagttcaattcaaccatcaatggggtttttttcaatttgtttattatggaacaatagggtgtctagccaaagaattaatggttgctttgaattatggaaaaagcttcccagtatcaacttaatgaagttttactgaatttgaaatccacaccacactagatgtgttaggaaatttctaagcatgctagtgaattactctaccaggtttcaatagtgcctggtaacacaatcctaggagtgaatttttggcaggtggaggaaatacttcaagaacatctagaagcatccagatttttctttgaaaatgcatttttgagttgctctgttagtccctttttaacccttcttcccacccccagctttccactaaaccatttgctttgggacatatcaatttacagtatattatattaagctaggtttgactgcttgatgcactatagtataaataacagagcagtgggtggtgggggtgggatgggcaatatagataatcaggtggagcataagctgttattaatgcaagacaatttaggggagctgagccaatagaaaccataaagtcagaatttcttcccaaagcctctgcctcatcattatcgctgcccactagagctgggaaagtttctaaactccctgatctcaatttcctgccgcctgccttaacttttagcagaagcacaaaagaaaccaatcagcaaagcatgcacacatactactaagtatggtgacagaaaatagaactttgacctgttgtggttaaagagactaaagtcaatgtatctgacagcctcagggaaatacgcatatttcaaatttatgttttttaagtgctactgaccccataggaagaacacttggcaaactcattaattaggatcctgtttgagtttctagttttagttcaaatcctttgtttgaacttagtggtgagctttcttatgtgcttgtcagtaaatggtaatacattggactttaccagcttggacagtggtgacccaggttttatgtttttacacacacaatctacatggtttgatttaagccagaaaattattagcagcaaagtttggaaggcctgctttgggtaggacagagtgcttgctgtctatctttgaaatacaaaaaatattagagagtccttgagctcaagaagtttatactctaaccagagtgactagacacctacacatttaggaatctaacaatgcagaacagtagtaatgaatcccaaatgagatagaatctgatgtagaagcatccatcccaaggaagactggagtaagaaaggaaactatcatttatagaatacctttctgctaggcattcgtgttttgctactccactaccttgcttctcggcaggatggccttcaatagacttttaaaagagagtatgtatacatatgtaactaacctgcacaatgtgcacatgttccctaaaacttaaaagtataataaatacatatatatatatatataaaataaaaaaataaaagagagtaggaggcaagcaggagaaaaggcccaaggggacacacacaggctccttgtataagagagatttggtgtaggtacctattggtatgaattgtgttagggctagactgtaaagggccttgaatgccagaatgagacatttattcttttttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcacctgccactacgcctggctaactttttgtatttttagtagagacagggtttcactgtggtctcgatctcctgacctcgtggtccgcccgcctcggcctcccaaagtgctgggattacaggcgtgagccaccgcgcccggccaggagacatttattctttactcagtccataacaaggaggtttgggtttttattttttatttttttagcaatatagtgaaatgatgaaataacattgtttgttttggaagattgcattaggctgttggaaacctaacaggctaggctggagataagggaaggcttaattgataagggtttaatctagggcagtgatggttaaactggagcatgcatgggaagcacctggggggcttgtgaaaacacagactactaaaccttagtcccagagtttctgattgaatagatctgaggtgaagccggtgaatttgcatttctcatgagttctcagctgctccgccaatttggggagcactttgagcaccactcaaggatgactttaacagacattggcgaccccttaaatatgagaagaaaggaaacatgatgagagagtagagtcagagataaggctgagtttggaagaaaattggtacattttggggaatgttgaatttgaagtgctggtcacatatccaagcagaggcaatcagtaacacgtttgttgaagagaggagatggagactggcgaatcttatgtgaagatagtagaggaaattgtgagagatgaaaacaacaagatttccagttatctttccaagaagctgaactcaattttgtgttaagttctgcagcttccaaaatctcatggtcacccatgacttctgttttccttaatctaggcaggtttgcgacttagcaaacacccatcctcatcattatatagttatcattggcccatgtgtgctgttaagtaacctacttcagtttttattgattgatttaattttattattgttatataattttattataataatttttacaataattttattgtttattttgttatatttatttttattgttttggtctggataagccccttagatgacaaattcttacaaatagaacctttctgtggaattatgttaccatgctcagtatggttaggtgtttactgtagtaaacagctcattaatgcttttatcttcaaatgcagacccttattaagaacatgaaatctgtttatgcttatagttgctaaagtgcaacttggctaaagtgatataaatggcagtatcttaaatgccagtaagtggcaatatttcccccacaggtagagatttttagacctattattatgtccccccctcaaaaaaaaaaacaaacaaaccagacttaatagctctggctgcatacacacacacacacacacacacacacacacacacacacacacactcattcacagtcctgacgtttcaaagccaatttgtatttatatatgtaaattcctggaagggagaggaagttacttctgaatcattaaagaaatatcaaaccacttcctaaatggcctttctgctctctgaaatattctctatacctgtcagattcatatattatcgtttgccaacaggtacccagtaggaaagctctgagtttagttcaaacaaaggattagaactgaaaataagagaagcaagtagggcaacaccaaacaatgtgagcaaacttgatttacctacctcattcaccaactttggacctaaatcacttttcaatttctaaaatgaacacacaaccaacaaaaacgaatccatccttcagaatcaaagatttgccaccaatgaggatgtgcaaaagcatgtgaagaaatattctcttaaaaaattttggctgggctccgtggctcacgcctgtaatcccagcactttgggaggccaaggtggatggatcacttgaggtcaggagctcgagaccagtctggccaacatggtaaaaccctgtctctactcaaaatacaaaaattagctgggtgtattggtgcacgcctataatcccagctgctcatgaggctgagggaggagaatcacttgaacctgggaggcggaggttgcagtgagctgagatcacaccattgcactccagtctgggcgacagggtgagatgctatctcaaaataataataataatttaagccgtatttaattatcactagaatccctaagcgacttgcttcctcttcagggagttaaatttatttggatgtaagaatgctgatatgtttaccttataccttacacttcattgtgaggatttgctggggaaaatgatagatagataaatgggtagatgaatgaatgtatatatgcaccctcaatgtgtattgcacatgaagtatattttacatttgaaaatacttttaatctgtcttgtaaaaataaggcttgacatttgcctatagagtttttaataaactatactaatagtagttacaactattttttaaaagtagaaaaatgcattgtcaaaataaaaatgagtaacaggatggtcactatgttcaaggagcagaaaaatatcatttgaaaatgtcatttaagaaggtcggtgaattaagagaaatcaatgtaatttatgtaaaaaatatgtattcagtaaaaattgtggtgtccatggacttgctaaatatttttattatatgaaaatgtatggaaaatatgtagaattctttacctcatttaaaaccttgtttactggaaggtaaaaacctgtgagtatgtacctatgtctaaatatataatagtattgtcaggattttacacatgatgcacttttattgtaacacatgttgcacgtttattgtggctagttctttctacctttgatatttaaattcttagtattcctgaagaaactgaactcacaacagtctgtaacatacagagtacagacaatgggaaatggcttttaatgaaattcaataccaatattaagcagttttagcgaattaggattgaattgaacattatctaggattatatttatcaagattttcaattctttgcttaatttttcctgtagaatagttttacagaaaatcattgcattaaaggaactgcttttgatatatattaatttgtttacctgttagtaaaatcagagatatgtgggcagtaaacgagtgacttctacttcacagaaacttgtcatcattgtctaagctcttattttgaagctcaagttgttataagtacttaacactatagattctaagggatagagaatggaagggaccaggcattgaattctgtttctgtgacaaacaaagtcttgtaaccggagagctgctttttttttttttttttttttttaactatttatctcttcatgaaaaatggtgactgtcactgaaagatcttttttactctgtcacaggcttctcaaagggcacacaaaatgaaaacgtgggattcaactagttaaataatgaatcaatttcgaggttttagcataggtgacacctccatggtcgtctttttggactgtgatttctggtaatagcaagtgaaaaaaaactattaccgctgttgctatggatcttctatctgctgaggttcaggcatcgtttttggaggctgcgatgtaaaccctgcttagggaaggtagaatttcataataacagaggattactgctgcctcatgagtaaacagaaaatgtaggtgagggaaaaggtgttggactctggaagaacagaaaaacagtatttccaaggaaggggaaatcctttgctttaaagattgagaattctttctgtatttttttagaatgggaaatttctctactttctgcagagaggagaaaaagctaacagaaaaggaaattggggaggtaatagtcatttgttttttcttgttgcgtgtgagttttgtgataaaagtgacatttacataattaatttgctatggcaagaaaatgtctaaagagtctttttcgttggtagaaagcttgtgaaagatcagggaaaagatctaacataacgggaatggtgattacagctgcttttctatttaagatgtgcaattttggtagcatgtgttttgggccaatacattgtttctagacacttggagtcattttgggtggcctttttttttcctttggtagccaaaataaatatttttcattaataaagaaagatgccagaatatctatcacttgattttacttggctaatttgaactgctattttgtggggagcggggggctaaagaggaggctcactttaaaatgactggacttaatatcattgttatttttccagtaggttctggcattaaaggtctcccttggggaatgattaaaacagttctgtggagcatttcaaggctgagtagcatctcatatatactctaaaataagtttgcctaatgactttttagcaccacttgatttatgttttggctaagagttctaaatagtagtagtccaattacttttttctaggaatatttacagacactacatactgtattgtttacattattgacttttaactttacagtagtttaaaaggtgtaaatgtctttatgcttaaaacaaacaaacaaacaaaaaaacactgttttctgccactgttttctctatcctgttccaggatagagacagttctctccctttgtccacccacatgcctgggttctgggtcaatctgtataactagacgtatcttaatttgattactctggggtgtatttttgatggtagtgcatcatgaaattacaatataggtgtgatcttggttgaaagataaagtacattttagatatttttaaaaaatttctttaactgaaaagattatctgttaattgtgaaagaatactcttatttaatatggccaagtggttccagagcttgatactttatttttcttttcctgataggacactaaatcatttcctcctaactactagaatgaataaagaatgtagtgtatactgttccactatactgtgaaattgcctgtgtgcctttctgcaaatgtaaagtaaagagattgcataggtaatccttaagctctaaaactgagttttggagattctactcaggaattgggactaggttattatttgtaaaagacagcatacacgcaacattttatatattgaagggatcaggtactcattccaggcaaattttgaatttgatgtaaataatttttaactgaagcaatgaatgtgtaattatgcttttactgtgtgtatttaattttctgctaagaggtagtaaggctataatatttggcttatgctttggacaaaaggaaagttctttgaaattttgaatttttaggttctccctggcaaatattttgattccttgtatttttggaaaataataatcatctaccatcttccagtagtgcttttggagcttttttaattgaatgcagcctttctcaaccagaattcctcatctgaaccataaaacagaaaatgattttgagttactgtcttctcaattctctcaagaaggacatataaggaagcccaattctagatgcaccggagagcagttaattttttcatataaggattctttagggtagcagtggtcaaactacatctaagggccaaatactgtctgtaacctagtcatgtgaggcctgcaagctaaaaatattttttacattttaaaagagttatttaaaaaagatgtgacagagactcagagactgtaaagtgtacctgacccacaaagcctgaaatatttagcatccagcctttacaagaaaggtttgccgatccctgccttggggcattaagcccgactgagaattgctgatgtaaagaaaggaagcattttatagtactttcactgaggttgtggatatagtatgacaatagaaaagattttcactttactaaagtaactgacttgcctattggttccattattgtgatgcttaattcaagaaaagccctcagatcagagtaaataggcagatatgtttctgtttgctttttagagatacactttaaccatggaattacatagaatgttgtattggtaatgacaatgaatgataaattacatttatatgtttgtgtgcagatacattttagtatttttctcggtttctagagaaagaaaataaaaatgggagcattttataaagtaatataagggaggacaggggagaggcttaattgcttttatcagtatttaaaattagatggccacatctattagagaaggaaagtgaatagggagtgttaagtgtcagatataatcacatttgtttcctccttgtactgagtaagtgtcttcaccctacaattaacatctcaggtagcttgtctgaagtaaggagaataatacttaatcaaaaatgcattaaaattattagatcatagcatatgaaataatcaggctttaccaatgccacttgactacttgatttagtgggggaggtaccatccaccataaaacacgtattggtatgtcacaattgtcaaaggaatgaaaatgaccatcaggcattatttgtaatttgctgctgatttcctttatctccatattcagttaatcatgaagttctatcagtattttttttccgcaaaatatcagacatcatctcttcttttgtcacactattcttttgtcattaagtagactcaaggctgcgtgtacagatgatgcagttacttaaaacacaacctttattttttcactcatctgctgaaagctttcagcggctgcctactagcctgaccagaaattccaaggaaagatgagtcaagccaggcttgctgaggtggtcaggaaaggctgtactagatagctgagctggctttcagactgggtgtaaataagggaaagaaagaggagaaatgaaattagccaaggcaagaaataacaaagggaattctaaggttgcgttttccaaaatgttttataagtccttttggggtaggcagtgaggatttgtttgatgaatagtactttctccctggttagggttgtaaaatgatagggtacaaatgaactcaagttgtaaattactgatcttttagggtagacactgttccaatcattttaattacttagaattgctcatcaagcaatttaagaactaattaagaaactttgtcatttatctccatcctgaggttacttatttgtgattactctccccactccacccccagctagaaatcactcagtataaaatttaaaaaaaaagccaagtgtttcataagggtcacttccagttctaaaatcttactgcatttttaagttcctaaacagactatatagcatttttttttaaggaaaaagatcaacttttgtatatgtattcagatttagtactagatgttgattatcccaattggagaattacagttttgttaaattgatttctaaatagacaaggactataaatatcaactaatataatgctttatatttatattagcaaaaattaacttagtcatatctgtgttgagaacatggaaatagctttatgtttgaaatgatatttgttaaaagattcaactcattagtagatatctcataatttcagtagcattttctcctctatttgaacatttaatttgtgctttggtaatttcagcaatgtcagcacagatcaatgggtgtaaaaacgggtgaatttgtacctctagagatagggattaacatatttacaagtgctattgacaatggggacaatggggtaggatggagataggtttcagaaatcttagttcaagaatatttggggaccttcaagaggagattaactcacaacaaaaagtagaagagtcttctaaactgaaagtatttgggaaagtgaaaatatgacaatatttagtgctttttccccaaaatgagtggtattccctatgcaaaggaaagggaatagcaataataaaattgtcactgagattgctgaaatctcagccctgtattgttaatgtaagctactttctcatatatattaactgtatcgtggtgtacagtatggagcttttatgctcatttgtaatagttcttcttaggttaggttttcaggtacaactatttcacacatacacacacacatacttaccattttacttggtttttaagtgtattcttatttattaatgcactgttccaaatcttttaaagaattagatagagtaataaaaactaacaataagcatttgtttagccttgcacacatatacacacacataaacacagactttgatgatatttttcactttgggaaaatgaaaaggtgattattgaaaaattagagaccattcttttgttcaataacctcctctctttttgccaagattaaaatcatttcctattgatgccatcatgccatcagtatcattttcttttgatcataaaatgttaaagccagcaggacccaagagataattttccctagtcctacgattccattgggtaactcttaataaatactatttgattaaattcattcagaatatatatttgattaaggaggaaaatgttggagggaaattattctgcagccactttctcattaagaatgaaaaggtaagtctatgtaaaattccactttttcaatcagtgttaattttctaaaagaactcatggtgttaataatttagtgctgtgcttacaagcttcaaacatattgattttaattggagttccacatctagaagaaagataggcagtgagcaaatcaattttgttttaatccaatgcattttaataagtgtgctaaaaattcaccataacattacccatgatagttcgatatttgctataaggggctgctgccttaaattctaaccaaaggcatttatttctgaaagtactagaatgacatccttttattttccctctaatatggatagcataaaatgaggctctcagcatctgtcacttcaaagtgccctgtgtgggtttggttaaataatggcctgaataaattaggatacctgttttatcattcatgtattaacagagtctttgtctttctttcattgtatggccttttccccctttccaaatgaatattttatagttagggcttgttatcaatcccaggccatatttatgtaacctcctgtttagtcagtaataatctctgtaattttaacattaatgctcctggttaaacctgacgcctggttgaattgtgtatttctatatgtatttagcacaatgaaattaaaagaaatttacagcagagtggtatgcaaactgtggctcttcaaggcctctaatctttgcattagagtatgaaatcatcctggatgctccaggacatacagtagacatgtggttctggttaatagtgattgtagatgtgcttctagaatcagatttatatataccactgatatgcatccttgtgtatgtggctgctaccaactcttctttgagtatagctccgtattctttcgagaattgctgttttgcaacacaaataactgtctccagttgaaggaaaaaaatctcaaagttgtgacttcgcaaagtttttattatgttaatcacatgaaaatagggattgacttaaaatttcatacctatgttaacatccgtcagtttactgaatatagtctccctttcaccaaaagtcagaagtcaagttgcaaatgaaaagataatcacatgccaaagatttcattttaggagggaccccaggtaaataccctgcaaacatccaacggccatggtgtgtaaagggccctactggatactgtgaggatagctggcactgagtaaggcagagccctatccttaataagcctgctattgaaaatagaaagtcatggcaatgaaagagaatgcaaacatagtaaaatgtgtgctctaatggaggcacaagtaaagtcctgtgggagggcagaagatgaagcaatggattggttaatcaggttcccctagggggatgataaggcttgttttgtttttaattaaagatgctgcgattttcagagatggagaaggagagcaaggtattgtagactgagaaaatggcatgagtcaaaggctcaaaaatttaaaaatagagtcatttcctaatggatcactgtatttaagtttgtatgtctaaggtattacctactgaagcattgggcttgaaatatgttcagatatccctggaattttccctttggaaacttagtttcactggatgttcaaattctctctctctctctctctctctctctctctctctctcgagatctatatatatatatatatagagagagagagagagagagatctatatatatatttatatatatatagagagatctatatatatatttatatatatatagagagatctatatatatatttatatatatagagagagatctatatatatatttatatatatagagagagatctatatatatatttatatatatagagagaaacgtatatagatctacatatagatctatataacatctatctatatagagaaacatatatatatgttactttctgagtactactttatgttctgagtgaatttacttcacaactaggagagaaagacaaataaaactttaggtcctgtatgagctgaacttattaggtccttatttaggtcctgtatgagctgtatgaaccccttgacttcctccgggatagtcacgtgtatataatgggacatggccagtgtgaaggatgagaaatcagtctggacaatgactcattctgctgctctttatctattcttggtgtctaggcccacttcattacagtgttagagtgttggggcttgaatacggtctactagtgattttgaatttctcactggaacaatggcgtggtatataattttcatttgagctattgtgtgctgttataggcttggccacatgaccagtaccaatgaatccattaccttgtttcaaaactagggttggtgattgctagtgatgaaggaaggggaacaaagggacttggcttctaatacttcacagattcacacagcttcagagcagtaagggatttaaagattgaatacacctctctccctcatacagatggtgaaatcgacattaagtcactgatttcttgtaattttcaagataagcaaaattaagtcaattttttcctgacctctctgctctctttacctctgtagtacttatgagaaaccagacctcctttttcctttggaatgactgtaaggtcagagaggaattagctaaatgatgcaatggaatttgcatccagcatttattgtgatgatagccttgactttcggtttattgagagaagaatgtgattgtttgcaggatgtttccttccctttacccatggatataattaaaggtttaagggaacttcagatcccagagagttagtaaaaaacaaaaaacacaaaattagttatttcttttcacttaaaagggcttatatccaaagatgatttacctggttgaacaaaataatctgacgtttctacttttaattaaaataacaggaatgtgaagacctccatatttgtgaaatggagctaatgaaagtgctgcctattatgactttggttcttgcttgaggatttttaagataaggaaagttattaaatttattctcgttctttccatatttcatttttctttggaaaaatgtgatatgtggttaagtgacaatagaatcaaagaaatgtctcattcttctttactccattgtaaaatgaactgtcttacaaacatgtaaagaacagcattcttcacatcccagaatgtatcctgcttgctttcttgttcttttcctctgatctgagctggggtaaaaagaggaatgcaagttagcaggcagaggaagctcttttcctatcctctcgtgagtaggaggaattaagatgaaggaatattatcaattattcttttgttcttaaagatgaattagactcaaaattattagtcaggagaaactcctcaaactgctatgttattcatacgctatgtcaaaatcttttgtaataattttaatgaagttatcctttactaaaatatctcattctaagtatttttgctaatgagatgcatttaaaaataagaataataaaataaagagaagatgaaaaagtacctatacaattaattttatttctgccttatgaacacatttttcttgctgctatgcacaaaattgctgaaagtttaaacagttgccttaatagtatgaaataatactgtgtgagacctttgactttatgcttcaccattgagaccagggttggagtgctgttgcctcattcgtctcaaaactgccgtttaagtaggtgggtaaagataaggagtcaactgtgagttgataaaatgctgtctgatgaccacaaggaagcccagggttgatgtaatgacatatccctactacatttcatttatctcatttcatgcatgtaaaatctgggaatttgactgctactttatgttgcaaaggcaagttataataaactttgagaaagatgtaaaaatgtaagtataccataaaaataggtaagctaataacattttcattgtacacttagttaaaatattttgagcccttataaatatggaaatacaaatttaaatgactgtccacataaagaaatttaacctgaagccaaattcttcatgtttaatttgaaacatatacagacatacttaatttttatcttagttcttattctgtcatatgcaaaatacagtggagctaagtatttcacttcagaaatataaatcacagggatctctaaagaattccataaaattttatctgataacttgtagtatgaacctgaagttgtgcaaagtaaaaaattactctgctaacatcacatttttcaaaggttgagaaaattttgtggggagtttattttatccttctgattattaaagtaatctgagcatgcatggtcatttgaacaattctaggcctgcataaacctagcacaaaattaacaattgatgctaaatgttgttttttattcctggacaatttcatcaatttgtggggggttttaaatgaacagaactggaaaccttagtattaagggttactgaagtatacaacaaatcactgataaagctggaattggagctgttggattcttgacattggatcctatgggaatcatgatatggaatggcatcactactttatctcctacactctagaggctagcccattccagcctagttattgacatggaaaaaaaaatagtctgagaaatgccagaaagtcaagattacttatgaatcatttttctttaaaattgtaatatgaaatatttggtagttgtgcatacatatgagggccaatcaattgcatagtggttcaacaattattaaaaaattgcatcattttcaccaacatctttcccaccaaaccccaaccaccacagtctggttaccattctactctagttctatgaggtcaattttttatattccacatgtgagtgagataatgcagtatttgtctttctgtgcctagctttcttcacttagcatactgtcttgcaggatcatccatgttgttgcaaatgattggtaaaaggatacaaaattttagttaggaggaataggttcagaagatatactacacaacatggtaatataattaataataatacattgtattcttgaaaaatactaacagagtggatgttaagtgttctcaccacaaagataagaaatatagcatgtaatgcatgttaattagctagatttagtcatttcatgatgtatatactgtatatttcaaaacatcttattgtatatgataaatacatacaattttgtcagtttaaaaaattaataaaaattatatcagtttaaatatagaaaagtcctattttaaattttttcaattcttttaagtttacatttttcaaattctttaagcattgggatagtacagagtagacattagacaattgtgtgatctctttacgatggaaaataattttgcttttatagcaaaaggggttatagtttaaattacaaataaatcctagctgtagtgaaggaaccttagacataacagtcaggagatctgcgttcagatttaagctttgccactagttaactaccttttatctttgaacaatttgtaacctctccagggtatagtttcctccctgtaaaaatatattttggacaagtttgctaagttcctgttcatctcaaagattatctaattcttttaatttcaagagtctgtatctcttcttaatttctctaagacttaccattttaacataaatggccttaaattacatagcttccatttagtgatcctagcctaggacaaaacgggtatacaataaatgcttgttgctgatggtgatgataaagagttggattgaatgacctatatacatttccttccatttctaaaagcccgtgattgagagagcagccaattgtatatggattatatctggcacttaaaaaagatagtgtcctgttttctcgaactcagcactggtaagagttatacggctgttgacattaaaattctgttttttgtttgtttgtttgttttgttttgttttgagaaaggctctcactgtgttgcccaggctggagtgcagtggtgtgatcatggctcactgtagcctcgcccttctaggctcaggtggtcctcccacctcagtgtgctgagtagctgggactacaggcacgtgccaccatgcctggctaattttttgtatttcttttttagtagagatagggtttcaccctgttgcccaggcttgtcttggactcagctgagctcaaatgatccacctgtctcagcctcccaaagtgctgggattataggcatgagccaactgcacctggcctaaatctccttttttttaaaaaaatgatatcttgattaggaaacattcagcaaacattttaggcaatgttcataagggcaagtgaaaaatcttaacacaggcaatcataatagaacagtaatttaatttgaggctcataaaccaactagagaatgacttttatttatatgcattctgcttcttagatgacaggaaactgtatatacatggaagtaatccagaaaaacatttcgtctctagcctgggagaactgatttgatcaatttaaacaggtagctaaatatctctagtttagtacattgttaggctgaagtttttagttgctctctgtgattgtcagggcactttgtattcactgcaagtcactcctggtgttcccacttgaggacttcaaggaagtaagaaatcttcttttaagccttgatatcattagcacattatttgctcattatttcctgtaacactcctcctcatcaatgagtcactgataggcctatatacaggccagtctttgtaaagtgcaaaaagttattttatagctacagcattcatagtatgggctttattaatgtaggaaggcaggtgcaaaacaattcaaccttactcagcttggttcttagttctggaagattcttttaggatacgtgagttgaatccttccaggtcaaatcctgtgagaaatctgcctcctcttccttacatctattatgttttcactctcagtcccagagtcttactgggggtcttagttaggtagttcaaattcaaagaactagattctttaccttggttctttcccacattttgctctctaggtccccattctgcgagaactccaagactaattctaaatccgtcttcaatgttcttgtttctcctggccaccaattcctaatgcccccctccacaagttgacccattttctactaactagatctaaaattttatccttcatcaatgttggctgttatcctcaaaactctgtcatcagtcacatcttaacctattataggccctatcgacaatacatagactatattgggtataaacaatgtttaagaatatgtatacaaagtgtacgggatatgttgcttgtgttttgacaaacattatgtttctaatcttgagtcatccctcgggattccaggataccttcttctgctgtgtataccaaaattggtgcatactcaagtcatgcagtcgaccctgcggaacccacatatatgaaaagtcagccttccctatacatgggtttcacattctggaaatattgtatctttgatctgtgtttggttgaaaataaattcgtgtgtaagtgaacctatacagttaaaacccatgttgttcaagggtcaccagtgctaattttagagacatatccttagaagaagtattgcagacttcatttttaaaaatataggtatgtatagtaaatgccaaagtcctcttagttttactttaatctccaacttgtccacttttaatgtacagaattagatgagacccatatgcttgcctgggaaaaataaggataatgggttccctgtaatcaaggatacaaatttcacatccatctgcttagtggttcccaagtgctgatgtcgagactagtgttcaaatgactacacaggaatcatttggggtgctttttcagaagtattggttgcaaggccccagtctcagtaggctgaatcagtagttttggggtaaagcctaggtatccacattttaaaagtgatataggtagttctaatttatagccaggattggagagcacctagagaacttgtaagagttctttcagctgtctgtttctgtggtttaagtatccaagaaggcttcttctatctgctccttactttgcacaggagacaagcaagatgttcacctaacattgtttccttttggacttcttcagagtatttccatactaaatagttgttgttgttattgttgttttagtggtaatgataccttctgaataagacttaaatttctaacagtgtacttatagttgaagagtgcaaattcaagttaaataacagataaaacagggccaaggaataatctgattgccctgaggaggtggatctttgaggttttcattttcgtagccctgttttggtatggcacgcggaaatcatctgtcattaataagtcaatatgagcttaatttagcagttcctcctatttgacactacagaacatagagctctttttttggggcagctttgagaaggcaatacaaatgcagatagagtaataaattgtgatttttgcagtagaggtaaggaatatttagccatttcagtatttttttattattatactttaagttctggggtacacgtgcacaacgtgcaggtttgttacataggtatacatgtgccatgttggtttgctgcacccatcaactcatcatttatattaggtatttctgctaatactatcccccccaagcccccaccccctggcaggccctggtgtatgatgttcccctccctgtttccatgtgttctcattgttcaactcccacttatgagtgagaacatgcagtgtttggttttctcttcttgtgttactttgctgagaatgatggtttccagtttcatccatgtccttgaaaaggacatgcactcatccttttttatggctgcatagtattccatggtgtatatgtgccacattttctttattcagtctgtcattgatgggcatttgggttggaatttcagtattcttaaaagaatatttgatttggatggagagggagctgacttttcttagaggttccaaagaatgatgggaatgattaggcaaactagattctttgtttaggtggcttttaattgcattccttgggatgcttgctatttatttacttgatcttttctcttgtgctaaaagcaggaaggaaacctgtcttaataaagacttaggatactttggtttaaaatgatgaaggggaaattataacttttgtattatctatcagggattcaagattagtaaatggggcaggggtctctatcccttagctagttagggaagtgaggttatattagtgaaatcttgttttcatagttccctccactctgaaagttggtgttttgtaggagcattgttagatgcaaaataaaagagtaggaagtgcaaacattgtataaatgatggatctttctctttttctgtgtctaacttgctattcctcaatttaaaatcttaaactatatccatggattagagtttacttcagtgcttctttaaaatgcaaaatgtgacctcgttttaaaatttttgatttacatatttgcaagaacccatttattgtaggaagcaaggaacagccatatcctccctgaggttgactgtttgaatcaaatccttttaaaacactaattaggaagtttaagtgttcatttttgttctttaacaacagaagattcttgttataaagttaatgaatacatacacttcccagaatgtcttatcagaagatatatcctatgtatcttcaaataaatgatacattcccaaattttagaattgttttataactgtatcaggaaaacagaaatatttttttctaaaggaagttataaggaggtgaacccatcaccaagctatgtagtaagtattttttccacaaggtattacaaagccaaggaccatcaccaaaagtaggaagaggtaactgtgggttagccactatgtattagtagtcacaatgaaatacaatgtcttggtaaaagaggacaccaaggaaatcaataatgatggcactcaagtttttgagaaggtattataaccaaatatgggcattaaaaatgcatttgcaacctactggaagcctaagctatttttaaaagcccatatggaaagctcaagatgtgtttgttccatgtgggtactggaggtgggtggggatacacaagtagcttgcagtctcagagacttctatatggaaagcacaacttttagaaatggaaaaaaatccaatcagagagaatggggaagcttataaggtaaacaggtcatgtacaaactgtattttaggctgtgtaaaaagagaacttggtgaaattctttaaaagcagtcatgagttttggagttacctcaaaaggtagtggtttactggagtagtagtgtgtccatttggtgatcatggtgcaatgaacttgataagagaaaagcaatattttcaatgccctctttgtctaataaaggaagataaaagggacatgctaactccataattgtcttctgaaattgatgatgaagtgaaactaagtaaaactgtagtaaatgaacagctattctaggtccagttaacaaattagacatgatagctcaccagaacttgatagaatcctcttatattttgaaggaactcaaagtttttgattaataaagcacttaatgtgcttttggcagggttggcaatcttgagtttctacttgatcagcagtatattttcagcaagatgaatttaagtaagtatataaagtttgtcttggggtaaaattttaattcaaaattgtatattataagatacagaatatttctgaatcaggaaacaacagtgaatttataaatctacgtcatgcctatacatttgttaaccttgaaagcctatgcttattccagattttattgtagtgaagtgttaaattattctggatcttcactgtgacatgagttgtgaaaagttcaatgtgttaccattttctcatgattactagcaattattacaaaggtatagaatcttagttcagctattgatgataagattacatatagataagattccaactaatgaaaaacaaagacctgtaaagcctggagtcttttgtggtctgtgttatttagatggcggtttggaagtgtagctaagatgattgggatatccgagttggagagagaggagtgttaaaaggtaatattggcagaatgttagaaacttaaacagttcaccttagcttaggttagatattctcccactattgctacatttgcattaatgtgtaaactgtgtataatcagcggctttattccaaaaagtgcctgatgttttggcatgcactggatatatttgctgtgtgagaatgtttgtgatagcaggatcagctaagctcagttagtgtgtatgattcactagaatatggactagctgcctgtttgggattacagttgttctaacaaagcacatgtggggagtcagaggagtttgtatgcttttacaaaaatgtgttattgtcttatgtgatttattttccttcattaaaaaaatttgattcaaaacatttgtgttctttctttttctcgttccccactcccttcagaataacatagctgatccagaagaactgttcacaaaattagagcgcattgggaaaggctcatttggggaagttttcaaaggaattgataaccgtacccagcaagtcgttgctattaaaatcatagaccttgaggaagccgaagatgaaatagaagacattcagcaagaaataactgtcttgagtcaatgtgacagctcatatgtaacaaaatactatgggtcatatttaaaggtaatgtgtgtgctgtattatttaagtcataaggtattttcattagaagttttttaattctatttttttgaaaggcaatgtcttaaattaggatttggcagtctatggcttccaggcagaatccagctccatttatagtgccaaataaaccgttgttagatttagcagctgtattctgaatgcatcccagtactcagctgcaccccttttccacacctgaacttttggtttgatggaggagcagaaatgcagctggtcctggagacatctcctttgtcaggaaagagctatccccctgggtttccagacactattctcaatggtcttaactgtctcaacctcagagctgatggaacatgtaagtatgtcacttatttcattgagttatggtagttatttacacatttctctcccccaccaggttgtgagctccttcatagcagggagtttagcttaaccagtcctggtacttacattccttagcacagggtatggtacatcttaagcatgtggtaaatatttgttaaaatggaattaagtggaataacatctgcctccccctccaaataaaagttggatttttactggttccaggatcatgggattagcagacacctgaagttccagcagatggaggtgttactacatagcagaaaactggttggtaaaacccagtggtccttgggttccagagttagaagtcaggattcgtgtctgttgaaatgtgaataataaatagttgaagaaaagcccccatgaactctagcttagtttggagtttgaatcattttaaaattaaaattgtttatccttgtattgcagtttttcaaatgaaggctgtgctagatctttgccattcagggtttaaaaggagggaagtgtttgttgttactggttgatctataggccaaaaagagcgtatctataactaattaagctgttggcctgcgtaaaaattaatgctatcattttatcctctgctgaccaaataaaacttcggatatccatctatacctttacgaaataacctgtcttcaagttcacagattctttcttctgtttgatcagttctgctattgacactttattgtattgtttcatttcattcattgtatttttcagctttgaaatttctgagtttttaaaatgatttaatctacttgttaaatttatcattttgttcatttattgttttcctgatttcacttgtttctttgtattttctcgaagtttgctgagcttccttgacacaattattttaaattatttgtcaggcagtttataaatctccatttatttggagtcagctactgggaaactactgtgttcttttggtggtgagatgtctccttggtttttcatgtttattattgccttatgttgatgtctctgcagttgatagagcaatcgcctcttccagacattacaggtttcagtgtgaaaagaccttcttcctctgtaggacagtgtgagagcaatggctgggtgggttgcagtggttctggctccaatgagggcataggagtatagttcctgtgcagctttgtcacttgagattagtgttgacaaagattgcagggatcctcagtggtcaataccttggttgtctacaacagtggtgagggctgtttgaggtctttggtggcaagagctgctagggtccccccagtctctttttcttccaccagagaaatcatagccgagtagatcccttttggcattgggtctgcttgtgggcccacttgaggtggcactagtgtctaatgagtgatgcccatggagtggccacagaactaaggcttcaagcataggcatatctggagggacatgctctggggcccaagccaatagtaataccaacgtcctaggtacaaataccccctactgctgcacagagctacagtggctctgagggtggcgtagggcctagctatttgtaacatctgagctgatgtctggagcataggcacgctcagagggaccttgtctccagagcctgggatgtgagctagctcactatggcagtgattagctcaagtgtctgagctgtgggtgggtccagtgcaaccactcagctggtctggagtccagaacacaggctagctttcagtggtgactgtgtggatgtctggagcataggcacactcagagaaaccttggctccggggccctggggtgtgagctagctcactgtggcagtggctccaatgtctgaggtatggttgagctcagtgaagacgcagaatctgggtctggagtgtgggcactagtggagtggccatgactcagaggtctggagctgcatcagttttcagagtggtggcttctttctccatgtggctcaacaatgtcttcttcttgagatgagagagttttgtagtcatgtattcctcttggggttccctggcagaaatggctgttgactacctcagtagcaagagatgccagtgtcctctgcagagcaggccactggggaccatgatggcttctactgtgtagtgataccaatagcctccacctttcatctttgttcctagacatttcctggcctctcaggtatgctgatctcctcagtgatccttcctgtggagttattctttcttttttgctccactgtgttgctgcagattgttaaataggcccttgaatccttccagagttacttgggtttgtggatagctgtctatatttgggggctttttatgtatatgtggagggaggggatgattaaaactggtatctcctctgccgtcttggtgactttgtcatcgctttccatctatctgtatctatattggttaatactgatatagaaatttatcacaaatttcactgcctgtttacaaaacccgacttattctaatattggatgtatgtggtatgaatgcatagtagaatgaatcattaagcagccaaacagccactatatattacacactgtattaggtgctgaagatataaaagtgaacaaactcactactgctgtcaaggcactcacagtccagttttgcactgaaatgatgccaattttatggttaaagtatgtacaaggtatagatgatgcacaaattagtaagtagtcacttctgtccttttcaggagtggcatgaataaaaggcctccaaaaggaggtgataatgctagtaatttctatccaatttcagcatttacatctaagtgttagctattactgtattttactacatacataattatttgctcctttgtgtgataattttgctgtcatatttgttcctaaaaagctaattcagcccatcatattcttttttagagatctcatgagtgattacgcagtctcagtagttttaggttctcctcctaattcccatacaattccttggtggtacatgtgtgtgtgtgcgtgtgtgtgtatgtgtgtgtgtgtgtgtgtgtgtctgtgtgtgtatcatttgctcattctggtttactctttctggactgaatcccggtatttccagactcactctagggcaaaactgaatccttgctacttttaggcacctgtgacaaaaacactatttttggttgctgacctaaaatattaaatacgccctatttaaaatggctattccataatatattgaaaattggtactgatatggtttgacaattttattggttgcttatttattcatattcaatactcccatggaaaatgagtgacagctctatcttcttttcctaagatttcatatagagtgttttttaagttgcacagtagtatacatgtactagtcacccagtatttacttaatctttaaataattaaaaactagttttttgtttgtcccaaattttgattgtaaagtgtactcagaccagccagtgctacaaaaccatcgtccaagatagcttcttaagggattaaatcaaattatttttatctccttcacccatcattaactaaactctatgatataaaacactactttgaagaacatgttgcttcatgataaaattgtagaaatgtgcagctggcttatgttgattatttgtgttctgaatctatttaaagtaaataaatctgtgtgtatatacatatgtcttgagacatatgtatatacacacagagaaagaaatattctataatcttacaacgttttcataccatgtatttaaatcactttcttaaattgaccaactcatttattttccatttatattacaacatagtatgactgtgtgggtttgtatttttttctaaactaaaatcacgtcaaatataacaggattctgtttcatgtagtcaacataagtcaaggccacatcctctttgtgccatcagggaactgtgttatcagtcaacttacatacttattgtggcccattgttccatttcaggtgacatggaggattttgtgagtcaagttaattgagcaaactgggaaatgggttgttcttacacaggatgtcatccataactaagacctcactgtaagctggaggaaaagtttattacatttgagagaaaattatatgttctttgaaactgtatgcagttgtagtgatttccttgagacatgcaaaaaatgtactaggtattcattttgactaagctcactgtataacttcatttttgaaaacaagagttaaaaaccagacaaacacatcagtatgaccacagtgttttcctttaattttagttcactgggcagattttcttgacaaagttagtctttatgaagagtgctaaaataagcaaacccttcccttctgatctcataatattggaataatcttttataatctttaaatatttttctagttcagtgtaaatcttaaaatgacactcaggcattgaatagaatttgaatcatgcctttatttgctgctgaaaattgcctttagatttctgtgtatgttaaggaaatattgcctcccacccaccatcaccagtatttatgaaaaaaaaaagaattgaatgaagtaaaatatttcagaatcatctgtacggctttgtggccttctccttatttttcactgaaactgtatgtgcttacagccagtttatgtatgctcaatgcctctggaatattcttttattgttaacatttgttttggagttctcttataaaacttgaagaaaatggaggctagaaagtttgttccttcttaaaatgttcttttctcaaaataggaatagctttaaacttaatataatacacctctaagaagccccatgttagattcaattcaacagacgcttatttattaatgcctactatgtgtattcctcttcttttgcatattgtggttaatctcatctactttcgtctgacaacttctaaactgatgtctctggtttcatcctctctgctcagccccagatatgtgtttataacttgcttcatattaatagcctgcttatctgtgagtacatcaagtgcaataaccctcaaactagggaggtagcatttgaactaagtcttgagaatgattttgataggggttggaaggtgcaagtggggtagggacacagcattccaagctggaggaaaatgactcagaagtggtaaattttctagccatattcttggcaagatgatctctactgtcacttccagttttataaagtcttatgtgctgtatgttttttttaatcaggcaaaatatacttaacactaaatttgccattttaagtgtacagctctctggcattggctacattcacattgattttgtgttttttttgtttgtttgttttttgggtggttttttttttgttttgtttttttgttttgctttttttttgtgacagggtctcactctgtctcccgagctggagtacagtggcgcagtcttggcccactgcagcctccacctcccaggttcaattgatcctcccacctcagcctcccgagtagctgggactacaggcatatgccaccacacctggctacttttttgcactttttgtagagatgaggactccctatgttgcctagactgctctcagactcctggactcaagcgatcctcccacctcggcctcccaaaataccaggattacaggcgtgttgtgcagccctcaccaccactgatttccagaacaaataaggattccttattttcagatctagaaattgagtagttgtaattttaatgcttaatggtatatactactttgtaaagtcacatttcaagctttctatgaacacgttttactgacagacagttggcaagtttctgttttgaattagtacaaacaaaaaggcacacattgtttttaacttggaaaacaggtgctttcattcatgcagaactgcaaaataggcaggcatgttttataagatctttttcttttaaatgtcaggtgaatgggaagctctctgaattcatatgatagagtatagtacttgttagaaacaaacttgtggcagaagaaacaatttttaacctatccaccattgtaagaaccacttttttcttctcttgaaaaaagtataaaggtacatcagagtcacaattctcaggttgcgagtgcctaggttctatacacaaatacaagttatatgaacctttcctggaactcctcttccctcaccagtattgtgggaatttatttcctctatttcctaatgtagacttcactgctaaccaagactctcagctttctgctcacagtgcctgctggccatctatgtcaggacagagtggatgtcaagattagtggaggaagtggtaggggaatattgttcctccctttctcttacaaattctacatagtgtcagcatatggaaaggagaatcattttgtcttaattaactgagccctcccttcatgatcgctaaccctaggccacatcccattccccacactacaatgtcagttccactctgattcttcaaccctctcccatcccctaagcactcatcatcatgtcactgggttccattctctgccttgataaagtcacatcctcatggagatgcctggaaattttaaattggactcctgaatacctcccagggatttttgagtttgagggctactggcagtagcttgagaatcttcaccccgcagctggggttgtaaaggtgagaaatgtgtttctggcatcccaagttgaggcaccatgctgaatatattttcctacttgaaatattgttaagatataaatagtagtgagtttctctggtactttttatgctatactacgaatgaatacatttgtgtgaaattgtcttttgggaggactaccccaggaacttagacattatttttatgggaaaatgcttgcttttaaaattctgaacatcttacttaaaaaccaacttttggaacacagtccagtcactacttggctgctgccagtatagtaaagccaaccattctacttccagtcagctctttggtcccacaaaaattcagagaataccactcatgaaatggtatggagagagaggtgtcccttgtatttaagctatagctaaaataaaaagggtttaatggtttattccagtgtttaactgatggtactgaatggtatgtgtgtgtgtacacctgttttagaatttgtatacatatattcctcccaggagccccatttcctcttgttcagctcacagggaagttaattccacctggagaaagcacagatttttaaagctacactctccctttttcttatccatttacatcagaggtaaaatgaacaatattctttctaggttccgtgtgtgccaaaaatgcccattaaccgtagctgataaaagtttgaagtacatcaaaacaaatgaaagccaacaactgaaataaggcaaaatatccattgtcctcaaactcaaacccaaaatttctacaagccctcatttacctcctcattctttaatgtaactatcttttctttccaatatcattcaagataattatttaaagctttgttttttataaaaattactaatagttcaacaataacaaacagtacttttatttgtttagctatatcataggcaaaaaggtatgcgggtagtctaagctcagaattttaatttggaatgttctatggaaaaaatatattcggggttcccaagcaaccatttttaaacctacattttagaatctgttctttatttttttaatttttaatttttgtggctacaaagaaggtgtaaatatttatgggggtacatgagctattttaataaaggcatataatgtataatgatcacatcagggtacatttactctctgtgttacaaacagtccggtaatacttttctacttatttttaaaagtataattaaattattattgactatagtcaccctgttgtgctatcaaatactagatcttactcattttctctaactactttttgtacccattaaccatcaccaactccccctccctactatccttcccagcatctggtaaccatccttctattctctatctccaagggttcaattgttttaatttttagctcccacaaataaatgagaacatgcaaatagaatctgtgctttagtatgtgagatttaacatttttgctagtatgttattttggctcaggtttgtaattattaaattgtttcatggctttacaggggtctaaattatggataataatggaatacctgggcggtggttcagcactggatcttgtaagtattttaaaatagttacacacagatgcaaatgtgtgcatatgcacataccttaattttttaaattgaagattaatggcttttgagcacgctaagtggttgctttagttaatatgttcaaattaaattcttttttcatgacctctaccttatgtaggtacagatgtattgtacgtttgaacatgttgctggcattctaagactatataagaaatgcaaatagcttaataaaataaagtctcccaaattagaaggggatgtgtgtatccattgctgtcaaagtttgacttttgcaagcttatccctgaaaaaactgagttttcttagatttttaaaaaatatgtaattgagataactgtcactaaaagtgttttttatgaactgaatgtttgtgtccccccaaaattcatatgtggaaatcctaacccccaatgtgatggtattaggcggtggggaccttgggacctaattaagtcatgaaggtgagttctcatgaatgagattcgcacccttacaaaagaggccccagagagctctctgactttctttccaccacgagagggtgcagtgagaagaaggccttctggaaaccaggaagagtgcctttaccagactcgaatctgccagccccttgatcttggacttctttcccagtctccagaactgtgagaaatattgtttaagccacccagtctgtggtattctgctatagcacctgaattgactaagatagtggtactagggttctaaacaaggttggcctacagatccagttcttcacagagttctctctgcccctctataggttatttggaaatgtgatggcatttgggttgtcacaatgacttagaagtgctcctgccatttttgtggtcatggatcagaatgctaaaatcctgcagtgtgcaggaaaattcaacccaatgaagatgcatttacacacagaatgcctttgagaaacactggttgttccccaattcagtgtgatcctatcaatgttgagtttctttcccttccttaaaaatctttattaatatgatactatgttttaaaattcagtatgacttatgagaggcaacttagtgtagtagaatgaccactgggctggcctggggtgtttgaggttataggtctggctctgtgcctgtgaaccagacacaaacttcctggacgtaggtgttctataaaacaaagaagttgcactaagttatttctaagttcccttccatctttaatattatattttttttatttgcgtgtttctgccttagaaattatagagtatgctgtttctaagaaagtgttttgattaaaataatcaagtaatattttaattcttatttttttaggtggagatgagttttcctaactgaaagtgattaaatatttttaaaaggctttaaccttgactgccagtaactcaaagcttcaaataattttatgaacagaaatgactataagagattttctttcctttaggcagaaccatatttaaaccattttaaagaaatggtaattaaacttgatggagagcctcatctactactaggaattcatgtcagtttaatcagttgctgaatttggtaatctttccttgtgtctaatctaattcttatatcctaaagcctgagttcattttttttctctcgtctctagtgagagaacaccactgatgtttctttgtgtaataatccttcatgcatatggagtcaggcttcattctcctcttgaagttaaatgatctcatttctatttgtcttgtcacagagtcatattattcaatagttttttcattagctctacaagaagcctctcaattgtttcatgatcctccttccattttttgaatattaagagccctttccaaatttatcagttgtcttatctggttcctcagggtgctcaccatatctcttccccattttggaagcactggcaaagctaggccactctgttcaacaggatcactgatagcaatgttaaacagtgaacactggcctaaccccaaccaatgacccaaatctgtgtcccctattagtagtttggtcagttttatgaaatctccaagttaaatgattgtgagatcttaatctcatcctgctattctgaactctacttaataaaacaaatagccattaataacagtttcaatgaatgaaaaatgttgttagtactgtattggttaagaatcaaaaggcctaggtcataaacccagtgctaacactgactgcctggcaaatattgggcggccctttagcctccttgtgtcttaatttattcacatgttaaatgaagaaattgaatcagtaatctctaattttgtgttcttagctctaaaattcaataatattgtgatttaattataaaactcatttaactagactttacagggagagcagataatgagaaaatgtgctattcctttttcatgtatattcctgtacaaataaatgctatcatttgggggaatctaagacaggattaggtgtagaggaaggctctgctactaagaacaagaggaaataagagggatgtttagcagagagtgtttctcacattaaactggtgcctggtacctaactaatggaataacataagattacaacttgtcatttatgttaacattatacagtgtctaccttgagtcactcccattcttgaaaaacaatttattgtatgtgagcagactttgagtatattgcacatcattttattgagtttattatgctccacttctttccaaaaagaatcgtggtggcttgcaacaaaaacacatataataagatgactagaataaaacatgagccccaagaaaaaagaaacaatatgctaaccataagagagggcataaaatagcagactgcattagggactggctggaagttaaattgtgacaaagatccatgagctcacaaatgtacagtcttcgaaagagtcaaggtccctctcttgcatattcttacttgacaacagaggcaaattacacaaggcaagtacactgccctgggacagagatattatctgttagagacatggcaagttcttcagttatcggagaaaagttcaaatggagaagtctccctgccacagagtctttcttcccatcctcctctagcacccagttaattgagatttcacttttattgaattttaacatgaacctaaaatatagcagataagctcatgaatctttgggatcccctttttgttgtttttacttaaatatttttaaaaacttctgtattaggtaatatactggcttatttatgttacttttacatgtccttcagaatgatagctagtaggtcgtacattaatcttgcccaatcactgaaataaccaaggatatacctcccctggtcttgccaatgtcctgtgatcagatgatactaattactgatcttaagtagtgtgacatttgtcctttagttattttgtagtacctcagaagttcattgccagccatcaacaaaatagtatgccattttcaacctttctagaagactttagaaactattttaatcactactgtttgaatagaaactttggggtggaagttgatagatttgaaagtaagtagataatgttacctaggaaagggacctattgaattacagatatccctggagtatactatatacccagaccacagttaatattagatggtgagaccaaagtatgagttctattttaagctgttaaatttcaacatgaaagtgccctttattcagcataaatatggcattcatgaaagatgaaatacacaaggtgccaaagagctgtggatccctcccagtgtgaggcagagtgggcaatgtttgattttcaccacctcttccctccttccagaagcaaacagaactctacctctgctctgactttagattcccaccctttcctgtaataatattgtacagtccactgtttgtgctttatgaggtaccagaattttaaaataaccatttattttaaagagggattttcagatattccattacaagttctcctgaaacctaatcattgctttccttgtattccagttggaactattggctttggtacagggatggggaaataaagggatatgtgttacatttatttgaaaaacattatccctccatgatttaatttttttttaccatcatagtctgaatagtttaattattatattcttggctaaatttacaatttgagtctcaaaaaggctattctttgcaatattattaaaatacataaatgctgactgatatgatcaaatagttgctgtggaaatcttatggattctctgacctaaaaatcagtttcgtgtcaatatgtagtaactttttcacagcaattgcctgaatttaagtagctgatttctctttttttccatctaaagaacagatagttggttctgtcattacgtaagcatatttgtttcatctttgatgtaaatattcaggaacctcagaatttgaagcctagtatataggtaaaagggctcgtattatctttcattaaattgaatcattaaaaaacctgttcagccctttgactgaactcttttgctttcttccttcacattttacatttttccttccttgtttagatattggtttgataaacagaacggcatcatgtgtctaagtgatttcttcatttcaaaggtaccaattttgaattttatgtttccaaacttttacacatatgtgtatgtgtgtgtgtgtttttccccttaagcttcgagctggtccatttgatgagttccagattgctaccatgctaaaggaaattttaaaaggtctggactatctgcattcagaaaagaaaattcaccgagacataaaaggtatacaaaagtctaatatgaacctgagaaaaatagaagcattctgagcaagctgagtttttttttgcttttctttttttcctcctagctgccaatgtcttgctctcagaacaaggagatgttaaacttgctgattttggagttgctggtcagctgacagatacacagattaaaagaaatacctttgtgggaactccattttggatggctcctgaagttattcaacagtcagcttatgactcaaaagtaaagtattacctgtacaaactgttttgggcttgttaataaattatatatggcacactatcctagttaatacactgccttatttttccttgtttcacaagtgtttcttaagctagagttatgtcatattttgctgcttaatcataaattccctcacagctaactaatatttggaccctattcacttcaatggcttttcatcccacgtggaataaaatcctaagtcctttctgtgacatataaagctctacacaatctggccattatctgcctttccagtcttatctcctaccactctcttctagattattcatccacagtggcctcatggttgttcctcaaacatagcaagtacaccctggcctcaggacctttgcatgcccttccctctgtctgaaaaaaccttcttcccacaatcaggtctttgcttaaatatcacctacgcagggaagtcttccctggccatcttatgtaaatttgcaacacccttccccccatgattcattattctcttactatgctttgttattttcttcacagaagttagcaccgtctggcaccatattatttatttatttattgtctttcttattagaatgtaaaccccttaagagcagggatttttgtctggcttatacactactgaaatcctccattccgagaagggtacctggcacaaagtatggaattcattatgttttacataaatgaattctactaataaaaatttattaacaccacattttcttgagagacaagtactgtatagccattaggttccacagactattttgtggtagtatattggaatggagtttcaaggtgatatacatacatacacatatatatatatatatatatatatatatatatatatatatattattttctttttccttttacgttaggctgacatttggtcattgggaattactgctattgaactagccaagggagagccacctaactccgatatgcatccaatgagagttctgtttcttattcccaaaaacaatcctccaactcttgttggagactttactaagtcttttaaggagtttattgatgcttgcctgaacaaagatccatcatttgtgagtatatattgctattattactatttgttttctattattagatctacttatagcaaaggcagcttttcctgcagtagggaatacagtgtatgtgagaattgtctaagatccatccaggaacctggttcgtccttctgtattgctatttctattgagttcttaaccagattcttcattctttttctccttacccttcgtttttttcttgatcctcagcttcctccttattctattcattatttcctctttcagggggaaataaatttgagaaataaagttaactttatattatgtcattattaaagtgtatgtataaatacaatgatttttgttcaactgttttcatttttcatgaaaagttatatttgggtttaactattttttttttttgagatggagccttgctctgttgcccaggttggagtgcagtggcatgattttggctcactgcaacctccaggttcaagcgattctcctgcctcagcctcccaagtagctgggattacaggcacccgccaccatgcctggctaatttttgtatttttagtagagatggggtttcaccatgttggcaaggcttgtctcgaactcctgacctctagtgatctgccctcctcagcctcccaaagtgctgggattacaggcatgagccactgtgcctggccaggtttaactatttttatttggtgtttagaaacttcaatgtgaagttgtatacttttcctaggctagtgagctccattcatttacttggtggattctattacagttgttttactgttgttgaaataaagctgccttgtgactttttgagacgagaaatacacaagagcagtccaaacttgatataactatttttaagttgatgataaacattctcatgttaataaaatgaaggcggaacatcctccacagcacctggtgtttgcatttagatgcaatagacattgatttgtgatggagaagggattatatgtgtagataataacaaaattacagccttgcaagttttcatcaggttttttcaaatttacagtaaatgtgattaaagtattttagaacactactttgaaatgtttttaaatgtttactttctaaatactgtcatgtgtctctctgcttttgagaaggccctgcctgccagtttgctggtgggtaagccacctgctgcccgttgggctttaacaaattgggacaccaaagtagtagattcaatgtggttgccttgagccacttcaataatagaattagctattttcctacagcattttagttgttcttatgtctacagacatacctttatacctttcagcttaataattcaaatgattttttttaccattccttgtaatcataagagttcaacaattgtcatatgcagccttgatctttttatccttagcgtcctacagcaaaagaacttctgaaacacaaattcattgtaaaaaattcaaagaagacttcttatctgactgaactgatagatcgttttaagagatggaaggcagaaggacacagtgatgatgaatctgattccgagggctctgattcgtatgtacaaattatttaatttttatgtaggcagcctatttaaatattgtatatcttttagctatgctccagtgtgcttgttctagcataaaatataaaccatattttgaaatttcaccttagaaactgtaaaaatctttttcaatcacagtctgtggaatacaatggagttggaaacatgtttttcttggaagtgaatagctctagttttaaatggtcttggtctaacccctagtggatacttgagtatattacaaaattttggaacaggattcaattaaaggtgttatattagtttgctcaaagtaataaggagctgtgttttctcatactttgatggcaacctgcaaaatccctctaaagaactgacctccaggcttttcccacctcttggccatgtaccaaaccaagatcagactgatacatttaaatattcatttatgcatgatttttatttcttgaaaaagttgtagggttttataacagcagcgtttacattaaaaattcagcctctaagtctgtcaattaatttagactaggaaagtctgtatgctatgccagaatttagtcctccaccagctgaactggcacaaaggcaacaccaaatttctttagatactactctgagattcttccatttatgagaaattgtccaatgttggaaagggataaaaaatatcagaataatttgtgccctattctaatgggtgttagccttagcttcccataagagtcactcatggaaccttaaagcaatcacaagccacaccactggagatcctgattcaataggtggggagtagtgagggacaggtatttatctatggtaggaggtctcaatgaagcacacacagagttgagaaccactccactactactctgtagtaaaatgtagtattcgcctgaagctgagatcagatgcttttttgcatcatgagtttttaaacattgggacaattatccctttagattctacctgcattgatttggtatttttgccaagctgaatcatttgggcacttatagaggtatctttggcaatctctttagggaatctaccagcagggaaaacaatactcatcctgaatggagctttaccaccgtacgaaagaagcctgatccaaagaaagtacagaatggggcagtatgtatatggagacaattacttactcttcatacagtttttcaaaccatgtagtgagatgataatggcctaaaattgttaggattgaatacccctaaatgcctgtctgcctcactgtgtttgtagtatgcttcatttgtcattagttttgagctaattaagaaaagttaatagaagttatttaagtggccatattggtattttttaagtgcatttcacctggagatacataagcccagggaatcataggtatctattgtaatcccagaagttagaggacttctggatgatgaatgagaatgaatgataggaagaaagcttagagacttgccttgcatacaatcttttgttttcagtaggggattcaaattagttcgtatttgttaaagaataagaaaatcatgacacttattttaatttcatgtgtataatctatattatttgttcaaaggagcaagatcttgtgcaaaccctgagttgtttgtctatgataatcacacctgcatttgctgaagtaagtacagattaattagccttggatatctgtgttaagtagtataatattttaaatgttttaactattattctttctcagcttaaacagcaggacgagaataacgctagcaggaatcaggcgattgaagaactcgagaaaagtattgctgtggctgaagccgcctgtcccggcatcacagataaaatggtgaagaaactaattgaaaaatttcaaaagtaagttggaaatgtcattttaaaaattattttgcattttctgttgtatgttaatttatgatgcaatgtaattcctttgattcaaccattccaattattcctaacaaagtcacctttcaatacatagttgtatacttaaaaatagtttttgtctgttgtctatcttaaacattagcttttagaatgattatctttaggcatgacaaggtagttttccactgcatgaaatgacctgtttttctttctccactagtaggattatagacaaaaggtcactgagcatattctcatttgagctcttattaatataattgtggaatgctttctttcttgccactaccctcagaatttaacaaaacaccactagttgcatagtttccagtgctaaagttcctacgtttgatctccatatgaaaagttaaggaaaaggtagagggactcaatccagaccaaaaaagggctcttatgttcaacttcagtttctatgttgtctcttgaaatattcatttgattttgttcgcattcaaaaaagttcttacatttaattttttaaaaaattttcaacaagacttttgtatgcatgcacacatatacactccttagctcaagcaagctataaggtgatactgattttagccttgaccctgctatatctcttctcagtgcatctttatatttctttgtgtttgtgatgccactgggatcgagatggaacaaactctgtgacctgtgaaatcacacactctcaaagatctttctatctgataaggctcacttgtactcgcaaacctaaccccctcttaaaatcccttatattttaatgaaaaccccccatttgaaaacaaatcaatcggaagttgtgaaatcagatgcagaagggattttttaacttgtttatattttaacatctacatgataagattcaatagaaacaatgtatcccttttgtggaatcagtttcttcattgcagagttcatacaaaggagaaatataaacatgcatagttgtacattggtttaaattttttaaaaattttataggtgttcagcagacgaatccccctaagaaacttattattggcttctgtttcatatggacccagagagccccaccaaacctacgtcaagattaacaatgcttaacccatgagctccatgtgccttttggatctttgcaacactgaagatttggaagaagctattaaactattttgtgatggcgtttatcattttatattttgaaaggattattttgtaaggaataacttttaatactatagtttcacctgtattctagtaaatgttgagacaccgttttgcttttaagtatccctatttcttaagttacgaggatgaatacctttcacattttgatctttagttgactctacagtcatgaaacatacaggtctttcaaagtcattctcaatattcagcttttgtaaattatcaagcttcaaaaagcttttttttttaaaaaaaaacatgcatattctaaaaatgactattggtggggaggtgtaaataagtcataccttcttaaaacagaaaatttaagtaaagtcttttaaatgaaacctgtaaaagtattgactcttctaccaagttggtatgatattccaggcagctcaatgattatcacatttgagaccctgtgtttgaagcatttacaggcaatgtacagcaacagaggtacctcttggtgtatagtatttacattctcttttaggtagaagaggcaattttacccttatttcacatggttagaaatttaaagcaagatcatttacccaaggataggtgtttggtaatgttgaaggagttagtctggcttcatgttttacatcttcaactaaaatcccatactatctgcttggatttggagagccaaaaaataaagctgattgtcatgtgattaaatatctgatcaacaggtatgaatataacttaaatcagcatatttttgccatggtaataaattgtcctataaactatttatatatttttgttcttcataattatcactaataagcatcagtttgttgtttttaaaaggatatttaagtgagcattttctagttcatatgaaaataaccatagtacaggatgatttctgtccacacaaaggttaaattagattgcacagttaattttcacttatatttatggtactattatgtgggtgatgcctttttcttttaagcccagtacatatattatgcctgcctaagttctgaactggggctgtatttcagtagttgtagaattattgatatttagttttgatagctaatgtttaattgtttggatctgcacagtttggtttttgcacaaaagtcatttaaaaaaatctgagtaattgtcaaatattaaaagaaagatattcttcctgtaaggaatacagtttttagtcaaagtggccattacatcctctttttaatttacataatacagatacttgagaaagttgttgtggtgttgtatgccaagaaaattctttttattggtgcctatattgtaacaattatttttaatgcattgtattttgaagtaacggttcagttaaatttttcacctgctgtgtaactgaaacacaattacagtttataatcatctgtagaagtctggagataattttgcaactcatgttatgggttaaatgaatatttttgtaaaagtaaaagcaacaaatttataaattgattatttgaaactttacaacacaattgcatcccaaatacaaattgtattgcttattcattatagctattcgtcctgtaatctgtttctaggtgaagcatactccagtgttttaggggttttgaaaataaatatttaaatttcacagtc

SEQ ID NO: 38386 - DNA, 9723 bp, Homo sapiens
ctcggccgccctcgcgctgtggttcgctccgggcgcgctgcgctcgtgagttcccaggaggcctggcgggcaccgtaaccagcgccgcggacaccggcaccggcgccacggactccgcaggaccccgcgcccgccgccgccgctatgctggggctgctggtggcgttgctggccctggggctcgctgtctttgcgctgctggacgtctggtacctggtgcgccttccgtgcgccgtgctgcgcgcgcgcctgctgcagccgcgcgtccgtgacctgctagctgagcagcgcttcccgggccgcgtgctgccctcggacttggacctgctgctgcacatgaacaacgcgcgctacctgcgcgaggccgactttgcgcgcgtcgcgcacctgacccgctgcggggtgctcggggcgctgagggagttgcgggcgcacacggtgctggcggcctcgtgcgcgcgccaccgccgctcgctgcgcctgctggagcccttcgaggtgcgcacccgcctgctgggctgggacgaccgcgcgttctacctggaggcgcgctttgtcagcctgcgggacggcttcgtgtgcgcgctgctgcgcttccggcagcacctgctgggcacctcacccgagcgcgtcgtgcagcacctgtgccagcgcagggtgagcggcccccgcccctggccccggagcacggcctttgtgggacctccgggggctcctcctagtccctggccccctcccctagggaaggcccgctgcctgcacctctttcggatactgctggagtcctgcctcttaccgctcccgcccctccctctctaccgggggcattcctcactgatgcctttgttcgtgggggttcctagggtccccgaatcaactcttcatagtcgggcttagcgtgcttccctcctgccatttcttaacctggcccctcacggtttcgtgttcacccctctcctctctcctggtactctgttctgtggctggagtgttgacctctctggtccttggtcctgaatataggttggagaggtgatcagttagaagaggttcctaggagttcccgaggacctgagcccccctttcacacagcttagagctgaagggctgggttctggtcacctgggtttggggttgaggtattgagccgagtagctgaaagccttctggcctttctgcagttggagagaggagggccatgcacctcccagggctcgctcctcccagcagggcagaaccgcccctgcagcatggcacctggggccctggggacggccaccaggccgatgtggccagaccagttgccagaaaagttgcctggagcgtccgtgcaggaagccagggcctgtgcacccctggtgtgcccttagggcactgccctctccggtctcggacaggtgcctcccgagcagacgagggtcaacgtctcatctcagtcctgatgttacaggaaagggattcagatccagacctcaagggagggttcttggatcttgtgtaagaaagaactcagggcgagtctgcagcgcacagtgaaagcaagtttattaaggtaaagcggtgaaagaatagctggtccgtagacccagtagcatgttcctgtaagaggaggaacgcgtccaccctaggtgcaatgcttgtatatatggggagatgtgatctgctacaagggtttgtgataaaggagtaattttcttaattactatattttgcaagaatcaatattactattttcttttttttttttttttttttcagacggattctcactctgtcgcccaggctggagtgcagtggcgtgatctcggctcactgcaacctccgccttccgggttcacgccattctcctgcttcagcctccccactagctgggactacggcgccagccaccacgcccggctaattttttgtatttttagtagagacggggtttcaaaatcaggaatgcctttgttctccagacatcgggatatctggacactcccaagtctgggtctctttagtaaacattattaatttgttcccttaactgtgtttgaaacgcttgttccccggtgccgtaaagaaatagcacgtgaacataaatttaatttcctcagcaaggccatttttacttcctgcagaaagggtacactcgccagcagctttgccatgagagtacaccgaacaaaggagacaggctcatttataacctgatgtgtaacaatcgcttttatttaaagtgcgaacggaatatttaatccatttcagccagggatttgcatcttgatactctctcgatggctaaggtctgttttagatctcttatttttacaatagacaccctagttttattattagatgtagaagcaaccggtgtgagatctagaactgaggctactgaagaagggggagatgggggaataatgcgtatttaaaaaatacctagggggtcttttccatttatgtcaatccccataccacagaagcgactgagggcaggtctagagttagttaaggtggaggtggtgatagagaaggacagggttacactgataaggctgacagttcgaaagggtagtcctttcagtgaaatagatgaggggttttagatctgcacagacctttttcttggaagtttaactttgctcctgagcagttgaatgtgtatagtcccgtttactacaaagttggcaggctataggagcagaacattggcatcttggctgcaggtcattacgataatgagagctaggggtaaccatgtccatcagagggctgggacgtaagcatttgtgtgaaaaggctagctgttgttgatcttttacatttccgcaaggtatgacagaacaagcattcaaggcggtggtctgaggtgagttagttacagtaataacaaaggcgctagtaacaataaggaaaggaagcaatatgaaggtacaggaaaattaagctttctttaactttaacttagtaggattggtcctagtacagtcatccatgattctgagagaaagatgttttcttgactggagtgtggtcgtttttttcttggctctgcggatggcagtctcagtggttaacagcataaaatagggttcttcccaggctggctcaagttttttctttctgtcttttgatgaggacgtggttttcaggctggtgctggtgtactggaaattctaggggtggtacctagaactaaaagtcttttagttctgagggaagggaaactggaagataaattaagtatatcatttttgctgcatatcctggggcttgaggccccatggtgatgcctcccgctccattcctgctcagcgccgcccaggggacactgcggccctgcctcctcttaagctcttggccttcttggggccttcactgcccctgtgcactgtggccttggacatgaggggccttgtgacttacctggccaccttcaggccttaagaaagctaaacaccattttatatttgacagtgctttttgtatgattttataccagataagttaaattttacctttatactaatgtgctattaatgttaaacttaataaaatcttttttttttttttttgagacagagtcttgctctgtcgcccaggctggagtgcagtggcgcaatctcagctcaccgcaagctccgcctcccgggttcacgccattctcctgcctcagcctcctgagtagctgggactacaggcgcccgccaccatgcccagctaattttttgtattttttagtggagatggggtttcaccgtgttagccaggatagtctcgatctcctgacctcgtgatccgcccgcctcagccttccaaagtgctgggattacaggcgtgagccaccgtgcccggccaaacttaataaaatcttgtagacattatttattcaattttaatgtctgactatagggtaagatttttatagactctttttaagcttttataatttttgttaaagagcgggttagtgctttaagaaaaatctattgtgcttttaacatccagttcacagaaaaactgcatgatacccctttagctttagccaatatgtttacacacagaatttcctttacaattaacattttaaaacttgcttaaacctttaaaacaaaatatattttttaaccttttaatgtaggtaaaaatccatattatgtctccttataatcctgttattaaaagtattattttatttttctgacataccttgtatataaactgtttttttttaaataattttacattcaggaggcctaattacttttaaattatacactatttcttgcataaattcccttttatagcttttcttacaactttcacaatcttcaacatgtcttaactttctgcctgccttttacgctatttctttttctcagtttcaccctctatgtcttcctttgatttctgtctcttccagtttctctcttattctttccctctgtattttaatctctttctgtctcttctctctcttcactctcttcatcccctgcttccttcttccctcctgagttctcccgctcctgcagcagcagggccgggcaatggcaccagcccctgggcatgcactgccgtcagtttctctatccacccccaccattcccctttttactttttttcccctttcttcctacacttagtttctcgggctgggtgggatttgcatggctgcagtccggccccggcagcccagaggcttggcagatgcctgccacaaattgcaagaattatgccctctcacctcctctgctctcttcctggcgccgctgtgcttgctgtttttgctttctttttttctgacttcctctcctagttctttttcctgtctgctggtctttcctttgtctctgccagccacctatgctgctgttttcccccctctccttccccttcccctgggggaccaaccagcgggagtgaagcttagcctttttctttccctgtgaagaggggaaaagggagttttgaatatatatatatatatatatatatatatatatatatatatatatattttaactactggaggtttgtgtgaggttcaaccccctgaaattaatggaagacttaacccctcaaaccaggggtgtcttgccttgcctgccctgggaggttgacctgtttcctcctttccccccaaaggtcccttgcatacttcccacttgtgttgtcctctctggtcgcccccccaagggagaattaggcccctcttagtgtaggcgtgctggtataaatcccacagcaggacctgccctaagccatatgaggtcactacagaaccggaaccatggaggggacccactcactgtccagcaggaggacttgtcaccgtccacacaaaccacactgcaagcagggttgtctgtgatcattcacacatacacacattcagccctccagaatttcaccaccaaggaagtactttaccagcttctgtggcttctccttccttggtctgtgcacagagttgcagccctggtatgtgagcatcctttaccttaggttgctggccagtttcttttttttttttttttctgcattgctgagagtccgggtttattcgtcacaccaggtgggtctcaatttctcatccctgaggccactgcagtgaggcagaggagcgtgctccctcatgagagaggaacagagaccgcccccgcaggagaatgtagccctgtacggattgccaccaaattgtttgaaatgcttgttccccggtgccgtaaagaaacagcagttgaacataaatttaatttactcagcaaggacatttttacttcctgcagaaaggacacacttgccatcagctttgccacaagagttcacccaacaaaggaaacagggtcatttataacctgacgcgtccaccctattgccgtctctggtttccattgactgggatgggacctcacattctgtatctgtcccgattggctagcaacgtacaactttttaaaagaggcaaaggcagaggagaacaaaggaaggaagtaatttgtggaatgctgagaaaggtaaaaacaccttcaaataaggaagaggaacaggctatgacctaatgcccgcttggaccagtataagcatgccagggcaaatatttaggctaaattgtgggagctaagaacctaaagtagtacattgctttctttattactgctagcagatatttaataatgttagcacaggtctttgaataaattttgcttctaagagaagttactatttattcctaattagatcggtaggaaagtctttgaagaggaacctctactttacaactaaacatctagaggctcggaatgcctctttctggggatgcagcccagcaggccccagcctcatttcccagccctcactcaaaatggagtcgctctggttccagcgcctctgacactgagaggtcatgtcaggaatggggaaactgaggctcagaggagctatggcactgcacaaagctacacggctccctggtcttctgtttctgttgagtcatgtgaaccaaaaagtatcggagatatgtctcagtcaatttagaaagtttactttgccaaggataaggactcaccagtcctgacaacatgtgcccaaggtggtcggggcacagcttgcttttatacatctcagggaggcacaatacatctgtcagtacatgtaagattcacattgatgccatctggaaggggggctttcaggtcatggtagatgtaaaagttttctgattggcagttggttgaaagagctattatcagtagaaaggcatgtctgggttaagatactggttgtggagacctaggttttattatgcagatgaagcctccaggctgcaggcttcagagggaatagatcataaatgtttcttgtcggacttaaggtctgtgttgttaatgctggagggcataacaggcctgtcccacaccctcttctatcatggcctgggctagtctttctggttaaatgtggagggccctggcctattggaggaagttcattcagatggttgggggtaccttccgatgttatttttggtttacagtcaggaaccccctaaaaggcctagatctctctctgtccccaggtgctggactctatgtctttcatgcatctagagtccagaggcaaaggccaccaaggctgagagccgggcacggaggccgaggagatggggagccagggttgcttttctgggaaagagggagtgataaaatcaggcatgggctggttggtgaggtccctgtgggaggtgaaggctgggacccagaacagcagagactctgtcgatgatgtggaaagaccgcggctgcagtttgggcaggctgagccagggttgggtcttgcatgttgagaggctggcctgcggtgatgtggccaaagaggaagagctgggctggggtgagtgttggtcacatggttgaaactaggtggggaggggagtggtccaggggagagtccaggcccagctctgctgggacttgccatgggggtcacgactcatctgcagggaaggtctgggctttatctctgagcacctctgtgtgctgctcaccctgaagtgggggtgggcctgtgcctggcctgtcccctcatcctgggagctcccaatgcccatctgcaaggctgtggacccctcaggagtggcctggagcctggctcccattgccacatggtggctgtgtgtgtggagagggttgatagtggagtggtcaggcccaggctgccctgggggatgaagtgccatcctctgggtgccctggagaaagaagagaactcagtgagccctgtctggtactttcctggaggagggctcccatgctggccctccacccctctgtcccctgtcaccctgaggcctctggatttcctctctgcccttcccaacctgccaacttcacgggtttctggctgggttctggggatggcccctaggggagacgggccaggcacaagcggggctgtgtcaaggtgggtatgcaggggtagcacaagtgtgcagagcctggggaggcatgggcaaagcatggcaggcggcggggcaggggatcttggaaggtcacgggctggggagcagtgtgggcagcggcccagaggtgggaaggccgtagcttagctgggtgtcccctttctgtcctctgcaggtggagccccctgagctgcccgctgatctgcagcactggatctcctacaacgaggccagcagccagctgctccgcatggagagtgggctcagtgatgtcaccaaggaccagtgaccgccaccttcacaccgtctgccctggccaccatcctgggcctgggggctgcccacagatgggcagtctcagccatactctgttccagctggagtagcctcctgaccagcctggcccaccctgctccacccactgggcccccccagttattgatacccctctgtgctgggctccacgctaggcagaaggaggagtggcattggcatcctgacccagctctgccctcaaggtggggatggatgggcaaaggagagtcctgcctggccctacgatgaggccactcatgtgggcctaggtaggggaggatggtgcctggagcagagggacccacaagtgcctcccgagcctagatcctggctcggaccactgcaagggccgaggcagggccagaccagagcatcctgggtacaggcctgggctctccagggcctgggcctgattcaggtgcagtgggcactcctgaagggtcagagcggcatctgccaggcagcccctctggcttccgctgaggtggttgcaggcctggggcagagcctgggtggtcagaggccggggctagaggcagatggaagggaggcatttgctgacagaggacggggcacccgggctccccactgcagtcggccttgcctcctcctcctcctctacctccagtcaggctggacgggagggtagccttgtggctgagaggggtcagactaggtggcacaggggctcctggaaagacagcaggcttcctgctgggcgttcccttgttggagggaatagagtgggggtgggactctgcaggggtgtccttgtccactcgcacccctcgccgcccaccagggccatgctctgtgacttgggctgatccccaccctttctgggcctacagcaccacaggccgctgtacccccttagagctgcccctctctggcctggccggcaggcgtcttcttaactcctctgtcctctatattcagcatgttccttgtcagctgctgggccggccctgccttgcgctagcagagcctctcctggcagcttctcaggtctccctaatggagacaccaggctactaggacactggctggggccaccccctcctgcctaatgcctcaccttacagctggggaaactgaggcctggaatggcccagagtcaccaaggcaaagttggggctggtcccagcctgaggctccagctgatgccctcagctcccagagagggggtgccccatctagctgggtgcaggggtcactgcttgtcagctcagggccctgtgcccgcttgcctgttcccctacatctgtgcctgcacatccagaactgcctccttgccgctgcctccaggaagcccaccttgagccagagtcaagggctgcagcactgcccgatagaacacgcccgccctcactgctgttcttgccttacagccaccatgggaaagctgcaacctttctgttttatttaaagaaagcccaacattaaagggttttcattgc

SEQ ID NO: 38387 - DNA, 10266 bp, Homo sapiens
agtctgcgcggcgcggccaggcccggccgaccgcgtctcggtcttcgcgtctgccagcctggctggcagtccgtctgtccatcccgccgcgccggggcagtctaggcggagcgggggctcaggcggcggcggcctcgacgcggtgagaggagggggtgggggcgcccctcatcccctcccgtgggcttcccacccccggtgtcggtctccggttcctgagggttgggtccctctgggtccagcgcggggaggggcgggggaggggaggcggcgagctgggggaggggaccgggctgggggaggggaccccgggccgaggagccagcaccggtggtgagggcggctgtgggtaactgtgattgtgtggttgtcattgtgtgtctgtgtgtggttgtgtaactgtcatcgtgtggctgcatgactgggattgtgtggtttcgggaggtccgcgggtgtgtgtgtgtgtgtgtcactgtcattgtgcggctgtcgttgtgggtgtcactctgatggtttgtgtgtgtgtgtctggctatgctgtgactgccattggccccccgtgtggctgctgtctctgtgtgtgactgtcttggtgttcgtgtggttgtgtgcataggactgtcattgtgtggctcctgttgtgtgttcattctgatggtgtgtatgtgtgtgtggctgtggtcgtgcgctgtgcacctttcttgtgtggcattgtgagtctgtgtcatggtccatggatgtggccatgtggttgtagatggcaccttgtctctcccctgtgactgttggtgtgaataagagactgttagtgtgtgtgtggctgtcgctgagtgccttgtaattgggggtgtgacgctgtgatgagttctgtgacccccattgtgtgcggtgactcttttctgtgactcttaagtgtgttgcaggcctgactgtgtgtccctgactgtagcggtgtgggggcttgtgtgggactgtgatgtgtgtagggtctcctgacatgtctctctctgtttggcctggggtgggggtggggacttgtttgatctgtttggtgtctctgacaggctatgagcccactgtgtgtgagtatgcagtgacatgtgttgtgtgtgttggacacctgtctgaacaagggggcccctcttgtttactgcaaagtggcgcccagcacagcgcctggaagtcggcaggtgctcggtcttcactgtgggatgggtgaacgctatgccatggttgtgtgtgtgtgtgtgtgtgtgtgtgtgtggtgccaggatggaggctgcggctgggttgtgcttcctaagggtgacagcatgggtgactctgggtatctaggacctctggcaaccatcaccccatatcacactgcagagtgagtgtcgtggttggggtgctggacccagagtgcctaccctcgcctgcctgggcctcagtttccacatctgcacaatgggggtgaccatccctgccctgctggctgccaggagcggctgtgagtcttcaggcgtggatgcagcctgggggaagccatagggcgctttcacaggtgagatggggctgggagaatggatgcaagcaggtgtgactgtgttgagccctaaagcgctggggactgggggtagccttgggggagggaagaggagaactgggaggcagaccggctgggaagagggggaaggagggagaggcagttggcagagaaggagggcttggctatcagcccaaccagacaccaacaccacagcccatggggacagagagaggggcccctgcagaggccatggaggaagcgactcaggggaagggtctggtagggatgggggccccttgggaaagaggatggtgtcccctaaaaactagtggggacccttctaagtgccatgggggaggggttcccatgaggctggggagtctcttctaaaggcccacctcctaaagggcattgggtcagagcctcccatgtaggctgtaaaggaagggacccccgtagactcttggggagtggtgtcagaggaggcaggtgtccccagtagggtcaggaccaacagggcaggacctggattgcagaggcatggccagaaggttcaagggacagagtcagggcctccccgggtcttcagggccaggggtgtggccaaaggactcaggggatgaagccagggtcccggtgacctgagccttcccctaggcacaccccctgggactcccactccctccccacctctgcaggcctggccttcaccatggcgggagggagaccgcatctgaagaggagtttctccatcatcccctgctttgtcttcgtggaggtgaggacccccgtacctctcccagagacggcgtgcctatctctgtctctgtccaacctcagtctccttatctgtacccacttttccatctctgggatctcccttgctgtcccctttctcttgagaaatggttatgagcttagattcagaagtgccactccccggggtccaatccctctctgccccatccacactgcagggtgctggacaccacaggtaccctcctgagccacagtttcctcattcataaaatggacatcaccagagtcccaactcatagggctgttctctgtgtgtgtgtgtgtgtgtgtgtgtgtgtgtgtacgtgtgtttgagatagggtctcactctgtcacccaggctggagtgcagtggcataatctcggtttactgccacctccacctcctgggctcaagcaattctcctacctcagcgtcccgagtagctgagactacaggtgtgtgccatcatgcccagctaatttttgtactttttggtagaggtgggatttcaacatgttggccaggatggtctggaactcctgacctcaagcaatcctcctgcctcagcctcccaaagtgctgggattacaggcgtgagccaccacgcccggcctcctagggctgttctaaaggtaaaatatattaattcatggacaaagcttggtacgaccccctgcccacagtgagggttacacctgtggtagctgctagcacccctacttctctgatttctttccatgtgggagagtctctccacctccccctgtctgtctgtctctcatttgagccttggccctaatctcactctccccatgcccatctcttctctccctctctctacaactcccttcccttttcctttcccttctctttcctcttgctttctcctcttctcccctcctttcctggctttcctctctctctgttttttttttttcacttcttccttttctttctttccctccctccctctctctctttctttcttttgtgatggagtcttgctccgctgcccaggctggagtgcagtggcacgatcttggctcactgcaaactccgcctcccgggttcaagtgattctcctgcctcagcctcccgagtagttgggagtacaggcgtctgccaccatacccagctaatttttgtatttttagtagagacagggttttgtcatgttgtccaggctggtctcaaactcctgatctcaggtaatccacctgcctcagcctcccaaagtgctgggattacaagcatgagccacgttttaattttttttctttctttttgtctttcagccattccttttcctttcttttttttctgagacagggtctccctctgtcacccaggctggagtgcagtggtgccatcatggctcactgcagccttaatcctctgggtgaagcaatcttccttcctcagcctcccaagtagctgggactatagttgtacagagataaggtcatgcgatctcaaactcctgagctcaagggatcctcttgcctatgcctcccaaagtgctggaattacaggcacgagccgctgcacacggcccctctgtttctgtctccttctccttctgtttctcctaagccctgacccttctctcacctcctttccccatttctctcagtctctctcccccttgtctctgtctctctccatcttctagtttctgtctctaacccatgtttctccatctctgtatctctgcctctgtggcctcagctggagtcctgacctctctcttctctctccgccacctctccccgccctggcttggtggcagtcggtgctgctgggcattgtgatcctgcttgcttaccgcctggagttcacggacaccttccctgtgcacacccagggattcttctgctatgacagtacctacgccaagccctacccagggcctgaggctgccagccgagtgcctcctgctcttgtctacgcactggtcactgccgggcccaccctcacggtgagacaatgaagacctcctaggaggcaggtgggccggtaagggtgggtgaggggatgggctggaaggccagaagactccatcttggtcttgcccacagatcctgctgggagagctggcgcgtgcctttttccctgcaccaccttcagccgtcccagtcatcggggagagcaccatcgtgtctggggcctgctgccgcttcagccccccagtgcggaggctggtccgcttcctgggtgagagacatggcctggggtcagccccatggtaatggtggggaggtgggtatagaagaaaagagtcatgggcctgacagtcataataattccaggctgggtgtggtggctcacgcctgtaatctcagcactgtgggaggccaagtgggcgatcacctgaggtcaggagttcaggaccagcctggccaacatggcgaaaccctgtctgtactaaaaacaaaaaattagctgggcgtgtggcaggtgcctgtaatccttgaacccgggaggcagaggttgcagtgagccaagattgtgccagcctgggcaacaagagcaaaactccgtctcaaaaaaaaaaaaaaaaagaagaattccagggaaaagctgggcatggtggtacatgcctgtagccccagctacttgggaggctgaggcagagactcagctacttgggattactagctacttgggagactgaacaagatcccacctctttaaaaaaaagggaattccaggggggaaggaagaggacctggaattgccatgatggggatgttaggaagcaacaagggacttaggctcagaccagatgtaatggaggttctagggacatgggtggggcctaacccaaccatgatggcaactgtcggaagagggtcccagaatgccataaggagagtctcaggcacaaaagagagacacaggcacaggacaaacaccctggggcccctgggtgagactctggctgtgctttaaatggggtcccagcctcaagtagtggctgtgggaaagggggaggggcagaccttacctataatgatggtcccagggcagagggcgggagacccagctctaacttattagtggccccaggaggagagtgttgaactcagtagtagccagtttaggggcaggcaggaagagccccaggtatgccattagggttttccctagccgtcctaggcatggggtggatcctgatgtaatggtgttggggcgggggtccaagcccagctataatggggctccaagggaggatccgcccctgacatagtggtaatcctagaaagacaggggccagataatgagggtccctgggggcaggaggcctcagagtaccttcatggtggtcttaaaggaagggggatgttggcacaactacagggtcccaagtgtgctttaatgacagtcacaggaaaagggagctaagaggcccaatggaatcagtgggagcatcagggcctggcgcatgaaccccttccactatcccacccctaggggtctactccttcggcctcttcaccacgaccatcttcgccaacgcggggcaggtggtgaccggcaatcccacgccacacttcctgtccgtgtgccgccccaactacacggccctgggctgcctgccaccttctccggatcggccaggtcccgaccgctttgtcactgaccagggtgcctgcgctggcagtcccagcctcgtggccgccgcgcgccgcgccttcccctgcaaggatgcggccctctgcgcctacgcggtcacctacacagcggtgagcttcgggagcttcggggtcggaaatgggtgtgcaggctggacagcgaccagcagctaggaagccgccagggttggagcctctgctcttccacgccccgggtgctgttggaagctctcgctccacgccccgacctgttggaagctctccctcctcctcccagatcctagccacgcccccagtcagaggctatcgctgtccattgactccgccccttgccctctggccacgcctcctgagccagtaatgcgagggaaactgttggctctaccctatggcatcaggacagtccctgatgtgcaagactcggaacccctatagcctagccaggcccccaggatgctacaggcgctagatattagctggcagactgggcagatgggacggccccctggagtccttgcccctcttctggagcccttgcccctctcctgggggccttgttccctcctgttgtagccctggccacgccccttgctcttaactgctctgggatttctaactctgtcccctgctttttcctggtcacatcccctgttgcttcaactcttttttctggcatccgggtttatgctcccaccctgtcagtggtcccctaggggtcaggggctccacctcctacagctcctacagctcctacagctcccttcgccctgactccaccctctggttctgtggccacgccctaatccagtaagtgtctgtccccatctgcgactccggaccagggacacctgggccccagaccttgtcctctgctcttgggagctctggccacacctagccctgcaggtggtgcccacgagactccaagacctcaatccctgacccccccccctttgcctttttggtcacgctccctggaaaagcccactgggagcccatgactccaaccctggagcccctggccactccctccagccccaacgctctggccatgcgctctagcccagaaaggagcgtccacttgggttcggcgacttgcctccgctatccccctgaccagtccggctccccgcagatgtacgtgactctcgtgttccgcgtgaagggctcccgcctggtcaaaccctcgctctgcctggccttgctgtgcccggccttcctggtgggcgtggtccgcgtggccgagtaccgaaaccactggtcggacgtgctggctggcttcctgacaggggcggccatcgccacctttttggtgagttgcctcctcaaccttcccagcatggaagaccctcaccagctctctgacccaagaggcaggaccacatgatggagaagggtgtggactctgtgtgaccttgggccaatcccttaacattacccttcctggatattctcatctgtgaaatgagataccaggatcagggtgaggcaaggccttgaatgcaaattttaagagggtgcccaacactcagtaatcaagattaatattttaacaaaacatttttaaaaatcaaagttaatacaaaactatcataatgtacagaatataaaaattctaaataaagatgaatcaaggctgggtgcggtggctcacgcctgtaatcccagcactttgggaagctgaggcaggcggatcacttgaggccaagagttcgagaccagcctggtcaacatggccaaaccctgtccctgctaaaaatacaaaaattagccaggcatagtagtcccagctacttgggaggctgaggcagaagaatcgcttgaacccgggggacggaggttgcagtgaactgagatcgtgccacctcactccagcctgggtgaaagagcgaaagtctgtctcaaaaaaaaaaaaaaaaaaaattagctgggaatggtggtgcacacctgtggtcccagctactcaggaggctgaggcaagagagttgcttgaatccaggaggtggagtttgcagtgagctgagattgcaccactgcactccagcctgggtgacagagtgagactgtctcaaaaaaataaaaaattaaaaaaattaaatcctgccactgtacaacttggtcttacttactttagcctagtgtggggtctgtgggataaataataattgcacctacctcagtaaaatggaaccaacagtgcctggcacatactatgcattagctgtttttgaaaaccggagcctcactttccttatctgaaaaatggggatggtatttacatggctcctatgtgacttgccccaggcctcaacactctcctctccctctattccaggtcacctgcgttgtgcataactttcagagccggccaccctctggccgaaggctctctccctgggaggacctgggccaagcccccaccatggatagccccctcgaaaagttaagtgtggcgcaggtaaggggggccgggggctgctcccggctggagagggtggtgggtggagggggccaaggagacaggaaggaagtcaggcaagaggtgggggtctcagaaccatggggaagtggagggatcacccatctctgtggacataggtcctgggcggacagccccaaagaatgaaagggagcacccccgtcttcttcccagggggacacggttaatcatgagaactgtggttgtcttttccatggggctcttcacctgatgagctccttgtggctgtggccggtagggcccagggggccactagccccttccgtctgtctctttgtctcaggaacccgaggtctgcaggccgcattcgacaccggcacggctcaccccatccagtgagtgttgggggagtggggggctaaacagggggacttccaggtgggcagccactgccccagaggtctcacctaggcctttatgctgcctcccgagttttctgatcccctgatatctggcttctgaccaccagagtcgcagaactgcgcccgccgtggccacctgatccccagctgtgtctcctccagggccccagccatgtgttcgtcgccccgtgtgccccgtcctcgattgaggtctgagccgacgcccttgcccctgcccctacccctgccagcgcccacccccagccagggcccctcgccttcctcccctggacctggggggccaggcgggggtggtggacgtggccggaagctgctgctgcccacgcccctgctgcgggacctgtacaccctgagtggactctatccctcccccttccaccgggacaacttcagcccttacctgtttgccagccgtgaccacctgctgtgaggcccgaccacccacccagaatctgcccagtccccacttcttccctgccacgcgtgtgtgtgcgtgtgccacgtgagtgccaaagtcccctgccccccaagccagccagacccagacattagaagatggctagaaggacatttaggagacatctgcctctctggccctctgagatatcccgatgggcacaaatggaaggtgcgcacttgcccctactattgcccttttaagggccaaagcttgaccccattggccattgcctggctaatgagaacccctggttctcagaattttaaccaaaaggagttggctccaaccaatgggagccttcccctcacttcttagaatcctcctgcaagagggcaactccagccagtgttcagcgactgaacagccaataggagcccttggtttccagaatttctagagtgggtgggcatgattccagtcaatgggggaccgcccgtgtctaagcatgtgcaaaggagaggagggagatgaggtcattgtttgtcattgagtcttctctcagaatcagcgagcccagctgtagggtggggggcaggctcccccatggcagggtccttggggtaccccttttcctctcagcccctccctgtgtgcggcctctccacctctcacccactctctcctaatcccctacttaagtagggcttgccccacttcagaggttttggggttcagggtgctgtgtctccccttgcctgtgcccaggtcatcccaaacccttctgttatttattagggctgtgggaagggtttttcttctttttcttggaacctgcccctgttcttcacactgccccccatgcctcagcctcatacagatgtgccatcatggggggcatgggtggagcagaggggctccctcaccccgggcaggcaaaggcagtgggtagaggaggcactgcccccctttcctgccccctcctcatctttaataaagacctggcttctcatctttaataaagacctgtttgtaacag

SEQ ID NO: 38388 - DNA, 31136 bp, Homo sapiens
ggaagtcggaccagccggccggcggaagaacctagagcgcgctgcctggcgagtcaggcgcgcggggcggcgttggtggtcttcgcggcgcaactcggcctttcctgggagggagtgatggggcgcaccggggccggggagcgggcgccagtgtagcccgcgcggcgcctggcccggagcgcggcggctgcggcggcggcggcggcgggcgctggaggcctgtgagagccgcagcccggagcgcccggcttcccacgccatggcccccatgggcatccgcctttccccactgggggtggcagtgttttgcctgctggggctcggcgtgctctaccacctctactcgggcttcttggccggccgcttcagcctcttcggcctgggcggcgagcctggcggcggcgcggcggggcccgcggccgcggccgatgggggcaccgtggacttgcgcgagatgctggctgtgtcagtgctggccgcagtccgcggcggcgacgaggtgaggcgcgtccgcgagagcaacgtcctccacgagaagtccaaggggaagacgcgcgagggagccgaggacaagatgaccagcggcgacgtgctgtccaaccgcaagatgttctacctgctcaagaccgccttccccagcgtccaggtgggagcccacgggcggagcgcccactcgagccgggtagcgcgtctcggcccgtcgactcttaacagtatgggatgtggagcttctggttccattttgtagatgtggaaattgagacgcagaagttaacgtgcacaaggtcagacagacagcagaggagctgggtgaggttgcacgtagtctgactcagggcccgtgcccttttggctcgtcctgggtcgggtgtgcgccgtgtgtacctgggatcagaaggccttgaaacgaaaaggctgacaaagttaattgcacccgcagcttcaggctcctctgtagaattaaggggttggctaaaatccaccaagactctctatccttccttgatttcatccctagaagggtcgaaactggagtacacattttctgggtggcctgccagtagccagctgaaagaccgagtcttgttgcagagctgttagtgtgcggggcatttgtgtgtgcgtgtgtgcgctcgcgggagtcggggtgggggggtgggggatgagtatgctcatttcgctgtctttttgtcaggacgctctaaagtttatagtttgcgggccctttaaggaggtacttagaaatataccagctgttggtcctacctggcccttgattaaagatccatatttactccagagaataagaattaaataacatttggcttttctttgggtaggtttctgggaagggagttgacattttcttaaggaaatccagacattttggatttgttattaatactttttgaattcatcatttcactggagctgctattgagttgaataaagcatatttaaaatttgcagttccagaaactgcaaattttgttgaggaagagctcagcatagcgtagcagcaccttattaacgtatatcttaactcacctaactgtagttttggctactgggaagaaaaattgtcttcactggaattttattagataaacagtgatgtgcaaacccaggcttctttggaaggtgactgaccttttactgctgatcttgaaagagttaggagaatattgtcattgtttagttatgtattttgcataaggcttcttccagtctatcataatattgctttggttttgttttttattctcctctcttcctcccttttctttcgtctttttctttttccagtggaaaggaacattgtatttcctaacatgagctactggataccagatgtaattaacgttagaattttttttttcaaatttctacttaaaacacagaatatttccactttttcttcttccctactctgtttttatcatcacaaataatacttaaatttttttgcatctagatgtaaggtgtgtttatgaaatattttaccccctttccaaaacatacgtgtttccttccccaagaatttatagaggaaacaggagattcagagaagttgctatttaatggttataacagtactaataataaccatttattgaatatattttacatgcccaaatactggctacacaggacttcatttgatccttaacagcaactttaagaagtaaattttatttctgcctactatacaaacgggaaatctgaggctcgtgacactccagcttatatgaactatcccacattttagctagatttttagaaggctatttaaaacttataattgtagaagcttaaaagcagtaatagtgaaatacagcaagcagagttgatttttctttttttaagtaaaaacaaaagtatcttaaatgttgaaaacacatctgtatgtgtgtgcattctcatttattagcaaacaataagggaatggctgccaagggcagtgagctgcattttattaacataaaagctaagcttttggaattgcagatgttgaagtctctggcttaatataaaacaacttcttgttttcttgtgactatttgaatgtttgcatgtgcttctgtagtattcatgttgggtcatgactgaaggaatagaagaggtttgtgatcatttatacagtgtcaaagtagggatggtgtcatgttgagcgatctccttatacccctgtgttataggctagaggccaaatattgtagccaactaagtggagaatcaacctaaaaggagtctttctccttttttgccttcccctctcctaatgcccagaagtacagtcttaaatccctggttaattttgaagcctcaccccaaatttcttggtaagaaacttaaattatatcccacttagtttacttcctagtggaaaaagaccattgagaagcaacagatacttctttcttttatcctagtgccctatgtaaatgtagaaagatctgttttctcccactactttcctatgtagagtctgaagtctgagctttcgtatgtaatgttcactcctcagtaaaaggatataccaggggttatcctagagcactcaactggagacagttttgtcccctaactgacatttgacaacgtcggaagacatttttgattgtcacaaccaggggtgggatgctactggcatctagtaggtagagggtaaacatcctataatgcacaggacagccccctatgacgaagaattatctgctccatttgtcaattgatgcccaagttgaggaatcatactccagagaagtgagtgctatcctaacaaaactcagatttcacctaggctccctggatttccttttgtcttcagttttcttcaggttagagatcccagagagtcctctgggcagctagtctcctcttcctaaacactttggcaatgcttgacttcattgtgtcaaagtaatagtaactccagccatttgtatggcactgtctctttatccttgcaggtaacaatgaaaatgaaggctgaagatacttttgtggagtgggtttgcagccacagaacagacaaactgagatttatagttttgatttaatgtacaggggactgtctgtttgaggggctcctgtcctcaacttgatttgttcaaagttttgacaatgacttatttgaaggtaaagcatggtactccaagctggtagcagccacttgggtctgtgccttccttgacctataagatggaagttaagcttctctctttcaacagaagtatgtcccagaaaagtttgagaagcactaatatagtgcacagagcacttgcattgacatgttgtgcagtcaccagcctaggtggtactggccagtcatttaacttttttgagccatagtttcctcttctgtaaaatcagaataactagtaattggtgtagacataagcactgaaaacagaggaaaagaatctagttcaaaggaacaggcccaagagagatagtaggacagctaattcttgtaatctaatgagtttgagtaaaatgcacttgggagaattattgtggaagagattggaaaggtaggtaggggctaggtcatattccaagctcaaaggaatttggacctagtccatggtttactagtagaatactaaaagaaggccagatttagctgacttttcttgaggcctgcaataagccatactttgggctttgggcatttggaggtagataggaactagttagagactgttaaaacaggccatgggagagatgaggaccaggactcaagcagtggggaagttatgctgagcttgttttactagctaacatttgcatagccttctgcaagccacaaaaattgaattaaacttcttaatgacattattaattttatcttcacaacaacaaaggaggttaagtactacagcctctgtttttcagataaagacttggagaggctaaataatttgccaaagattgtccagctagaatttttttttttttttttttttaaagatggtgtctcgctctgtcgcccaggctggagtgcagtggcacaatctcagctcactgcaagctctgcctcccaggttcatgccattctcctgcctcagcctcccaagtagctgggactacaggtgccgccaccacgcccagctaattttttgtatttttagtagagacggggtttcaccatgagaataatcttagagtcactgagattgacataatggtcagagaatcatctcaggtctgtctaattctctatataaggcggtatagcagatgtaacaagtatactcttaactacagtgttaaaaatgaatggaaggactcagagtagttgcttggaggatggtttggaggggagcaaagtaaatacagggagaccagttaggaggccctttttcaggtgagagcttatatcttttgaattagggttatggttgtagagaagatagatgtagaaggaagtgaaagaatttttagggatatgtcaaaaataactcctctgtagctttcacaattggggttttgttgctggtgaaggggagtggtggttaagttggaggacagattatgaatgccattttagacttgctatgttagagatgcctttgatatgtccaaggttagctgtcaaagagtcagttgaatatatgagtctgaaggtctgaagaaacatctgaactgaaaatacaaatctgcgagtcatcggtgttgtgatgttaattgaaactggttgtggacagaattggttagggagagaatataacatgaaaggggaatatcagggcctagaaccaaggataatgaagactgaaaacaatcatttaacaagaatagtagcaaccaacctttattaaatgcttactctgtgttaagcactgtactaagtttgttttaccttttctctttcagtcttcttaagaaccttacagggagctagatcattgtccctttttaccaatgaggtaattgtagctcagaaagtttaggtgactagcctaaattattcatatacccaataaattgaggagttggcatttgaactcaggcaacctatgattaggaggtgaggaaatggagactgtgagtaaagacaagttttgtgagaaattgggcttttaaggaagttggctggggtgttaggtgtattatgtttcctaagagaaggttctgtgctttctttttggtatatttgtttttaagatatgagacactacagcatgtttaattgtttatagagctatatttgaaagacaatagttgatagtaaaaggtttctgtaaaggtgggaagagaataggacaggtagaggtacgtttatttatatgtttagaaaatagttattgaggcctggcgtggtggctcatgcctgtaatcccagtactttgggaggccgaggcgggtggatcatgaggtcgggagattgagaccattctggctaacacagtgaaaccccatctttactgaaaatacaaaaaattagctgggcgtggtggcgggtgtctgtagtcccacctgctcgggaggttgaggcaggagaatggcttgaacttgggaggtggagcttgcagtgagccgagatcacaccactgcactccagcctgggtgacagagcaagactccatctcaaaaaaaaaaaaaaagaaaatagttattgaatgcctactgtattggtcagggttctccagagaaagagaaccaatagagatttattataaggaattggctcgtgtgattaaggaggctgagaagtcccttgatctgtcagctggaaacctgcaagctggaaacccaggaaagcaagtgatgtgattcagtccaagtccaaaggcctgagaaccaggagagctggtggtggtagtctcagttggagggcaggagaagactgatgtttcagctcagcagtaaggcagaagaaggggcagtctttcttctccctccttttgttctattcacactctcaaaacattgaatgctgcccacccacattagagagggcagtctgttttattgagttcactgattcaaatgctaatcttatccagaaacaccctcacaaatacaaccagaaataatgttagccaaatctctgggcattccataatccagtcaagttgccatatcacacctatggtatgataggcactgtgtgaggttaggatataatgatttatggagaaatgaagtaaatgatcgattccttcttaaggcattaaccagaagtcccttcaaaccccaaagtaactgaactagcatactaatggcattgattgtgtttgggggccttgaactttgacaatactgatggagaatagtttccttcccctttctggaatttaaaagactagcctaaatacacttatgtgtgtatatgtattatatgtatatgtatatgtgtgtgtatatgtccatataattaaataaaatctttaaatagacaaacttgtcttaagaacctttgtatagctggttcccaacttaagatggttcaacttaggatttctttacaatggtgcaagaatgatatgcaccattcattgtaaagaaactatacttgtagtacccatacaaccattctgttttccagttttaatagagcagtcaataaattacatgagatatttaacactttattatgaattaggctttgtgttagatgattgtgcccaactgtaggctaatgttagtgttctgactacatttcaggttggctaggctatgctgtgatgtttggtaggttagatgtgttaaatgtatttttgacttcagatattttcaacttatgcagtacaaatgcttctcaattcacaatgggtttatcaggacgtaaccccattgtaagttgaggagcatttgtattacataagcatttgattcctgacccctgacttggttgtactaattttaaggtattgtttagcatatagattaaacattttctgtcctcacaattacggaacactcctactattctgtacctattctcatctaatgctgcctcatttaagctgtgctttcccttcagatctgtacctagctattactattttatcccccaaattatttttcctatttcccctacctcccatccagtaacagcaatgttttttttgttttggtttgttttttctcagagttcctgatgcaaggttgaggtttaaaggaagagactcaaattaaattgattcacacgtgtgaatttcttctggctcttaaactacttaggagtatttacttttataaaagggaaaatgcattagtcaggaaagactgagtaggaaatgctgtagtaacgacatcctccaattctcagaagcctgacactctccaaagcagttgtcctccatgtagtgactgtgacctagttgatgttgatatgtgattctgccatgtcaacatagcagggaaagagaagagattggagaattgggcaggagctttctttttattgcctaagccagaaagtgatgcgcattcacatttttgtccatattttgtacatctacatttttgtctatattctgctggccagaatcactctcatttgcctctaactacaaggcacatgggaagtatagccttccagatgttcaggaaggaaaagaaaagtggacattgtgagtactagaaatgcctacacagaaggcaagttaacctaaagaaatccctacttgctatacatagaggctaacaaaaggatctgagaatgttttgataattgccaggtgtaggtggagactgcaagatgagctattatgtatcagcatagaccaagatcagtttagtgttttctgatttctagaacctttttatgcttacccttctaaaattataggttctctaaaagctgcattgttcattcccaccataatgggcttctttgggagtgattggctgggtgtcgggagggggcagggattggccagggctgttagtaggtatgggtttttggagcttgggttgatttcttatgcttcaattccctgttgaggtctttgacaggtagtaaggatgaggaaggaagagtaggttgagtggaagaggattatggggaagaaatgaaaaactacagtggctgagaataatattgtcagttaagatgtatttattgagtacctactttggtttagacaatggggatggagctacagtaatgaagaaaatttgtgtccttgcacccacagaatttacgttctagctgatcaagatagtaaatgtaaacaagtaacgtggtttctgataagggctttgaagaagaaaaaatagggtcatgctgggagagtgtctggtggtccttctttatcaatggtagtcaggaaaggccactttgaggcagtctcatttgagccgagaccttaataagaaccaggatgtcatgcagagatctgggaaagcgtgtacaagcagaagaatacagtaagtacaaaggccctgaggctgagtgaccatgagaagactagtaagtctggggtacagtaaataagggtgcaaacaagagagagattacgggatagcacttactgctgtcattacccagatcatctggaacttaatgttgtagattatgataaggagtctggattttatctctgcataatgagaaaccattggaaggttttaagctagggtgccacggtctgatttaggaagatggcaggttgctgggttgagaagggaagctctgtaaaagcagtgattttgtctgttttgttcattactgtatcccaatgtccaaagcagtttagcgtatatagccattagatgttgaatgaatgggtaaatgaatatattgtaggaggtgagaacaattgaggactattgtagaaatccaggtgagagatggtggcctaaactaagattttcttggtagacatgatgacatatttagaattgggaggtagaatttccaggacttactgactgattcgatgtggcacgcgagaaaggattgaggaagactttctggtgttgaccatagcaactattgataaggttgtttacattggtgggtagtagatttttcagatttgtaggtatgtagtggttgcggccggttataaatagcagttactcaaaagcagattaggtatttgtgctaatgttcttgttctcctgctgtttctccctaacccgattctcagtgaagatcttttcaaatactgttctataatgtgttcgctcatactcagctgcaagtacatggagaagctgacttgaattgtgcaaaaaatcagtgaagctcagtagttgccagacttggcactgccgttttgtaagctacagtggttaaggcccataagctacttcgtcttttctaggagtcatgtttcttttttttttgaagtttattcctttttgcatggtgttactgttatcttcattcatctgaggtagtctggcattgttgttaagagtggtttctgaagccaaaatgcctcaccagtgccacactgtcttaattattctggtcttgatatctggtaaggtaagtcaccacaccatgatggtattttttttcccctcttcccaaaatgttgtgttgcttcttgactttttgttctaccatgtaattttcagaaatgccttgtccagtttccaaggagaaggttaaaaaaaaccaacaacaacaaaaaacactggggattttgattggagttgcatttatctgcaagctcttttagattttctcagtgctcaataatcaacttcatattatggattggtttttctttctaaactttgtacctccccacttgctcctctccccctccctttagcttactgcaatgactaggaccctctgcacattgttaatagctgttatgatggagggcaactggctctgtgttgcagcctgcgaggtccttcaccatctggcttccattactctctgacctcagctccttagcctttctccttggctcactctgctgtagccttgctggcctccttgctgccctctgaacacaccaggcacattcccaccttaggatcttttcatttgttatttattgggctagaatgcacttctagatgcctgccaggcttattttctttagatctcttcagtcaaataccaccttttcagtgaggggcttctctagctacattacttttttttcaaaacaacttcattgcagcatagtttttatatcttacaatttgtctatttcaagtatacaattcagtaatttttagaactgccaaattgtacaactatcatcattaatcagttttagaacattttcaccaccctaataatacccctgaccccattaactgtttattcttgtttttatcccttatcccaggcaaccactaatcggtctttctctatagatttgcctttccggacattttacattaatggaatcaaacagtatatgatctcttgtatgttgatgctttcacaaagcaagggggttcatccatgatttagcatgatcaatactttattcgtatatatggctgagtaactttccattgtatggatataccaaatatatttatccattcatcagggtaatggataaactactaattgatggaattagtagttttctgattttagccattatgaataattgcctagccaccctttcttaatactatctacccctttttcttaaagaataacccttccactactctctaacagtcctttctctactctccaacaacactctttctgtccttttggtctttattttttcctccttatcactatccagcatactacatgttttttcatgtgtctcgttgtttatctatactagaatctaagttccacagggcagaaatttttgtctcacattgatcactgtggtatctttaagacctgtaactgtgtctgtcatatagtaggcaatcaataagcatttgctgaattaataaagacataagtgaataaattgaatgtttactttgctctgtactgagaaatatttaaagatttaccaggcgcggtggctcatgcctgtaatcccagtactttgggaggccgaggcgggcagatcatgaagtcaggagatcgagaccatcctggccaacacggtgaaatctcgtctctactaaaaatacaaaaattagctgggtgtggtggtgggtgcctgtagtgccagctactcggaggctgaggcaggagaatcactcgaacccggaaagtggaagttgcagtgagccgagattacaccactgcactccaacctggtgacagagcgagactccgtctcaaaaaaaaaaaaaaaagagatatttaatgatttaagcggtttgatgtttctagaatattagtatttttaacctctcctgtgataatttggggtgtttcagggtaccttctggagattggtgatagttatattttttaaaatcatgtctgtgtctctgcaactttctgaagactataggtgagagatgttgtattgacaatactcatgtattgtcagtgctgtaatcgctttggcactgtagcgtggggtctaggcatggcatcacatgtagcataaacatgacctactctggaaagggagcttgtcagaaagcacaggacccaacagcctgtcctgctgagagtgtaagtccctaactaaaatcaaaattttggggacattttttcttgtgtgtgtgtatgatgatgtgatagaagtctcatggtgaggcagtattcatataagattgatgatctgttattaacttaattcttaaagaacactcaattcttagatttagtcaattggtatatgccagtttacaaaagtaaatgcagttctaaaacatttttttattattatttattttttgttttttttgagatggagtcttgctctgtcgccaggctggagtgcagtggcgtgatcttggctcactgcaacctccacctccagggttcaagtgattctcctgcctcagcctcccgagtggttggaactacaggcacgcaccaccatgcctggctaatttttgtatttttagtagagatggggttttaccatgtcggccaggatggccttgatctcttgacctcgtgatccagccgcctcggcctcccgaagtgctgggattacaggcgtgagccaccacacttggccaaaacattatttttaaaacactgttttacaaattagactaattttaggatgcattaagaagcacactgttgaaaacagtgttttttacataggatgggacaggggcgcacttgacaatgtccggagacatttttgtttgtcacacctgagggtgttgttgctggcatctggtgcgttctagtggcattcagccagggatgctgttaaacatcctacaatgcacaggacagccccacaacaaggaattatacagtccaaattgtcagtcgtgccaaattgagcaatctcaatttaaaggaatctgtaatgtgtttgtaaatgaatagaatacttacataaagtattatacaaacacatgtatatatatgttatatgtagaaataatatataatatatattatacagagagaatatatatgtgtaaggggggtttgtgtgtgtgtgtgtgtgtgtgtgtgtgtgtgtatatgtatgtatgtaagggtgtggggtaaggagagaatatattccttaaggagagaatatattcctctattctcgtaacaacccttcctctacttatatttctctccttaccccacatccttacatatctgtatggtaagttaaatttattttatcttttaattttgttccttagttaaaaaaaaaaaggtagaaaatttgactgtacctccctattctatgatacgtctttcttctaactctagttgcttgtgttgtgttccagaatattgtctattttcacactttagagctattatctttcataaagcattgttaaggtttaagtagcttgtttcttcaatgctcagtttctctatatttctctatatccgaattatctgtcttgattagtcaacaaaccaggcttgaatattagattgggaagcatttaaagacctgatgtcatggatttttttttttcattttcattttcattttgcaatatggagcatcaaaagaaataaaaatagggatttacttatttataatttgggtgattgttgtctgaaatacttttgtagtttatcaaatagtgattgttcgtcttactttttttaactgtcacctgtttttaatgcagattaatactgaggaacacgtggatgcagctgatcaggaggttatcttgtgggatcataagattcctgaggatatcctaaaggaagtaactactcctaaagaggtaccagcagaaagtgttactgtctggattgacccacttgatgctacacaggaatatacaggtaatttttaaactgaactcaaaacatttgattgacgtttagtagtagagaaccagaaccaaggcatacttcctataggtgatagtggctcactgattgttcagtaaagaagcatttttaacagtagtagcaaaatgttttatattggacacctataattgaagaaacttctttagccagaatttaatgtttactcgggatgttaggaatttaagttttaatgcatgtacatctgactttggaattcaaaatagtaaatttctaggtacccagaaggcaagtaagtaacaaaacagaactactgtccctccagtccccttttttacctagtcctagtcagattttatttttgtagatcccctctcaggccttgtttcttacccacaggtagctaatttctgccttttcactcttcatttggtttatatgttacagtttatctatttatcctgatagatggtaagttctgtaaatgtggagccttctacctttttacctttgtatttcagtgcttttgcactgaacttgaaccataacaatcaatacataactttggagaacagggagaagacactagatgtatatatctaatagtaactaaaattacagcacagaacttttcaggagtagataatagaaatatggaatatcgagaaatttgttcataaaaagttctcctaaactgagattggcctgttcatatagtaataacatttagtgagcacatccctcgtgcagggactttcttaagcatctaatttgattttttttattaaaagttaatttatacctaaagatgagtgcttagttattgtttatattatacagacaaggaagctgaatttaagtaatttactcaaggacattcagttaacaaaatggtgggctaggagaataacccaggtaatgcctgtagaaccagaactcttttgtttgtgtgatttttataatataaaagggtcttgactctaaatgcaatttgttttaaaacttttaagttcaggagtacaagtgcaggtttgttacatagggtaaacttgtgtcatgagggtttgttgtacagatttgtttcaacacccaagtattaagcctagtatccattagttatttttcctgattctcttcctcctcccactctctatcctctgaaaggccccagtgtgtggtgttcccctctatgtgtccatgtgttctcatcatttagctccccacttagagaacatgtggtatttggttttctgttcctgtgttagtttgctaaggataatggcctccagctccatccatgcccctgcaaaggacctgatcatgttcttttttatggctgcatagtattgcacggtgtatatgtaccacatttttttttttttacctggtctatcattgatgggcatttaagatgattccatgtctttgctattgtgaatagtgctgcagtgaacatacacatgcatgtgtctttataatagaatgatttatattcttttggaccagtaatgggaatgctgggtcgaatagtatttctttcttcaggcctttgaggaattgccacactgtctaccacagtggcttaactaatttacactcccaccaacagtgtataagcattcctttttttccacaacctcacttgcatctgttattttttgactttttaataatagccattctgactagtgtgagatggtatctcatcgtgaaccagaactgttagccactcctttaaaggggctcttgccctcagactctgtttgcttgaagggattgttgttttggaaagatatttcatgtatataaattttttaatgaactaaagtgtaatattgtatcttgaatttatgcacattactttgacatttgtgtgtgttgttttgttttttttctcatagaggatcttcgaaagtacgtcactactatggtgtgtgtggctgtaaatggtaaacccatgctaggagttatacataagccattttccgaatatacaggtatgaaatttgctagaactttcaagaattattgttattgaactgtttgtctatagtatttactgtcatgtacctaaatttgtatccactcctatattagtttcctagggctgctgtaagaaaaaaacacaaattatgtgtcttaaacaacaaaaatgtagtgtctgacagttctggagcctagaaatctaaaatcgtggtgctgaaactgtaagggagtatcttttttgtttcttttagcttctggcaatttgccagcattctgtggtgttcattggcttataagtgtttattccagtgtctgcctccatcatcatatggcattctctctgtgtgtctgtgtctcttctcctcttacaagcacaccagtcatattggattcagcgcccaccctactctagtgtgacctcatctcaacgtagtacatctgccatgaccctatttctaaataaagtcagatttcaaggtgctgggagtgaggatgtcaacatatctttttgggggacacagtttaaccataacaacccagaaagttaaggtaagcattgagatgagattatactggattagagaaggttcttaagccaattagagtgtttttataagaaacagaaaggacatagacacatgtgggataagatgatgtgaaggtggaggcagagattggagtgatgtctttaataggctaaggactgcagtcaccagaagctaggagagagccatggaagttattttccctcaaagcctccagaagaaactaaccctgctgaccccttgattttagacttctggcctttagaattataagaaaatacatatatttttataagccaccaagtttgtggtacagattgagtatccattatctgaaacgtttggggaccagaagtgtttcacattgcagatttaatgtatttgcatatatataatgagatatattggagataggacccaagtataaacatgaactttatttatatttcatatatagcttgtttacatagcttgaaggtaatgttatacaacattttaaataattttatggttgaagcaaagttctatctgtgagctatcatgaggtccagtatggaattttccatttgtgacatcatgtcagtgctttcctggattttggagcatttcagattttggaattttggattagggattctcaacctgtagttttttatggcagctttaggacactgatacaatgggcatcccatactaccatcgtttactgcagtcatccccattgtgtcttaagggcgtgactgataattgcataaaaaggctgtctgtgaagtggggagaaatggaaagacaaagttaatttttgattactctaaaattatgtatttgttttgctgaataactgtgaatcccaaattctggctgctctgagattggctaaacatctatttgagtgttggctctgtgtttcaaaatcaagtccactttgtgctatctgaccttttttcttcttttcataattcaaataatttttaaagttgatggtttgataagctacaaaagatttatgccattgctatgacaatatactgtaagattaattatataattgctttatggcttatggattaccttcacatattttccttaatccttactgaattagttaggatacacactaggccgttaatttagactgctgtaatgtacaccaaaatatatgaggttgaatacaaagtagtttatttttctcttctctaacagacagtatataagcagcccatgactgccaaggtagttccctggtgccaggcatgcagttctatctctattgttgctttgctgttgtcttcctctgtgtaactgaggatggctcaccacttcagctgtatttcaccagtggaaagggtaaaaggggagacgtggaggacatttcccactaagggtttgacttgtgaagtcaaacatgcatctcttcacctcacatcccattgctatctagaacctagtcgcaaaggaggcaaaaaaatgtagtccttattttcaatggccatccaaactaaaatgtagggattctgtcattgaaggaaaacagggaaagtggatgttggagtacagcatagtactgctacacagagagagggacacagttactaaaatcagtactctcacttacaattgaggaaatgagactcaaaaatttaataccttcctcaaggtcattcatgtaaattagtggtagaatcaaccatagaaattttattcaaatcagtgtcacaccactttcaaaataataactccataatttctaacatttatatcgtgtttaacaatttgcagtatacttaatgttatctcatttgaacctttcagtaactatgtgacaaggaaagacattatctttttttatagatgaaaaaatggacttaggagctcctatcatgaaaccataagttcaaaatgttactctaagaactaaccactccttaatagtatcttacaattattttgtattttcacagtttataaagtgcattgacataagttttttcagtcttcagtaactctggaaggaatataaaatggaaattatgactttttttaattaaaaaaacaggcatataaaagttaaagacagagcctaagtctttgaatccctctttttcttttgacactgtcccttattatctcgctatatcagttaggatggcatttagctacacacagtgtaaatctgattacagtggttcaagaagggtttctttttctcaactaacaaggccaaagcgtaggtgtgctttagtggctccataatacgtataaggatctgactcctctctttttgcttttttttcttagaaggtagctttttgtttgcatgttcacaaaggtggctcctctcatttaccacggttctcagttctaggcaggaagaaaggagaaagaagagagacaaaaggtctaccctagatattctttgtatgaggaaaaaaatatcttgaagtcctatccattaaacccctgcttcattttattggccgaatgtcacatggcacccttagctgcaaacagagcctgctattccaaagagaattggaagctcaataaaggaaatgaggaaattggtattagataggcaaatagattgacattctctgggcattgatttccacatctgtacgtattagagggaagaatagggataataaaatgcccctttttagaaacctttatttaataagaatatatattcctctctcatctgtaggcttacccaccttaaagaagccaaatgtccctaacttagcaaaaagtggtttctaaaaatgtctttttaagttagtaatataataccccattcttctgtaatgcggctaacttgcccaatgtactggaacacaaaggtgcttgctagtccgcaaactctctaaaataatcaatacgtttagaattatgttgggttgaccttccattcccacactgaatgtttgcttgtgccctcctcctggaatgttattttcagatccagacggtatgttgatgttggaggaataccagttgttaagtatcggtatgtttaccagaatttagctacacttcactatagtgggaactagatattattgttgttggcaataagagcaaagcttataaaaatttttatcagacttaattagaattaattccttgaaattcttagaatcaagagatacttgaatagtattttactgaagtaatatataaatgtataagtaagtgtagtacagtagacccatgaacagtgcaggggttggggcactgattgttgaaaatctgtgtgtaacttttgactccttaaaaactgaactgcgaatagcctcattttgaccaaaaatcttaacaacataaatagctgattaacacatattttgcatatttatgatgtactgtttcttacaataaagtaagctagaggaaagaaaatgttactgagaaaatcataagagcaaatatatgattgaataagagggaaattgcttatcctaaaggtcttcatcctctttgtcttcacattgaataggcagaggaggaggagaaagagaaaggattattagttttgttgtctcgggtggaggaggtggaaggagaggcaggatatacttgatgtaattttgtgaaaatatgttgtaatgtctgtttgacttttttacttttcatttctctaaaaattttactatatggtaccaatccttccttatttgctttagtttcagtgactgtatcgtaaaatggtccatgtcataaaagaagtcaaaagcagtcttgaataatgagaacctttcttccagattgtctaaaatcaatttattttctggcactgcttcttctacatcttctttctcatcgtctagccctggtttgaagcactcatctccatcaagtcgtcttctgttaatcctctggtgtggtgtctgttcactcttgaatgtctccaagatccctatcttgaaaccctctacgccccaccttttaaaaataatatctgcactctcatgattttcttgattgcctctgttgtaaatcttgtggagacatgcacaacatctggacagttttttccagcaggaacttattattttgggcttgacgaattcatgggttttctataacagtggcatctttagtggtgtaatccttccagactttgaatgattttctctgtcagggttctctactattggtattgacagtcctttccatagagtactttgtataatgagccttaaaggtccttatgacctcctgctctagaggctggattagagacgtagtgtttgggggcaagtaaatcacttgatgcttttagtgttgaactcatggggttctcggtagccaggggcattgtccagtactcaaagaactttaaaaggcagtcccttactggcaaagtactttcagacttcagggtcaaagcatcagtggactcaatccagaaaaaggattcttgttgtccaggccttcttgttgtagtcagaagactagcaagcagctggtgttttatcttttcctttcaagactcgggggttagcggttttgtagataagggctgtcctggtcataaacctgactgcattatacaaaacagtagagttagcccatcccttcctgtcttaaatcctagtgctcatttctcttccttactaataaatgtattttgtggccccttttttaaattttttttttttttccagaataggacacttgtctgcattgaaaacctgttcaagcagacagaactcagtgattttcttaatggcatctggggacttgtctgctgcctcttggttggtagaagctgctactcctgttatcttggcatttttaaaaaccagacctctttctaaaattatcaaaccatcctttactggcattaaataatccagctttagattcttcaccttccttttttttaaagttgtcatatgacttcattttttcttgaatcatactacagtctttaggcatgtagcagttttatacccacataatagctgcattttcaatatgagataaaaaggtatttcattaaaaagtgttaaggtttttgcacctgttggtgtgtagcttcagcaatggcttcatgagttttcttgttttttttttcccacaattattcttacgctgtattcatttatcttgagatagcaggcagccacagttacagacctcaatctgtggtgtatatcaagcaattcaactttttcttgtaatgtcatgatttttctctaggtgggagcacttccggcatcactagtggctcttcaaatgagtctcatgggtgttattcaaagtttgcattaaacactatgaaattgtactaaacactatgaaaaatatgcaaaacccacaaaagatcactttttaccatgatgagcagtttgccggagagacaaactgctcacacagagatgattacatcacgtagggtttctttttttttttcttttttttgagacggagtctcgctcggctggagtgcagtggcgtgatctcagcccactgcaggctccacctcccaggttcacgccattctcctgcctcagcctcccgagtagctggaactgcagatgcctgacaccacgcccggctaattttttgtatttttagtagagacggggtatcaccatgttagccaggatggtctcgatcttctgacctcatgatccgccctcctcagcctcccaaagtcacatagggttttaagtgggtgctcatgacacttgggcccacacagtagcattgtgggggggggggtggtacaaaattatttcagtaatacatactataattttgtgcagtttatgattttacatttgtttacatttctcttaactgtgaatggcactacgtatgtatggtctgtaagtgcttgtgtgcttaagttttggtaagttttaacttcttatactttgtgtatattttatggtagtaaatgacaaaataagctagttccaacatattttatgcattcataacatacctagctttttcttaaatttttaatatttctaggctacttaatttgtccgtgaatttttttcaaatcgtcacaaatctccaaaaagcttaccaaaatatttattgaaaaatatctggatgtaaggggagccacacagttcaaacctgtgttgttcaagggtcaagtgtatattcactcggtggaaattttatagctattaataataaattgttatttctgaagtaggtgtaggaacgtaccaaccaaccactttttatttcctactgggcttttttttttttttttttaagcttatcttacaggtaaaataaacacattttgtagctgctcttctgccttaccactatacctcattatcatccatcatttacatttatttaagcacctactgtactagacacttgaaataattatgttcatgtaagtgttactaataaatgtattgagtttatgtaacatgaagaacatttttaaaaatactaagtcagcaattcttacattattctggtagtatgtactgagatatgctataatatttttattctcttacacaatactgacctctagagataaagcactgtaaattcacttcttagtaaaactggtttttggaatatttatgaaaaggattaagaggattttttgttttgttctcttcatttttttttacttttatgaataatttcaaacaaacgtaaaattataatgaatacttatataccccttcatcctgatttagcagttgataacagttttacatatttgctttcctattttttggcctgtgtaccttaaagaaaattataaggatcataataaacattttacccttatacttcagtatgcatctctaaaaagtaaggagattttctacaaaaggacagtatattaatataataaaattaacagttatttcctaatgtcatcaaatatttacatttccccgattgctgctaaaatggattttacagctgattgcttcaaaccaagatccagtcaaccaacaagcatttattttggttgataggttgttaaggtttcttaatctagaacaacccctaggccccttatgccccccatgacattgatgttgggaagcttaagtcatttctcctttagaatggtctgtcttttggacttgtctgattgtttccaaagggtgtcatttaacttctttatttttatatcctcttataaaaagtgcagattagatctgaatccttgattggattgaggttaagcatttttgtcatgaatacattgtaggtatttttcacatacttcctactgcatcatattacacaatacttgtctcgccattcatgatgctcagatgattaaagtgttcatgacctgatctcttagttacaaaatttttatttttttgctactagcaagtaatctggagagattttgacatcatttgagatccagttttattaaaccttttgcataatagttttaagctctattaaagatgttataaaatgagattttctgtttctgttgtttctacatatattagcatgaattcttctatagagaattttctctattaactggaattaatttgtttatcctgaaatgtttcttctagaaaagcgggataaatgtttaattcttttactttatttaccaattttcagagtaaggagttagagtatagaacccttccagcggtaacatgtttttccaggaaggaacaggcttcctctctgtaaaatattcttatgatcttaatgaattttatatgttcagtgtggttcagacaactactgttattttaagttaaatttgttctttttgttgcttttactaatgcctttatttatccttttttctttacatactcatgtagtccttttctttagacattgtctcattgtctcttggttcactactataagcgtcagtgaaattagcatatttcatccttgaccatcatttcattttagacagttgtttttttttgatgtttacttttcgactctgctgttcagcttgtcagagttaaatggtgtcctttaacttttatcagccaagtatgagaaaaccatttatacacctttattcttttaccttattcccatctttggtttccccttaaatccacagttaaatttgttcaatggtaaccgacaatgcatttgctaagagtttctcagtcaccccttggttggataaagcttgtcctgtaatagattaccttagaagagctaactcatggtatgatcttccctgagtacatgctaacaactttgtctatagtcttgatacttaaaagactacttggctagttatacagtctttggttcactctgtattagtttcctcgggctgtcgtaacaagttaaccacaaacttgaaacaacagaaaattattctttcaaagttttggaggccagaagtctggtatcaaggagtcagtggggccatactttctctgcaggcttggaggaagttttctcttgcagcttctggtggctccagacattgttggcattccttagtcagtagatgcatcactccagccagtctctgcctatcttcacatgacagtctcctttctgtctcccctgcttataaggacaccagtcattagatttagagctcacctgtcattagatttagagcccaccttactccactatgacctcagctgaactaattgcatttgcaaagatcctgcttccaaatgagttcacaatctgaaggttccaagtggacatgaagtttggtaggatactgttcattcaacccactaaacttcaatgatgtaactatgatgtcttttagaattggcattctgggcaaatttcccatgtactcagtatgtctctcagtgtagatgtttaggtcctctcctaatttttttattttgttagagacaagatctcactctgttgcccaggctgaagtgcagtggcatgatcatagctcactgcagcctttaactcttgggctcaacaagtgatcctccgaccttggcctcccagagtactaggattataggcacaagccactgagcccagactaaggttctcttttgttttttagggacattttcttgaattgcaattttaaagattagctctatcccattaatttttctttttcagggactccttatatatgtatgttgactcttttttgttttttttttttttaatctatcactttctctgtgatcccttttatctgtttacttgtttcactttcctttttgcttttctcattgcttgctatacttttggagaagtctgttgccctttgtgtgtcctgtgatttagtgctaagcctgcagtgattttgttcttttctttttattcagtttcttttctgtgttatatgagctcccactttacatcttgttattgtttgcccatcttttctgagttgttgatcttgtgtttcatggcatttattcaatatattgttgcttattatttttaatcatgttagaatattggtttatggtttttctctgcattgtggaaatttgagtatcctgaaatgttttaatctatgttctctatgttttctttttatatttttcagtggacattgcagttttatacttcttatccctgtttgggccagctattgtgggattaatggaaggttggtggcaggaagggagtttggatgattcccagttcaggagctttcatttctgttagtgtgggaaaggctttatcttcattgtcagtatggtttttggttttcagagctcttctttcttgtttgatctgaccttgtttcaataaagcccctatcttaatctcttccttctcttcagctctagttgctaccttccaaatcccaaaagatgtcttacatcatcatcccctcccttgctgccaccagggtgttctcaagactacaattctggtcccgtatctcctccaagctgctgcttgatgctttgttgccaagtttcaagcctttttcaatacttcccattttagatggaacctcttccttctggggagaaatcctggctgctgttatctgagtcctacagccactgagagttctctgacctcttaactcctctgtgaagctcttgctataatccccacactagggtcagctccagcgcttatcctgctgttcttcagtgtttacctccctactttctcatacgtttgtgttggtagctctcttctgtctcctacttactctgtaggtacagagcatgggtatttctatttgttcttcttgttgctgtgtatagtttttagaaggaggtatgagaagagtccaggagactgccatcattcttggggaactcagaaacccaaactcagctaatgtttttgatttttttctctgcagccagaaataagctggtgatgcagctggtttcattactagccatggtggactatatcttgccctgtagtgagtgactgctaaaacaacaatctaattgggataattctgagtaagtttgttctcttgtatagttttatagtcagtgaagaaaacttccaaaccaggaaaatcatctgaagccatctctgacatccccttcccttttaaaaattctattctattttgaaatctaaggctttttctttaatactctctgataaggctgatatgtaaacctaactcacctcttttaactgttttctgtttataaagtcacttaggagattgagctaatattcaaataattgaaaccatgagtatatagaagtggaggcagtataggagaaaatgcattttaaaattggagttagggaagttacttgtgcttatgttgcaggttgggttctccaggaatcagacttggagctggagattagcttcagggtgtttattagggagtgctgttgggatcacaactgtgaaagagagggaaggaagttggatagatgcagggagaagtggagttgcagtgtcatcccagtggagcatgggaatccttaagccaaatatttaatagtcgttgtctttggttatgcaagataacatgaacttttttagttttgtcttaatacatgtctattttacaaatacatatatactacttttgtactctgaaaaaaaaagctttctgttttgggggaaaatacaaataattttttagaagagagctattttgtcagtcatacatagcactttgggttctgaagaatataacctttagttttaaagcttcagtgccattaatggatattatatttgcttttcagcttgggcaatggtagatggtggttcaaatgtgaaagcccgctcttcctacaatgagaagaccccaaggatcgttgtgtctcgttcccattcagggatggtcaaacaggtcgctcttcagacttttggaaaccagactacaattatcccagctggtggtgctggtatgttcctcttcctgtgtggtccctggagaatgttcctggcatggtcaaggctatgttaggagactaatttgcttgtccatgcttgggaggaaagtgaggaggagtggtgtactttcaagacaggcttggtctcctgtttggtaacctcgagggtgggattttagtcactctgcccttcttattagaaagaagcagtctcacaacagtggtttctctttcttgaatacacaaaagcatattcccattagatctaccactaattgctttttatgcagtctgatttcaaaataattgtcttacttaactgtgggaatatcaaggagaggaagaaagatcaagcacttaagatgcttcatatggcagaaagacgccaggagtcatcataagtattattagaaaggctaatccctgagtcacttttaacacccctgaactctttaacctgcatacctgggatgagcaagagaggctagtgcgcacccaccttatcgtatattctctactattgtattatagtcaacctagttttttggaaaagaaaccgataataaaatttgaagcctcatgagccatatatatacagtctctgttgcatactattatttgattttctttaatgaacttttgaacatattttttaaagattctcatcttaaccctgtaagaacaggccatgacccggatttagcttgaggggctgtttgtcaactcctgttatgagtactgtctaacatgtcagaaatgttttaattcaggttaatagcaaattatggtcagaaaacaaatgtgttggaaaaccttctcagcacacataaagggagaagtaatacttcttttttgttttgttttgttttgttttttctttttttgagatagggtctcattctgtctcccaggctggagtgcagtggtgtgatctaggctcatcgcaacctccgcctcctgggctcaggtgattttcgtgcctcagcctcccgagtagctgggactacaggcatgcaccaccatgcctggctaattttttatttttagtagagacggggttttgccacgttgcccaggctggtcttgagctcctgagctcaggcagtctgcttgctgtggcctcccaaagtgctaggattacaggcgtgagccaccacacctggtcaatactttttaacttttatgcctaataattttaattttctgttctatatatctgccttctttcatatggcttcattattttcttagaggctctctgttaggttggttaggaaaagtaatgtccagaatacccagcagggatgagatgactaggttctagacccagtttcttctgcatttgttttattactttagtttttaaattctgcctcattacaaaaaggctttagagtggtagtgttactgttagttctctttcacatcgggcctacttagatgtttaggtaaaacttgtgtgtataatatgtcattccatagaaaatggcacgtaatgaatgtgtcattccatagaaaataaccacaatgtagatttaaaatttttaaattgtaggtatatatttggttacatttgagactagcttaataagttactttgcaggccgggtgcagtggctcacgcctgtaatcccagcactttgggaggccaaggcaggcagatcacgaggccaggagttcaagaccagcatgaccaacacggagaaaccctgtctctactaaaaaatacaaaaaaatttagcagggcatggtggcacgcacctgtaatcccagctactcaggaggctggggcaggagaatcgcttgaacccgagaggtggaggttgcagtgagccaagatcgcgctgttgcactccagcctgagtgacagagcgagactctgtctcaaaaaataaataaataaataaaaataaacaataagttactttgcaatgtatttttgttctgagtttaatgtttatacagttactttaaaatttttttaatttgaaataattttaaacttaagcagttgcagagactgcagcaagctcctgcacactccatcctgctattttaacaggatacttaatcaaaaaagtatgctactttcttaaaattttttgaataataacctaaattctttgtttatcttttaggttataaagttttagcacttttggatgtgcctgataagagtcaagaaaaagctgatttatacatccatgtgacatacatcaaaaagtgggatatatgtgctggtaatgccatcttaaaagccctaggggggcatatgactaccctgagtggtgaagaaatcagttacactggttcagacggcattgaagggggactccttgctagcatcagaatgaaccaccaggccctggtcagaaaactcccagatctagaaaagacaggacataaatgagcataactgattacagggtacagttcttcacagctgaaatggttagcctgagatgctggaagcttcaaaggattggtggagactatgcatggttaaggccatcccgaactttttaaagtatttatgaagcatcagagacttattttccctgtaatagaatgcaaaatcagggaaaatgggttgctttgtgtctcaagtattgtctttatttttgagactattttcatacagttgtcatacacaaggcgcatatatatatttgtgaattaaaatctgtagctgagtctacattgttatgagtcaccattttcacacaacatcatgaatcttcactgttagtactttcatatagaattcggttgaaggaaagattgatttttgtgtagatgtttaatataactttacaactatatctcattgaaaataaagtcattggggatttttacctctaatttggatggaaagcacaagaagccacacattcattaatatgcaacaaatgttgtatttatgttactgaatatttctatggattaaaatagaaaaagtttaattgattttttcttttaaattttaataacaggttcaccagctggtagaaaatagagacacatgatgatttgcattgtaataatttctgtgtgtatgtgtgtgtgttgttttgtttttataaagaaaagtgtgtttgtacccatgagttcagcatttctgccatcttgctattttcattttccctgtggaagatgcatggttgcatccttttccttctgaccaacacttagtctttaactttgtaaggttcggtttaaggtttcagggttagcactatagttttggttcattttctcattaacgataaaatatgctgtaaggcactataagaatataaatgattctattacaattgaaagttacttgacattacatgaattgaactgcctttcattatcttcagacactttgttttagtatttttttttaatttgctaggtttgtatatagaagatcctttcattatcaagaatgagtatggttgcttttgccatggttgcttttactattaataaatgtatctagcctaccc

SEQ ID NO: 38389 - DNA, 95070 bp, Homo sapiens
ccgcctctgtcgccactctctccccctgttccgcgtctgcgtcgccaccaccgccgggggtatccggggggtcgcttaccgggctggccccgcgccacagccgtagctttaacctcccgtcagcggccgccccaggaagaggcttctcggccgcggagccacttggggcctcagttctcgccctcttgccgtcgccgcgggtcctggagaagcggccgcggccagggaacggggcatcgcggttccaacggtaggtaaacgggcgggtacccggatctgcgcatgcgcgggttgcaggtcgccgcggcccttcccctcctgttgccccccagcgccgcctgccacccgcgcctgctctcgggcgttgcgtttcgggatgtggaggactctagcaggtggggcgttccgtggagagggccccctttccgctggagaaagaggaagatgaagccgtgtccctggctgccggggggtgtggcagccttggatttgcagcggctgcagtgcagttgagcgggcgtgcccctcacctccagcccctccagagtagatggcgcgacaccccacgtttctttgctgacctctcctgcccgctggcgctgcgcctcttccccgcccacttccttcatgctgggcagtgaagttgatgtagaagaaaaaggagtgtgttttattctgggctcaactgcgcccctttttaaggtcacgtgagatgagtggttgcggacttccttaaatcgctcagagaatatagccaaaattgggctgttggtgcactggggccttgtctagaatgcgctctgcataggccaggctggagggggacactttgtatagcattagggttcgcgtggcacgcctggtttcctagatgaggttgtaggaatcggttggcacatttgcgcagtgggaaactgttaagccctttttgtttgtaatcagttaaaatcaaactgacttttagaaagacggtggattatttcatttggttccccgtttcgccttctaatcagtgaaaaaagttgggcatttactttgaaggatctgataatctaaaatggtagccagaatcattaccagtagtaatgcagactattaacattaactggggtgcacctgtttagagagacagacattaaagggtggttttgaattatttgtctttttagagctgggttagtgtgaggctattttcaaccttccttttttggtaaccttgaaatgcttgttggcctggttttctcacaggtactgtgcatttactaagtgcttgttgatggaattgaatggactgataattatttgtatatccattgggagcgccttcttacttttttttttttttccttgagacagtttcgctctgtcgtacaggctggagtgcagtggagcgatctcggttcactgcaacctcctcctcccggattcaagcgattctcctgcctcagcctcctgagtagctgggactacaggcgcccgccaccacgcctgactaatttttgtatttttggtagagatcagatttcactaagttggccaggctggtcttgaactgacctcaagtgatccgcctgcctcagcctcccagagttctgggattacaggcgtgagtcaccgtgccttgcccccttcttacttttttaatccgtgctgcttttaaaattggagtaatagtttctccagtttaattttattactaatttagacacgtgtgtgacacagcttaagttcttggaaaatgtagaagggcatattgcagtggcataattcattgggtggtgtaaatgttagttttttttattagaatgtcattgttttaggagagaaaatggctgaaatgaatctgttgacttgtcagtgtttccccaccaataaaataactgcttttataatcagttatgaataacctcaatccatcgctgcatagctcctccatcatcgtattcaaattttaaatttggggactataatagtgtaaattactgttttgtttttttttttgagacagggcatcactgtcgcccaggctggagtgcagtggtgcaatctcggctgactgcaacctctgcctcccaggttctaacgattcttctgacttagcctcccgagtagctaggactaccggtgcttgccactgcgcctgactaatttttgtattttttgtaagacggggttttgccatgttgcccaggctggtctcaaactcctgacctcagatgatctgcctgcttctgcctcccaaagtgctgggattacaggtgtgagccaccttgccaccttgcccagccttacgttcaatttttttttttgggggggggggacggagtttcattcttgttgcccaggctgaagtgcaaattttagtgtgtaaattataccttaataaatgtatttttttaaaaacccactggtggactttggagagcttatactctgttggtagaaacagacattaaacaaacacaaaatgaatatgtaataaaacttgtggtaagccaggctcacgcctgtaatcccagcactttgggaggctaaggctggaggatcagttgagcttaggagtttgaggccagcctgggcaacatagggagactctctttacagaaaaaaaaaaaaaaaaagccaggcatggtggcatgctcctgttgtcccagctgctcagggagctgaggtgggaggattgcttgagcccaggagtttgaggctgcagtgagctgtgatgatgccattgcattccagcctgggggacagagtgagaccctgtctcaaaaaacaaaacaagaaacctgtgatgaatattttggagccaaggaacgccacaccctagataaattaataaatgagaccattagtttgagtgggttgaagaaagcctctccaaggatgggacttgaactgatgataggaaggaggaagcgtgggagagtgttccaggtcagtgaactagcaagtataaaagacctaggctgaggaaaatgtggtaagctgacaagataatttgatgacatttactagatttctactagagaaggaaatattgcaagtcttttatttcaagttattacctagcttctagtgtatattttcttttccttgtatatataatgtataaagattcttatctcttgctttaattttaagagcgatgtctgtcaagtttctattattgcccttttcaggaacagaatagaaaaagttcagttttgtttacctattcttgaaaatatttctctactttttgcttttgtgtgtcaagctgctgctctttacaattgaaaagtaaaagtaaaaataaaactgaaaactgcttgttgattgacatagtaggtgctgaatatcattttgcattggggtgagcagggaggtggaggaggttctctatggtcctaatttggagcaaacactggtcacgttggatttagtgtttggaaaggtgtaaaggagctgaaatttagaattaggtaagatgggagtttttttcaatagcaaaagcagactgcattatgattggttgtagaatcactttgaaactattactgttgtaaaatattctctttttctattgagaggaaatattctagtagtatttccataatgatctttggccagcaactgcaaaacatttccagcaactacaaagtatttaagtgctttatgaattactcttggtgtggcttcatgtatttcagtgacattttaaacaaaattttcactgagaattgtagttgttgcctagaaggggcatctacttgtaagatagtagacttagagttctagttgctaattcagtaactttgaaccagtttcttcagctctctgagcttgcttcctcttctgagaaaaggaagggtaatccattctccttatttcaccggatggttggaggattcagttggagagtgaactggaaagtacactggaaatggtagcatcagtttcagtattggggttctgctatttagtgttcaactggggaaacaaaaatgaagtcattttttttttcttttttttgagacgaagtctcgttcttgtccccctggctggagtgcaatggcggcgatctcggctcactgcaacctccgtctcctggcttcgagcgattctcctgcctcatcctcccaagtagctgggaccacaggcatgtgccaccatgcctggctaatttttgtatttcttgtagcgatggggtttcaccatgttggccacgctggtctcaaactcctgacctcaggtgatccgcctgccttggcctcccaaagtgctggcatttataggcgtgagccactgcacctggcctaattttgtatttttagtagaaatggggtttcatcatgttggccaggctggtcttgaattcctgacctctggtgatctgcccacctcagcatcccaaagtgttgggattataggcaggagccactgcacttggccattttttgcgtattttatggtcaaagttcacaatctagtggggaagatatacaaaaaaagtttaaccactgcttttttgttcatgtaccagcttccctttttttttcagtttttatacaagtctgtgcaaaaagagaaatgttttaatctcaggggacctatctggctagaccaagttgtagaattacgcataataccccttacctgaaaaaatgaagtgtattgtagtttcgtattaacgagctatgaaaaatgataaactagtcttcttactcttatcagtctagtaggccttgcctgtgcatgttttcagtggagaaaaggtatattaatatttcccacgttgttgcaagaaatagcttctactcttttttttggttttattttttaaagcagtgaaattcccaatcttttaagcaatagagccctctttaatttaaaaactttctagtcctgaattctgtattagttatactttgtatctgataaattacttaatggccaagccagtatgaacttaataacagattaagtgatttggtgttttcctgattgtgttagtccattctcacactgctataaagaactgccagaataaagaaaagaggtttaattgtttcacagttctacatggctggggaggctccaggaaacttacaatcatagtggaaggggacgcaggcatgtcttacatggcagcaggcaagagagcctttgtaggaagtgaagggggaagagccccttataaaaccatcagctctcatgagaactcactgtcacgagaacagcatgggagaaactgcctccatgatccaatcacctccttctctccacacgtgaggattacaattctagatgagatttaggtggggacacagagccaaaccgtatcactgatcaaagtagcgtctatgaacatttgataggtaagtttatgcactattgagacattcgttcagcttttctgttaagtatgtcagacaaattatgctttggtcagtttctcaggccaggagggaaccactaagttagcatatttgccacttttgttgtaccatacttgttcagttagaatgaaagaggtgccttttgcttcagtgaattatttggagccccagctagtaagaagctgaatgtctagagcaggcataagtttattttcttttagttttggtttaatgatgtaaagtcaaattagcaatagtctacaaacttataaatctctatcatctttattgagacccagcttcctgctggcttttctgactttgtataccagtgataatagggatgtatttatgtagttttttggctttaacaagtagtgagatagctcttttaaacctttctatgtgaattgtatcctattttgtcaaagcatttgggcaaatgtgagttttattgtttcttcctattctatttgaaggtagaacttttttacttcaatgtggcactttttcttggcacatctttttgagtcattctgttgcccaggcccagtgcagtggtgcagtcacagctcgctacagcctcaaactcctgggctctagaaattcttccatctcagcctcctgagtagctgggactacaggtgtgtgccaccacacttcgctaatttatttatttatttatttatttatttatttatttatttatttatttgagatggagtctttctttgttgcccaggctggagtgcaatggcgcgatctcggctcactgtaacctccgcctcccgggttcaagcgattctcctgtctcagcctcctgagtagctgtgattaaaggcgtgtgccaccatgctcagctaattttttacttttagtagagatagggttttaccatgttggccaggctggtcttgaactcctgatcttgggtgatccacccgtctcgacctcccaaagtgctgggattacaggtgtgagccacagtgcctgaccaatttttttttttttttttttttttttttgagacacggtccctctctggtgcccacgctggagttcagtggcatgatcacagctcactggaagcctctacctccctgggctccagtgatccttccacctcagcctcccgagtagctgggactgcaggcgcatgacatcatgcccagctaatttttgtacttttttgtagaaacggggttttgccatgttgcccaggctggtctcgaactctggagctcgagtgatctgcccacctcggcctcccaaagagctgggattacgggtgtgaaccatcatgcctggcctcttttttcattttcttcagctttgttgaagtatggtttatatacaacagcatgtccagctcaatacgttttaataaatatattcatatgtaactatcactgccacagttatgacatagaacattttcatcacctcaaaaagttctgtgtttcagttttctcatcagtaaaatggatataatgaaagtatttgcctcctttagggttgttgtaaggattaaatgagttgatatagttaaagtctttgaaatagtgcctggcatattgtaagagctcagcaaatgctgtctgctattattatctatagtattgatattggtgctctacccctttttaaaagccccttactactaattttagtagatagttaaagtgtaaagattctgtgctattaagaaaggtacgtttcatttgtcaaaaatcagttgattgtagatgctgttttggttaatatagctctgtagtatatttgtaagttggctagtgtgatgcctccagctctgttcattttcttcaggattgtttgtgttaatcagggtttttatgcttttgtacaaaatttacggttgctttttcagtttctttgaagaatgtcattgtaattttgatggggagtgcattgaatctgtagaccactttggattgtatggatatttcaacaatattaaatttttcagcccatggggggaaaaaggggtgtgtgtgctgctactatgtatgtgtatttttgtatatgtaaatgaaattgaatggaatgcaaaagtaccttgagtccctgtagaacttaggttgatagctggtgtatgaagatgcactttcttgaatgtcacccaactttattgataattggtgtttaattgcattgtttctgagccgggagtagtgactcatgcctgtaatcccagtgatttaggaggctgaggtgggaggtttgcttgagcccaggagtttgaggctgcatgattgggccactgtactccagcctgggcaacagggtgagacctcaactcaaaaaaaaaaaaaaaaaaaatacatatatatatatatatatatatggctttgtttgtaatcactgttatctcatggtgaggtatatgatgtaaaattcaatgtaatttcctattccttgtcaataacaccatgctaggcaactgtcacttgtatttaaaataattttgctgtttggggctgggagtggtggctcatgcctgtaatgccgaggtgtgcagatcacctgaggtcaggagttcgataccagcctggccaacgtggtgaaactccatctctaccaaaaaatacaaaaaaattagccgtgcatggtggcacgtgcctatgatctctactactcaggaggctgaggcacgagaatcgcttgagcccaggagacagaggttgcagtgagctgagatcatgccactgcactctagcctgggtgacagagtaagactctgtctcaaaaaaaaaacaaacaaaaaaaacaaactcaaaaaactctctctctctctctttctctctctctctctctctctctgtgtgtgtgtgtgtgtgtataaattttgctgtttagatttataacagtatgcttttggaaatacttggttattttgaaagtccacacattgtattctcttgtgtcaatccttttattgaactgctttctcgacattttattgattctatctgctaggacattttattagatctttttggtatatttttgtacggtgcctgctgctgttttccttttttttcttttttttttttagaatgtaatattgtagtttaggtgttgcattcattttctaggactttcatgacaaattgctacaaactaggtggctctaaaatagtaggaagttttttctcacagttgaggagggtagaagcccaaaaggaagtgtccacagggcagattctaggggagaatctttctttgcctcttccagcttctggtagttcctggcatttcttggcttctggcagcataactccagtttctccctgtcttcacatgctcttctttctctctgtgtgtctctgtgtatcttgtcctcttcttataagggcatgagtcattggatttagggcctgccctaaatctaggatgatttcctcttgagatccttaactaattacacctgcaaagaccttatttccagataaagtcacattatgaggttcttggtggacatgaggtttgggggggacactattcaacccaccacagatgtgaagggaatatttatgtgatttaagctctgaaaaggggtaggaaacaggactaaataatgtcaactactttgcagtttgcagaaatgttaccttgggccactctccagtctgagagttctcagcaatgtgctctagatacaagtcccaagtgaaagattggctcctggggtttggaccataggcctgccctctggaagtacctgttcgcaagctagaagtaagtgatgacctaaaatgtatataagactttgaggccgggcatggtggatcatgcctgtaatcccaggaccttgggaggctgaagtgggtggattgcctgagcccaggagttcaagaccagcctgggcaatgtggtgaaacctcatttttacaaaaattagccgggtgtggtggcccacgcctgtagtcctagctactcaagaggctgaggtaggaggatcacgtaggtctggggaggttgaggctgcagtgagctgtgatcgcatatgccactgtactccagcctgtctcaaaaaaagaaaaagactatggccagtttgagcgccagaatgtgacattctatcatactataaattgtgataatttacatgaaaaaatagtatagtgattaagagctcaaggactttgagaatcacattctctggtttcatattctgcctctgacccttattatctgggtggactgtgggtaaattggtgagccttgcaatgtctaattaagggttaaagaataccttaatacatgtaaagtgcatggaactgcctggcatatcataactgctcatttaatgtttgttgctgctatatccgtcaacatcctcaggagaaagagaaacttgtcgtcagaaaggttgatgcctccgattgttttcctagtatcaagggtaaatttttactgatgaattcatagattcctacccagcctcaccttagaaaaatatgctttcaggttgtctagttagaggttgcaggtagtagaggtcatgagatgagataataggctcctgactgggagcagtggctcacacctgtaatcccagcaaggtgggagggattgcttgaggccaggagtctgagaccaacctgggcaacatgagacttcctctctactaaaaatacagctgggtatggtggtgtgtacatgtaggcccagcaatttgggaggctgaggcaggggattgcttgggtccaggagtttgaggctgcagtgagccataattgcaccactgcactccagcctgggtgacagagtgagaccctgtctcgaaaaaaaaaaaaaagaaaatagcttcttgatttcattaacaaggcattctaaacactgagtagccattttagtgatgtataaaacttgctccctgacagacttttgtagtgagttttcatttatagtacatcaagcaaatccccctttatgtcatgaggatatcagcttgacttttagtgtaagtctgttaaataacttatctctgaagttaacttcgaaattgttttcaaatggatagataggtagattaactacatgtcttagcaggcatttcaggatgttttgcaactaataatcaactaaaagatttgttatgggaatgtggttttccttcccttcagtttttaatgtttctcctggaggtgtatgttactaataacacttctttgaaaaccacactgattaatattactcttctgcttacctgaagcttcttgggcagagtcctgcagtgtagtttactgagcttattaaaagatttgttaatagatgactagaattcacagaggataatgataccattagaattcacaaaggatgatgagaccaaatattaaacactttgccaaacaagttcttctctctctctctagtctaattgctggtcttttagcattatgcaaagaagagagaggagactggttctctatctactgcatacctatgttatctcagttaaactaaacttaacagctgtacaggtattattcttttttttttttttttttttttgagacaggatctcactttgttgcccgggctggagtgcagtggtgcaaacacaacccattgcagcctccacctcctggcagaagtgatcctcctgcctcagccttccaagtagctgggactacaggcactactatacctggctaatttctaaatttttttgtagagatggggtctcactatattgcccaggctggtctcaaactcctgggctcaagtgatcctcccaccttggcctctcatagtgctgggattatagccatgagccaatgcacctggcctgtacaggtagtttcttgttttatataaagaaacctaggctcagagacatggaagttgttcaccatcatgtgtctacaaaatgacggagttattaattgaatctaaatctttctgggactgttctttttgctcttttccaacatatgctatcgcttctctaaattagggagctcaggcaaccactatgttgtatacaaaaaaaagaagaaagtacttaagtatagtagcaagcttaaatcatatctttgattctttgatcttttgaaaatacttccatgtttagttctgagtatgtgaggaaatgaggaaggaatgggatggggtagggtgtccacacataattgaggaaaatggattatttgaatggtgtagtccttgaagatgtgtcctgtcacatatcctcctttgcaattcgtttatttatttatcttcagcaggaagattcttctccaattttccatcatcatctgaaaccgttgcaaggttttgcctttaggttacagatagatttttcagacagaagaatacctttcaatataggtaacctcttaagaggactgtactgctgcttctattaatagtctcttctgacagttaaagatgtgggaaattgaaataattgtttttgtcttgtagattaactgctgaagtactgatcgagttctgcatttcttcaatgaggaactacaggctgatcttctgccataatctcaaacagccataaatgacaaaagaatgcttgctcagtgagggtagctggtgcagaagccattttttaaacttaggtatttaagtactgaaaggtaagttttcaaaatggtaactatctcgtgctctataaatccatagagattttggaacttgcccctgtagctgctatttgatttaacttgaggttttatagttcttagctggcaccagatacattgaagaatggatgttgcttgtctgagactatgtaaatgtatggcattttgctatccttaagttaattttttcttttaagttggctgcattgtttcctagtcatgttgtgacattcttgatccagtgggtatacacttgatccagtggaccttatttttgtaaacttaggaattttagtagacttatttttgtgatttgctttttttctcttgcagtgagaaagaaattgtttttctagggtgatggaaaaaataccagctggtgtcattttgttcattatcaacctttgagtttttctttcttttacaaatactcttttcctacgtaaagtaataaatgtgtaatgtgtttattttagaaaataaatttttcttaggattacttgttctctgatgtgtcagatattggaaatggccatctgagacattgttttctcccacttctttactgatcacaattcctacaaaattaggacaaataactatttcttctgaactagatggctctgaaaatttttcttttggataattatgaaataacagtgttaaggacaggcacaacggcttgtgcctataatcccagcgctttggaggctgaggctggctgatcacatgaggtcaggagttcaagaccagcctggccaacatggtgaaaccccgtctctactaaaaatacaaaattagccgggcgtggtggcgcacacctgtaatcccagctacatgggaggctgaggcaggagaaccgcctgaacccaggcggtgaatgttgcagtgagccaagattgcaccattgcactccagcctgggcaaaaagagcgaaactctgtctcaaaaaataaaaagaaataacagtgttgataaaaggacatctcttattgaaagttgatgtccagaaatgaaaaatttcttttttataaaaatgtattacaggccgggtgcggtggctaacgcctgtaatcccagcactttgggggccgagacgggcagatcacgaggtcaggagatggagaccatcctggctaacacggtgaaaccccatctctactaaaaatacaaaaaaattagccgggcgtggtggcaggcacctgtagtcccagctacttgggaggctgaggcaggagaatggcatgaacctaggaggcagagcttgcagtgagccgagatcatgccactgcactgcagcctgggcaacagagcgagactccgtctcaaaaaaaaaaaaaaatttattacagctgctttatcatgtagaaataagaactcattaatcttgttcttattagcccatcatttataaaaagtggttattagatctgcactttctaaaaaggattctctcctgtttgggcttatgaattgaggggttagatgagctttatatggcacagtccagaacgggtttggatttacctgtgtcattaataagcttgttcagtaaaggttttcttggagccaaatttgctccttaatttgtctttgggacattaatgcctcttgctaaatctttgatgattaactttgctattgtttgataagtatgcaaacactaaagggagcattcagcactaactcttcgtaatagggaatatgtttaggtaattgtactgaacttcatctgtagaacacactatgggcctgctaactggaacatttaaatagatgagaacacattcaggtgtaaagcatttttctttaatgtatctagtcatattgccacctgttaatcattatagtcttttttttttgtctttcatttggcagaaaagacagctttgatttctggctgcaaaaaagatatgaggaagagctcctccccttccttgagtaactgcaactccgttcttgctaacaaaatatttggaattccacttgatgagctgcagcagggaggacatccagacaatgaggttccattcatagtccgccacgttgtggactatattgaggaacatggtatacatttccttactttgagggctagcttttgttttaataaacacaacttacacctttttgaccttggatttttaatttttttttttaatatggaaagtccaaaacataggaaaaactagaaattctttttaatgttttagtgtgatttttacttaaattcatatacttagaaatgacagttgcccagcctagaacaagttttagtgggggtgataggaatatttttaatggatataaggggtgggataaaatagaatatcccttagaacagagatagtatgtttctagatgtataatttgaaggtttttagacaagtcaggggagccaagaaaggctttccaaaagtatgagtattttaagttaattggagaatgaatatatatggtcaagcagttgacattgcagcttattgaatgattgccttgaactaacgtaggaggtctggagcaacaaggactttttcaagtcaatggaaatgctgagacagtggagtggcttcggcagagatacgacagcggagaagaggtggatttggttaaggaagcagatgttccctcagctattagccttcttagattttttcttcaagaacttcctgaacctgttatccctggcagtttacatattcacttgatgcagctttctcaaggtaacataatttgatacttatcaattggtcatttgttgttaatttcctagtctttaccttttagaaatcttgacatgtaaacagtaagtatagtattttagagattaatttgttattttctcatttgctttttggggttgtatgatcttgtcataggaaaggcaacttccgggatccctctagtactatttactttttgtgattggttttattagcctaagaaacagggtgaagaagaggaaagggaggagacaagaacaaggagtaggaggggtcatcaaaaagaaagaagagaaatttatgtaaggtaatgtgtgtggtggcacaatgtccaatagtagccaaaggtgttgcttagtggtgatattaccactattagggttacttatccctggtttgatagaatttcctagcaaaaggaagaagacaactttgattctaggctttgaatatacctaaaacttgttcttgaacacttagctaaaggaaatgaatatcaaattgaacattagactctaagctaaagaaacaaaaaaagatgtatctttgttaggtttttttggtggtgactaaaaagtagtgcttagctagagtggaacaggaacaggaaaaataatggtagaggcagcagaaaggtcaaagaaccaagaagtgaggaaatgcttctgttcctagagccaaatggtattcatgtatatgtaatggagggacatgcttcattatataggaaaatgtgtaaagttggcatatagagttatatatttcttgaattttaaaattaccctttcaggcttttttggtattatggagttcatttattttttgaatcggggcttctaaagaaattcagttatgctaagaaattataactacttcctttatgcctatctctatcacagctgggcattctataatatgtgtgtatatatccttaagtattatgttgtcagagaaggtatattttctttcgaaagtgtttatccgtctttttcttaaattttaaactgtgagcctaagttagttggatgtctttgatttatgtataaaggtcaatgcaaagacgttctgtgaccctcttacacatgttttctgtacagctaaatcataaggcttactttgaacttgctatattcaggaaggggtaacctgattcagttctgttcttttactctataatctggatcaaaaaacaggttttaaaacgaaatgttattagtaaggctacccttttttcaatgcatcactttaatttttctccccccaaaattacgcttttttgttttgaatttttgaatccattttattattacaggaattttttcaaatgtttatgttgagacacataataagcattttgcatttattaaatatgaaccgaaaccaatatggtaaaggttttttgagccttttaaaataactctagagccattctctttatagtgataggtttccatgttccctctgttagctgaattgcagacacatatttaaagttccaagagtcagataatctttcagtcctgaatgaaaatttataaattaataattgcagtgagatttaatggaagcaaagtcattgactcactggtagaatctatcagaagctatttatttttcactaggattgtcatttcagttggttttcatttattcgttgttgttgtttttttgaaatgtccttgctctgtcgcccaggctggagtgcagtggtgtgatcctagttcactacagtcttgatctccagggctcaagtgatcctctcgcctcagcctcttgagtagctgggactacaggcgcgcaccaccatgcctggctaattttttaaaattttttatgttttgtagagacaagatcttgctatgttgcccaagcaggtcttgaactcctgagctcaagtgatcctcctgtctcagtttcccaaactgtctcagtttcccaaagcactgggattataggagtgagccattgtacctggcctggttttcatttaaaattatgacagcatcatgtactgttgggacaactaagttcctcttcaaagacacaactttctggtcataaattgtaaaccaatcctaccccttcttttctttcaaaaattgcgcatttaccctatttgaaaaagtttcagtcttagccatggcctggttttcatttaaaattatgacagcaccatgtactgtgttgatattcatggaattacaatacgcatcttgttacttattcttatgctaacattcacttgtgaaggaatttaagatatgcaaaaatttgcaaaagagatgtgcaaaaaaaagcaaaaatgcttatggtcaataagtgctttcatgtttaatatgagaaattcactgttttcttctattttccacttatacatagataatcattagcatgtgtatgtatgtgtgcacatatacacccgtttctttaatagctgtgcagctaggtatggtagtatttggggtgatatttgcatttatgttgtaatatcatctgatcattcattcatttagttattttgggaaggtgtctagatctctgaacaaagtttcctctcttcatttactgtagataattttgtttgtttcttttattctttgagacagagtcttgctctgtcacccaggctggagtgcagtgggaccatcttggcccactgcaacctctgcctcccaggttcaagtgattctcatgcttcagcctcctgagtagcagggactacaggtgtgtgctaccatacccagctactttttgtatttttagtagagatggggtttcaccatgttggccaggctgatctcgaactcctgacctcaagtgatctgcccaccttggcctcccagagtgctggaattacaggcatgagccatggcacccagctgtagataaataatatgataatattttaatattcacaaatacatgacagttaattgcttttaagatcatggaagaagcactgttgcagttgcatttcagcttttgtttttaaaaagtggtttcatttttctgtggtagctggacagtgcatccactggtgtggttaaaccttttatttagactagggtttcacagccttggtactgttgattttgggcttgataattttttgtgatggggagttgtgtaccttaggatgtttagcagcatccctgacctctaccaaaggcactgtcttccccaaagtcatgacaaccgttcattgtcagatgttgacaacttctgggttagaccataatggttagtccaactgcttatacattgtgttttgatagaaaacatagctagcagttttgtggattagttagaacatttccaaaaaatgttacagtacttgaaggaattgttaggggaaacttctctgatacatacattattttccttggatatgatttaactagaaattagactccaaaggaaagaaatttaagcaagtatgtatatatttaatgtattttgaaatgcttctctgccttatttgaagacttcagacacaggccagtataggtacaaatgtgtagaggaaatgtagccaaacaaaactttggataatgtggatagtatttcaaataaaaacagtattgcccacaagcttaccacctcaagtcaaatggtgtagtatgttcaacatcttttttcagttattgtgtattcattcagtgaattcaactaatgtttattgaacatctgctgtgtgctaggcagtgctctagatcagcaatccccaacctttttgacaccagggactggttttgtggaagacagtttttccactgatggagaggaggaatggttttgggatgaaactgttccaactcagatcattaggcatcagattctcataaagaatgtacatctagatcccttgcatgcatagttcacagtagcattcttgctcctatgagaatctaatgccgccactgatctgacttgctgctcacctcctgctgtatggcccagttcctaacaggccacagactggtctgcagccccggctggggacccttgctccagatactgagaactcagcactgaaaaaaactagatgaaaatctctgccctcatggctgggcgtggggactcacgcctgtaatcccagcactttgggaggctgaggcgggaggatcacttgagcctaggagttctagaccagtctgggcaacatagggagaccctgttgttacagaaacttcaaaaaatagccagctgtggtggcatttgcttgtggttctagttacctaggaagttgacgtgggaggatcgcttgggcctgggaggttgaggctgtggtgggcctcagtgatcatgccactgcactccagcctggagcgacagcctgtctcaaagaaaaaaatatctctgcgctcacagaactaaaatgctataggggataagggaagatggtaaagtagatgataaaaataaacatatggataggtatgctagacattaagtgccacagagctggagagaatgttaggtagaatttgtcaagtgttggtatcttcattatattgataatattaagtgcttgcatttttgatatgtgatttctataataattttctgctgaatgcttaggttgttaaaatttctcatcagttataggtccagtgatttaaacattaatccagggactattctgtctgattttaaaattgaagtactggtacatttgaatggacagctggtaatattacaaagtatagaagagttgttattggttgcattttaaattttaagtaaaactcatgtgactgtagcctttcctgataaacttaaaattttttttttttttttggagatggagtcttgctctgtcccccaggctggagtgcagtggtgcaatctcggctcactgcaagctctgcctcctgggttcacgccattctcctgcctcagtctcctgagtagctgggactacaggcacccgccaacacacccagctaattttttgtatttttagtagagatgggatttcactgtgttagccaggatggtctcgatctcctgaccttatgatccacctgtctcggcctcccaaagtgctgggattacaggcgtgagccaccgcgcccagcctttttttttttctttttgagacagggtctcactctgtcacccaggctgaagtgcagtggcacgatctcggcttactgcaaccactgcctcccaggctcaagccatcctctcacctcagcctcctgagtagctgggagcacatgtgtgtgccagtacactcagctaatttttgtatttttggtagaacggggtttcgtgatgttgcccaggctggactcgaactcctgagctcaggtgatgcgcctgtctcagcctctcaaagtgctgggattacaggcatgagccaccatacaaggccaaatttttttttttttgaatcaacatagtactggagtcctatttcctgataaactttttagactagtgttattttgcagagatagttaatatcatgaccgtaaccttttaccaggagtttttcagtaaaataattttaagaacctgcggaaaaatacaaaatgaaacataatttaattgatttttactcatgtagcacaataaatcacttcatttcgagaggacctctgagcacttatttctcccaaatgggatcctcaccaattagtggaatgaatacgggtctagtttctgttaatgaaaactcattgacacgataaatacaaggcctaacttgtgtgataaagtttacttgataagcagaaaccaacatgaatttagaggagaaaaacagacgagaaatgaaagaccttttaatttagttatactgatattgctgaagttaattgtttattttaggacgccaggagaagaaaatcacactgttacctttttctttccttctttttactttcatctaagctgaaaggtatcactgatactattagcccctcaaattgcatctctgctttgctcactagtggtttgtattgtctggcatggccagtgcattttgacttcttatagttggcactagtgtggaaacacaggtacagtcatgctggagacagtaggatgagaattaaaaaaaaaaaaaaaaaaaaaagagaattggggccaatgagtaatagatgaggaaaacatcctccagcaattaagggattgagttccttttttccagctcctcttctccacctcttctccatttcataagtgaaatacaaagccctaaggcatttggccccagtagaggaagtgaagaggttttgaattgttgtattaaaaaggtgatgtgggtggagtaatgtgaacctggcaaaatatcagagctttgctttttcctttattgaaaaaaacctgttattattgttttatagattataataatgaagatgaatttggaagaaagttgaggttcctcttgcaacagcttccacctgttaattatagtttgttaaagtttctgtgtagatttttagccaatgtagcatcacatcatgaagaaatttggtccgcaaattctttggctgctgtctttggtccagatgtcttccagtaagttgtttaaaaaatttttgtttaatttttaaaaattagatatgtgaggccgggcacggtggctcatgcctgtaatcccagcactttgggaggctgatgcgggcggatcacaaggtcaggagattgagaccatcctggctaacacggtgaaaccccgtctctactaaaaataaaaaaactagctgggcatggtggcgggtgcctgtagtcccagctgctcgggaggctgagacaggagaatggcgtgaacccggggaggcggagcttgcagtgagccgagatcgcgccaatgcactccagcctgggtgacagagcgagactccatctcataaaaaaaaaaaagaaaaattagatatgtgaaatggaatcattatattgtctcccaaggatcgcaggttgcttgatgaacaattattttttatagtagatatgattaattcttacagcatttttgtgaacagggtacaaattaggtaggttttacagatgggagaatggaagcacagaatggtaacataaattgcccatgttcataaagtatctcattggttgtcttctacctttacctgtgattgatttaagaactctcaattcaatttggacttctattcttagcatttacacagatgtggaagacatgaaagagcaagaaatagtgagcaggataatggctggacttctggaaaactactatgagttttttgagaatgaagaggaagatttttcatctaatgatttgagttcaattactgaacaggtgagaatattctatttggagggataatttttttttttttttttttttttaagaataatatgctcttaaagacttgccacagacataagtggaatttaaatctgacctggaagtaattatcttggttattatatgtaatcagtaggtggcacattcatgatttttttcctgaacaacatcctgtcctccataatttgattaataaggaaaaggcattaaaattagagtatatggtagagattttttgtttcttttcctattgtttattttgtaaggataatgcagtgttttggttttttgcagagaaactgctagcatagaggaatataggcaaggggtgagaaatttaaagtagagggaaagattcggtacacatttttaaaaatttgaagtttttcttcaataatagagcaaatcaacacaatagtataattgtcactaatgggaagcatctggatattaatagtttaagtggcaggtaatttttaaattctggtgactctagaatattaaaatctctttctgaggttacattataatcttttaaaaaattgttttattatttatagagacagggtcttcttatgtcgcccaggttggtcttgaactcttggcctcaagcagtcctcctgccttggccttccaaagtgttggtattacaggtgttagccaccacacctggccccacaaaatgattttaaaaagtgtgatataacatgttaaaataggccaggcgtggtggctcatgcctgtaatcccagcactgtgggaggctgaggtgggtggatcagctgaggtcaggggtttgagaccagcccggccaacatggtgaaacactgtctgtactaaaaatataaaaattagccaggcataggggcatgtgcctgtaatcccagctactggagaggctgaggcaggagaattgcttgaacctgggaggcggaggttgcagtgagccaagatcgtagcactgcacttcagcctgaccgacagagcaagactccatcttaaaaacaaacaaacaaaaatgttgaaataatagtatctctgtaccaaaaaggtgtgaactgaataagtttttattctcagttttaaaagccttctttaaaaattttttttgatattttgctgttgtgcccaggcttttattaatcaaccacaataattcccacccctgccccaaccctttttttttttttttttttgagacagtctcgctctgtcgcccaagctggagtgcaatggtgtgatcttggctcactgcaacccctgtctcccaggttcaagcaattctcctgccccagcctctcgagtagctgggatgacaggcgctcgccaccatgcctggctaatttttgtatttttagtagagacaggctttcgccatgttggccagactcgtctcgaactccaggcctcgggtgatccacccacctctacctcccaaagtgctggggttacaagcatgagccactgcacctggtccccttttatacttctgaaaactttttttttttttggccagtgtttccttgcttagattaccagatggatattaagtacatcctctcaactttcactagttaataaaatacgtagatggggaaagaggataatttcccattagatctactttaaaacctgatctatcatttgagattttcacctttgtgttgaaatcttacctctcagttaatcacttaggccagtgatttttcagtccttttcattagcattatacatgatgtgggatagactaggaaagacatttataaacacaacgaattatacagaatctgctgcatgtactttacatgtgaacttaatggttcactaactgttttgtttttatttttgtttttgtttttgagacaaagtcttgctgtgtttcccaggctggagtgcagtggtgcgatcttggctcactgcaacctctgcctcctgggttcaggcaattctgtttcagccttccaagtagctgggattacgggcacatgccaccacatccggctaatttttgtatttttagtataggttggattttgccatgttggccaggctggtctcgatcttctgccctcaagtgatccacccaccttggcctcccaaagttctgggattaaaggcatgggccaccgcgcctggcctaactattgttaataatgactttttagtgacccatctgactagtgagcttgatagacctgtggttgagacctcctgctttaggtagtttggatggtggatactctcttcatttatataaaaagtgatgttacatgtagaagctaggatctatgctattaaagaaatgacaacaatttcagttataatgataggcattattgcttattatgtatagacattgctgaagaggttacatatattaatcctttcaaccagctctgtgaggtagttagtatagcatctccattttatacttaagacttggacaagttaagtaagttgccagagaaagttagggacaagtagggatgtgtgaatataggtatttctgcctctgaggcctagcttttaactactgtattatactttatttaatttcgaaaccaaatcttactctgtcacccaagttggagtgcagtgtcacaatcgcgtctctctgcagccccgacctcctgggcccaagtgattctcctacctcagtctctcaagtagctgggactacaagcacatgccaccatgcctggctaatttttgtatttttttgtagagacaaggtttcaccacgttgcccaggctggtctggaactcctgggttcaagggttccaaccccctcagcctctcaaaagtgctgggattataggtgtgagccaccgaccatacccaacctgtattatactttaaaataggcactctgtacttgttgattaggagtgtgatagaatatcacagtgtaatgacttttcttttggttgcagttttactttctgatagtattctagtaactgtatttgtccatcaggaaaaacaccactgttacatgtagtagtaaacacatttattctagatatttctattgcatttttctagcatggagaaaaagcatacttgcattgctcagagtctttaatgactagtattagtttatattaagcaattctatagatagtttcttctttgggataacttaaaaactcatttgaaaatattttgctggttttccttctctaatatttcagtatctttttattagagtgattacctacgtagccagtttcataatggaggacattttagagctcctgctagcaagataattataaccttgacttgtgcttactggtcaaaatatgagttcttccttgttataggattccatctcttcatgaataattcaatctgaatcacttagaagttagctgacattttctaaaatgtagctaacatcttaaggcaacattttttttgcgcttcttttttcacacttactatattaaaatgacttgtttaaggcacctggaaaatcagatcaattaaaagtctgttgtaagtgttacatttacgaaactagttagaaaattaagttttcttaatgttaactataccttacaggcttacttatattcctagatatactaattttgcaatatactaatatactaatttgcaactagtgatacactaatcctgcttcaaaatgttacatttgtctggttgcaattttattttgatatgaaaaagttgacagttacttactccataagagagattggtcctaggaaatgaggaaataaaaatgagttgtttgtgtttaaaattttcatagaatagtatgtcttagatgtgttaacggtttcattacattttaattctgaatttctttttatttatataggttaatgaactttctgaggaagaagaggaagatgaaaagctggaacatattgaagaacttccagaagagggtgcagaaaaatcaaatgacatgccagaggtggtacaattaaggatgactgaaaacatcctggaatcaaatagtgttacggcaacaaggtaatagctcagttgaatgaactttagcttttgagtatttcattctaagtgtaaactcactccagcattcagaaacacaaactgtaactatatgtgaaagtttggcatttgtgtgtgaaaaagagcaagaagtaaaatttaaagatgcagtcttgctaaggaattttcagttattagtgttaataccttttttcaaaaacataacttcttacaaatatttcttgttaaagttggttttgtattagcttattaattgggctggataaaatttcagaacctctggaagtagcatcgttagagaaggatacagtgactgaattgacttgtatatcccgtttccaggctacaattagttgtaactaggctgtaaggatggaactctgatccattaagatagtgctttccaattcttttcatgtacaaaatgataatatttacatggcatgctgggtaaattcgataaatgtggtaggctgaagaccctatcccagcacatagctgggaccactgggcacactatttaggaagctttagagaactcaagagaaagagtgaacctttctgtggcttttgataaatatttccagactacttaaaggatgtaacccagtttacattgtcatactccccatatgtatctttaggtctgctaaattctatgctcgttctccgtaaagctccatggtttactaaccctttctacttaggaggatccagctatatatttagtccactagatatttttcatttaatttgtgttcagtggaagggtggttaaaaagaagaggaaataggccgggcgcggtggctgacgcctgtaatctcagcactttgggaggccgagacgggcagatcatgaggtcaggagatcgagaccatcctggctaacacggtgaaaccccgtctctactaaaaatacaaaaattagccgggcatggtggcgcgcgcctgtagtcccagctacacgggaggctgaggcaggagaatggcatgaacccgggaggcggagcttgcagtgagtcgagatcgcgccactgcactccagcctgggcgacagagcaaaactccgtctcaaaaaaaaaaaaaagaagaggaaataataatttgagtcagaaagcaaaatgtcatttaaaagtaactggtaatatctaagggaagagctatctattgccatttaggaaaattatgaagtaattttaaatgctgctaaacacaattattacatttctctgtaggcctctggatctttatattatctatggtttcttcaaacaggatcataattctgttatattaacatgtttattctctctgttgcccgatttaacattctgtttttgcttttatgtgtgtttacatgaccttctaatttattttttgatggtttcttaactgtattttaattatatattaaaatattatctatatgttcagatatttaactgtattctaacattcttttttcttgatattttgagttgtttcagctagcttgtcagtactgtactgctactaaaaaaaaaaaatacctttgttgtttggcccttttttcctccttctaaattatttggatacatttactggaattgaagagtgaacctttctctggcttttgataaatatttccagactgcttaaaggacgtgacccagtttacactgtcattaacagtattttcttgaggaccttacagcaatagatttaaatgggtgttttaaattttgttaattaattaatttattactattttttgagaccagagtctcaccctgtcacccaggcaggagtgcaatggcacaatctcggctcactgcaacctctgtctcccgggttcaagtgattctcatgccttagcttcccaagtagctgagactataggcacgcatcaccatgcccagctaacttttgtattttaggagagatggagtttcaccatgttgcccaggctggtctcaaactcctggcctcaagtgatccgcttgccttggcctcccagagtgctgggattgcaggagtgagccactgcacccggcctctaattttgttaatttagagctctgctctccaataaggtggccattagctccttctgtgtatttattattatttaatgacagggtctctcgctctgtcatccagtctggagtgcagtggcacaatcacagctcatgtatagcctctacctcttgggctcaagcagtcctgcctcagcctcctgtgtagctgggaccacaggtgctcgctaccatgcccagctaggttttgtatgttttgtagagatggggtttcggcatgtcacccaaggtggccttgagctcctgggcttacaggtgtgagccactgtgcccggccacttgtgtgtatttaaatgtaaacttaaacgaactgaaattaaataaaattttaaaattccttccatatttgtgccacctacatttcaagtgctcagtagccacacgtgtggcaagtgactatcatgttgggcagtgcagatatagaacatttctatcattgtagaatttcttttggacagtgctgatttagacaagtgaattcattaagtatttttatttatgtaattaccagcaaggctaagtatggtttcaaatacatattactaatagcttctcttcgatcatctgtctggttttgtagaggatcctcctttgctccaacacagtcattggagatttagtggttgtcagttttgtttttttttttgagatggagttgcgctctgttgcccaggctggagtgcagtggtgtgatctcggctcactgcatcctccacctcctgagttcaagcgattctctggcctcagcctcccgattagctgggattacaggcccgcaccaccgtggctggctaatttttgtatttttagtagagacgggatttcaccatgttggccaggctggtctcaaactcctgacttcaggtgatctgcccacctcagcctcccaaagtgctgggattacaggtgtgagctaccacgcctggccagttgttaggattctttaattgcagctcctaggaacagattctggttaaagtatagaaaaagcagtttattaataagaaggattctgggctacagtcaaatcgaaatgcaaagataagaacatgggcagctctgtgaaatttagaaacacagaggcatgtaataatctcttcagcatgtggctattgctgtgagagttctgactgcctccgtctgtctgttattctgctttggagcacatagctgtggggtggtcgggagagggtctgccctaaatttagttaggtgtctctattcccatggccagcgtggaactggtcattgtgatttatgtgtctctgaggacggtgcgggatggagggaggagctagtttcccatgggaaaacagggctattaccaaaatgttggggtagggatattaggcagcagaaacagatatgtctaccattgtggtcttctagatttagtaatatttatgtgtttcggttaatatctatacatttcctttttattttagttttggctgataaagtgtataaagattaaaaagtacccatgactacttttttggtggtatctattgcttcattatagtacttttcaggtaaataaaaccctttacatgtcatgagagtagaggtacctgctgtttttttagttgacatttatttatttatgaaaatgttaataatttaactcttctcttgaaagtaaaaatatccacggtgtgtagtaccttctagactgtggtcaatttatattctatttgttattaaagatgctcatattaaaaaatttttataaattacctagttttacattcatttggcaacttatttttacggttgttattactgcttgagatagaggctaaagattgaagttgtttataggtgtgtcctctatgaaattaaaagtaaataaaaatgcatgccatttcataagtgcttaatgagagataagcaaatgaaaaattgaagtggaatgaagcacacagctagttagagggaacaggcccggcgcggtggctcacacctgtaatcccagcactttgggaggctgaggcaggcagatcacgaggtcaggagatcgagaccatcctggctaacatggtgaaaccccgtctctactaaaaatacaaaaaaaaaaaaaaattagccgggtgtggtggcgggcacctgtattcccagctactcgggaggctgaggcaggagaatggcgtgaacccgggaggcagagcttgcagtgagccgagatgtcgcccctgcactccagcctgggtgacaaagtgagattctgtctcaaaaaaaaaaaaaaaaaaatagagggaacagatttgtttgatcagcctttcagaaagaatgattagggtttttaaatatatttttagagatatttatttttgcatgtctctctgctaaacaaggatatctgtttgttttttgtttgttttcacatggagtttcactctgttgcccaggctgggctggagtgcagtagcgtgatctcggctcactgcaacctctgcctcctgggttctcaattctactgcctcagtctcctgagtagctgggattacaggcgcccaccaccatgcctggctaagttttgtatttttagtagagacaaggtttcaccacattggccaggctggtctcttgaactcctgatctctagtgatccacccgtctcggcctttcaaagtgttgggataacaggtgtgagccactgcacccaacttccattgaagtatattatttctaatccccagcaatccacttaagctttttattcttgtttcttaaaaattataaaagtactttgctgagtctagctgatttcattagtataacatgtctgttgttttaaaaactaagatcatttattatattatttttctctgaactcttcagagaggtaagagcgtttcattcctttggttaaatccctttaatgtctctctattgaaggagccaaaattcttaaatggcctgtaaggttctgcatacatagtctgccccatcccacctctaactgctgtacccgtttttcctttatctcttgcctgctctctctttggtcattctcctttggccataacaaaattctttaattcaccagtcatgttctacttgagcctttgcactggactgttcttctatatggatagatgtgccactagatagctgcatggttctctcagtatgttcaattctttgctcaaatgtcactgtatcagtgataacctcctcatcctccattcttgatctcccttaccctgttctgttttgttcataactgttataaccatctaacatacatgtattattgttattgtctgtcttccatcactagaaagtaaaccatgagacagcaggattatgtttacttatgtatttataacacttaggatagtgcctgctacagaataggcactcagtaaagtattacttgttgaataaatggagctttagaaggaagatggaattttcttgaatgttcaatttaatatgattaaaattacatatatagcaaatgtgtcagtgttctgagacagaagaaatataaaatatattgtttgattatctaccttggatgaaaggaaagtcagggagaaatttccctagaatgcatagggcctagtatatagggagctcttaatgaatttgaaactggagattgaacttttcgtaattaacatgtcatctttttgagtattcctatgaagtaatttgcaaacatttattggaaatattaggtagcctgctttgtatttctcttcagaagtagcctaggaaagtatgttggaatcctaagagaaataaacacttgggggatgatttaagttagcatttctcaaacttttggtcacaaacattagtacccttataaaaagttattgaggactccaatgagcttatgttaatgtggactatacttattggtatttaccatattagaaataaaaactgagaatatttaactacagggagtatttctttgccaagttgtagtttggaaagatgctgttttttttttttttgttttttgttttttgagacagtgtcttgctctgtcgcccaggctggagggcagtggcacaatcttggctcactgcaacctctgctttcagagttaagggattattgcgcctcagccacccaagtagctgggtccacagatgtgcgccaccacacctgactaatttttgtaatcttaatagggatggggtttcaccatgttggccaggctggtctcgaactcctggcttcaagtgatctgcctacttcggcctcccaaagtgttgggattgattataggcataagccacctctcccggcctgggtgcttctgtttgtagctaaaatgtaactatttatgacctcgtggatttttattaataaagtctttctcctttattagttttaagttaatgcttctcagatattttggttatacaatccccttacacacttaaaaattattgggcaccctaaagaacttttgtttcagtttgttatatctattggtgtttatattaggaattaaaactgagaaaaaattatttagttaattttttatttttttgagacagggtcttgctgtgtcacccaggctggagtgcagtggcatgatcatgactcactacagccttgacctttcaggctcaagcaatcctcccacctcagcttgatgaatagctaggactacaggcatgcagcaccatgcctgactaatattttatatttgttgtaaatacaaggtctcgttacgttgcccaggccagtctcaagctcccaggcgcaagtgattctccagccttagtctccttaaagtgctgggattactgggccttatttagtgttttaaagtaacaataaacctatcacatattagtgtaattttttttaaatgaaaagtaattgtgttttctaattccctaaacttttttagtagcaatgttttacatttttgcaaacctcttgaatttctatcgtgaaggattcttacattttcttctgcatttaatctgttgctgctatgatctggaagttttggtattaggaagtggggcctttgggaggttattaggccatgggggtggggtcctcatgagttagactggaacccttataaaaagcctgagagaagactccttagccctttcactcagtggtaacacagtgaaaagtctatcaatgggccctcatcagacactgaatctgctgctgccttgatctcagacttctcagcctctagaactgtgagaaatacatttctgttgtttcctagtgtatggcattttgttatagtaatgtgaatggactaagaaaattggtgctgaggagtgggtgttgctgtaacaaatacctaaaatatggaagttgctttggaactgggtaatggatagaggctggaaggtcttgcactcacccaggctggagtgcagtggtgtgatctcggctcactgcagcctccgcctcctgggttcaagcgattcttctgcctcagcctcctgagtagctgggactacaggtgcgtgccaccacacctggctaatttttgtatttttagtagagatggggtttcaccatgttggccaggctggtctcaaactcctgacctcatgatctgcccacttcagcctcccaaagtgctggggttacaggcatgagccactgcgcctggccagaaaattttttaaaatgagctgggcatagtgtcatgtgctgtggtcccagtgactcaagaggctgaggtgggaggattgcttgagcatgggaggtccaggctacagtgagccatgattgtgccactgcactccagcctgggcaactaagtgggaccctgtctcaaaaaaaaaaagacaaaaaaaaaaaaagaccctgaaggcaattcagaaatcaattacaggccttgagtgcaagggcctgcgaggaggccctaaatgcaaaggaggggccaccaatgatgggggaccttggggaccttggcaagattccattatgcctggtaccatactcttctgccactttaggtatggctctggtgtgataacaggcagcaccatctctaccagagcacagagtgtgtgagccctaggggtggctacctccaccgttcaaaggatggggctgccccggtgacccagggaagaggaccatgatggggatgggatatggtatattggtcatttggaaaagattgcttcactgagttctgtaatcttccagatagttggcacatttgttaaagttcacattctttaatatcactgttgattgcatcagaagcatctttaagtattcaggtgtttttgagcttatggaggaggatacaggttttccagaattttgatttttgcttgaaaattcaaattttatattgtcagtttttcttagagtcttagtcgtttctgagaaaatgtctgccagtgttcaagtcctaataaccatggtttagatgttagtctttcaagtaaaaatggtattccgtaataaaagtgattagtttagctctcaacaaggtaagttatgctgcagaagtgctttatgagtacttcccttttacactgaatattaaaaaagaaatgtactcaaggagtaagatgaaattaatcattgttttctgcttctctgtcacggactggcccctttttaaaaagtttcaagtggctggtgaggaagaatgcagtggccacagtattacttgtctggacttatgctaagaccccaagcagctttttctaccattgattttgcatcatcattgttgaaaactttaaacaacaattttaagtttatttgagcattaaaggattcatgaatcaggcagcagtcaaaaccagaggaggttcagagtgctccactttagcagcctgagcattggggcttttataggctgaaagcagaagtaaagaaataacttgattgggtaggcatttgccttatttggatatgatacagtggaaagttcctagttagaggttagttggtgggttttgattagtcatcttactgttgacattgggtttcagttcacttatgtaggaagccaaggcactggagccatctcagcctgatggcctcccaatttaagaaatttgaaaacatgcaaatgtcagcacagtgaaaaaggcatacagtatgaaggtacttctaactctttcatagacggttttgaagactctcaggtttatagacctctttttgagaaccagtggtttaaatgtttgcttgtgagttgtattgattggtctgttcatgtatctgttatttctgcagttgtcattagctatgttttgttaagatttaagctgtcttcagagtggaaaaaatggtggagtttggggtgtgagcagcctagggtgcatgaaaaagcagtagttttgtttgattgatcctgaggttcttatccatgaagtccatggaaatctcaagattgtttctaaattgttgttttatatccacatgtttatcatttagctttatatatattatatatatatatattttttgagatggagtttcgctcttgttgtccaggctggagtgcaatggcacgatctcagctcaccgcaacctccgcctcccgggttcaagtgattctcctgcctcagcctcccaagtagctgggattacaggtgcctgccaccaggcccagctaattttttgtaattttagtagagatggggtttcaccatgttgggcaggctgcccttgaactcctggcctcgtgatccacctgcctcggcctcccaaagtgctgggattacgggtgtgagccacggcatctggcctcatttagctttatatttaaatgtacaaattttaggggaatttttacctttaaaaaatgtgaagagagaaaggagagttctaaaagagcttttaccttttcttccctgtgctttgtaatctttttcctgtgttgtattgggaaagtttattttggcttgaggtttaggtaatttttaatttatgctcatgcttaagaaaccacaagccaaaaaaaattacttcgtgttataaagttcatttaaagttgtgcttctgatgccttcctaaaactcaatttagaaagatgaaaaattgggctgggctcagtggctcatgccagtaatccagcactttgtgaggccaaggagggtggatcacgaggtcatcaggagttcgagaccagcctggccaacatagtgaaaccccgtctgtactaaagatacaaaaaattagctgagcatgttggtgagcgcctgtaatcccagctactcgggagggtgaggcaggagaatcgcttgaacgcggaaggtggaggtttcagtgagctgagattgcacattgcactccagtctgggcgacagggtgagactccatctccaaaaaaaaagaaagatgaaaaattgaaactctctttgtgggttgctgatgttagggcttcattcttgtgagttcattggtttctgatggttcaattttagataaggtgcaggaaagaaggtgtaagtgatttaggaagagccatgggtttagggttttaagactggtttctggccaggcgccgtggctcacgcctgtaatcccagcactttgggaggctgagatgggcagatcacaaggtcaggagatcgagaccatcctggctaacgtggtgaaaccccgtctctactaaaaatacaaaaaaaaaattagccaggcgtggtggccggcgcctgtagtcccagctgttcgggaggctgaggcaggagaatggcatgaacccgggaggcagagcttgcagtgagccaagattgtgccactgcactccagcctgggtgagagtgcaagactctgtctcaaaaaaacaaaaaacaaaaaactggtttccacttcattctgtggatcccctactgagaaaatatgccttcagttgactagaggggtatgcggactgtagtagtatcttttttcttttctttcatcgagtcatacagtttgcaaaatatttcagttgacagattttatcagttcacattttcaatatccaggttccacttgagtgtaaaaaggaagtcatactttggtggaagtaccagaaatgttgggcagtaacaagtagaatttatgctctgggtcatgaggaaattttattagagttaaaaaaaatgttttaagtactagcacatgataaatattgacaggttctctccctcttttccgtctcctgtaaatgatgcctttgatattttaaagacttgttatatataacttattgactaactttgtaacagtgagaaatcttttgatatactcttgtcataggtataaaatactcctaagttgatggggaaagttaggaaaggatttttgcttttggttttaaaggagcatgaggttattatttttgttttgttttatatgttcatttttcaaaaccatagttttttaaatggtaattttggtatagttctagcatgactcatctggaagctatccaatttttagacttgaaacgttaaccataaatgcttttctcaaattggataattgaacaatagcactattttgcatattttagtaatttcatatttataatttatgtccctggttatagtagtttgattaatgaaaacagattggtttctccacttatattggattaggcttatatatttttgagagaagtctagctagattaaaaagtttgttcctctttgtccacctcctgaaaagttgcaaagtaatgaggaaaaaaattgtagactcttgattgggtacctccttgtcagtagtgacctcatgttgcagtctttttccgtttaaactgcagagtgtagcacagctctactgtgtgtaggactcagcactaataattgctcagcagtttttataagcctatcaccttcctttactgtgctttcaatgaagtctttacctgatgtttttgttggaaggtgccagggtattcagaatggtttccaaggctgtgttgcactggtaaagtgatctttaccagagtcagttgaggctgaactgcaatacttttattgaaatatcgtttgtagcattaaatatttacaattgggaaattaaaataatagtagtttcttattttatttggatacaaaatattagtgactggagtaagtggttgcaagattgatcttatgttctcaagatgattatgtcatcgtaggcagatttgaaaatagagttaatagcagaagggataaaatgtcagggaatgactatagtcttcaatgttgtgcttgactgatgactttaaaatatatatgtcccctgtgatttattgtttgtctttctagtcaaggcttccttgtctaggggttgaatgaatacaattagcatttttatgtggtctttatggcatctgcctatagtacctatgtaacttgacctgaaatttctcagcagttatttttcttgtgtctttattttagctctcacatccctgtgatatctatatattttagctgcagatgcataactatattgatatatcttttttatttctattggtgtgtgtgagccctggctgatatatcagggctttttacccacaggatttgactaaagtatgaaaataaagaataattaaaatctgtgaaatctgaaagctaagtcagtcctttttgtccttcagaagctcagagaacaaagttgtacaattcattttgtatgtagccttgtgggtgacaacctgactcttaaagtagaaaatctatttatttgatttgtttactatggctggtgggaggctccttattaaaaggagctgtttatttgattgtcccagcatattcttcagggctaaagaatctttactcttgcagtaataatcgagcttgctgatcactacttttatatatacttgtagttttcagtagcaattaaaagggttaggaagcaaaaaagatcaactaccttgtgatctattcaatttaaggccactggaacttttgcctctttttgtctcctttgaataactggaaattttattaaactttattctttttggaggctggatatagacctaggccagtgtttctcaaacttactactatggataagaatcatcattggcatttgttaaaaatgtagactcttgggccctactttagagatttggagtgggaacttggaatctacctttttaaaaagcttttttccttgttttattttattctatttatttatttattttgaggcggagtcttgctctgtcacccaggctggagtgcagtcgtgggatctcagctcactgcgacctccgcctcctgggttcaagcgattctcctgcctcagcctcccgagtaactggaactacaggcgcacaccaccatgcctagctaatttttttgtatttttttttagtagatacgaggtttcatcttgtaggcccggctgctctcgaactcttgacctcaagtgatctgcccgcctcagcctcccaaagtgctggttataggcatgagccaccatgctcagcctctttgctttattaaaaacttaattttttaattaaaaaaatagatgcggttttgctatgttgcccaggctggcctcaaactcctggcctcaagttatcctctgccctggcctcctgaagtgctgggattacaggcatgagctgccgtggctggcctcattttgtattggaaagtaaatcatactacagaaatgggcataaagtaaatgtatagcaaaacaagttagaagcaaatatccttgtaaccacacacatctgtgaataaactgacagcaccccagtggctctcaaaatcctcatcccctccctccctactaaggtgattactatgtggacattatagcaatcacttccttgtatgttttagagctttatgaaaatgaaatcagcttatatgtaaattcttgatctggtttctttcactgaacggtgatttttttcactgtgtaagtttgagatttatccatgctgctgcatgtcactgtggctcatatcgttgtaaagtatcctcttgtatgattacaccacaattatccattttgctgttggtggacaattcaatttttttactttgtgacttattaatagtagtattatatacgttcttatacacatcttctagtgtacatgtgcatgcagatgaagacattaacacctgtcttcagttttagtaagtattccctaattattcaacgtacttattccagtttacatccctactaacagtgtgtgacagttgtttcacatccttgccaacacttggcattaactaatcttgtgagcatataacagtatttcattgtcactttaataagagccctcccccttttcatatgtgttttggctgattcctacttttgtgaactttagtggttcattggaggtttttttttattttttattttttgaggcagaatttcgctctcgttgcccaggctagagtgcaatgacatgatctcgactcaccacaacctcttcctcccgggttcaagtgattcccctgcctcagcctcccgagtagctgggattacaggcatgcgtcaccatgcgcggctaatttttgtatttttagtagagacggggtttctccatgttggtcaggctggcctctaactcccgacctcaggtgatctgcccgccttagcctcccaaagtgctgagattacaggcatgagccactgcacctggccttttttttttttcaattctttgtcaggagactttaaaaatttatattaaaaataggttttaaaaattttattattttttattatataaaaaatggttcctggctgagcacgatggctcacacctgtaatcctagcacttggggaagctgaggcgggaggatcacttgagctctggagtttgagaccagcctgggcaacatgatgaaaccctgcctctacaaaaattacaaaagttagctgggcatgtgcctgtagtcccacttatttggcggtctgaggcaggagaatcccttgagacggacgtggaggctgtagtgagctttgtttgtgccactgcactctagcctgggtgacaaagtgagaccctgtctcaaaaaaaagttgctaattttaatcaaatttatcactcttttcctcctgtggttaatgctttttgtgtcatgtttaagaaatcttttcctaagtaaacatttccacattatcttcttacagctttattattttacctttcatgtttagatctacaatctacccagaattgattttatctctcatgtgtgaggttggggccaagtaaacttttcccatatggataccaaattgtatctcattcattttttaaaacactgccatttccctgctttctgtacacaaccttttgttctaaatgaagtgcatatgatggttgtttttcttttctgtctgcctatttttttgtgtgggtgccatactattttatttactttggctttatggtatttgaggtttgggataaagtatagatctccaacaaaataacactgtcacttcaggagattctgatacaagtggtccatggatgacatccctgctctagagatgctgtaagagagctcccaaattctggcttagtatatttgcctttgtttatagttataaaaacacattattaaatgaagccattttggtacatagttgcacacgttgtttatgcttacacatataaagacaatttctgatattattttctaatcttaatgagcaccaatgatttcacaacagtccattgtatttatcctggtccattttatatattcatttgctgatatttctttcttaaaaataattctgcaaatatagtaaaatgttaattatagactttaaatgttggggctataggtgttcttatacagtttattttcacttttctgtatttttgagaagttttataatattggaaaaatgctacagagaatactttatggtataaaatccatcctccccttttgtatctaggataaattgtggtagatttgataaaccctttttgatagagtctcagactttctgagtcaaagtgtgtgcacatttttagagctctttgaaatgcattactaaatagatttccataagaaatttttactcattaaccttcccactagcaacatgcatgccagtttcatagcctttgtcaatatactatattgacatcagcagaaatatatataaattttattttaatccttatttgtttattttttttgagatgggggtctcgctatgttgcccagggtggcctcaaactcctgggctcaagtgatcctcctgactcagcctcctgagtagctgggacttgaggcatgagccactggcacctggctccttattttaaacttgtatatctagttaggttgattatttttctttttggttatttaattctttatgaaatatcttgtatccatttacctactaacattttattgataatctaatctgacaaaaaagggtgagaaaattcctctgggaaaatgagcagatgactaacaagggcaaatctgagaaagaacagagaggatataagccctaccaagaattaaaacattatataaagctttagtaacagactgatgaagtaagtagttgagaattagagagcttcttcaggatttggtataagataaagcaaaagcttaccagagatcacaaattaaatggctaagagtgttcaatttatagatttttccccacaccattcagtatgccacattgtcagtggattataattagatattaaaaataaaatgaatatttctcgataggcaaggaattatctaagtttagtagagattgcaaatattatcaaggaaaataaaacagatcgcaccacataaagatttaacttttgtaatttaatagcagctgatcaccgaaatgtaaatatgtaagcaatagtgtattagagcaaaatatcagaaaatgatttaatatcctagttcatgttaagactcttcagggaaagcctcatttatctttttactttttgttttttttctacagaaatcaataaatatttaacttttagctcacaggaaaccgctagaaataaactgatgatggctacactcttctttgtaccatgttttggggttttttccccccagcttttttggatttcagaaatgaagttccaaaaaactttagttgttttatttttctttcttttttttgagacagggtgtctttctgtcacccaggcaggagtgcagtggcacgaccacagctcactgcaacctccctgggctcaagcgatcttcctgcctcagcctcctaagtagctaggactacaggcatgcaccatcatcatgcctggctgatttttattttttttgtagagatgggatctcgctatgttgcccaggctggtcttgaattcctggtttcaagtgaacctccagcttcggtctcccaaagtgctgggattacaggcatgaaccactacacctagtcagaaaaatctttaagtgtgaatattggtaaacacttccctggagacgatcagcatgaaggcctttagaaccataaataatccattcattggaaactagcatgatactggcagttaacaaaaaatatttttatatgtaggaggggttatgtgtgtcagaccaagagggcttactgttgtttgataaagcatttgttcacttcgctactgagagacatgaagattgctgagtgaatgaatggtaaatgatactcatttggtttcctgcagtggatcctgacaatactaacttcatagcgtttgttctgcattttggttagagattgtattgccacattttggaggatcttcataaaactaatttacgtttaaaaaatgacaaggtagctacagatgtggtgttcaggtcaagaaggcagggtcactcctccctatggctaagtgttggctgtgatgatgtgcttaggcacacagtgccatttaaacataccttatcttttatctgataaatgattttttaaaaattacctgtattcatcaatggctaatactactgttcacctaaatccagtacaactaattttccctccagctttggaaatagatcagtttttctccacctgagcaccagagaaagtagttgtcccactctcacccccacaagtatatatatttgggggtctttttgtgtgaaaaatagtttctttagaaaattaggttcatcatctgtgagaggtgctcatgctgtggtgtgtgtttttgtttttagtcacttttttttgttgtagaaggcagtagagcatctttgttaatagcaggggctttggggtacccaacccatggccatatgcatttggccaagttaattaacatctttgagcttcacttttgtggaaagggggaaataattgtaactccttgggtattgaaagttattaaatgagagataaatgcatgtaatggtcctagctcataatgaattctaactttaaaatttttggtcttgttagtgatacgtttttccaaatttattttctttggttaatatttgaaagctttaccaaccagattcagaaaatatttccaacttgatatgtaaacaagaatacaacacttagtatgtgctctcctggttgtgtcaaggtagtgcaaatatggcagatttcagcacattttgtagttattaagtattgaacatttttatagctaatttctttctttgattgcagcacccatatatctcccatcagcatcctaccagcctctacagagtaagtagtatatttatagaagacaaatttttaagattttaaaatactactaagctgtagaaatgaaaataatgtacttgtgctcactttagaggaaagactgtacacaggcagtaaactagttttttatgtactgtgataggaacaaatgaagaagaaacccattgcattactatacaaaataaagatgagctttcttcagatggtttttttgaatcctctgaaataattgaaaaatgttcatagaatataagttttaaaaaagtagactttacataagaagtgtgagcagtactcatggtttctttcattttgctgttagtaggttattttgctttataagtatagctttgaaaagccttatttagtggttttctgtgtagtgaggagtgaattatagggacaactgatctttcccatcccagtaataatagtgacattatggttgatttgtatatgattgtctgtttgggtaaattttacttttaaaacttaagccagtatcatgtattccttttatgtatttctttttacactttggtttacccatttaagtaccataatagttttactggtcataggttttagcatttatgtctgtgtcaccagatatccagttagagtgactgcttcttactaaaacgtgttgttttgtagtattttagaaagaacaattagagcagctgtggaacagcacctttttgatcttcagagcagcatagatcatgatcttaagaatttacaacagcaaagtgtggtgtgtaataatgaagcagaaagtattcattgtgatggggaaggatctaataaccagtaagaaacattttactgttgtttattaaatgttataaaattgttttatcttaaaactgtattgctacttaaataacaggatctcatctttcttggagatttctgaaagttgtttgtgaaaagtgactttgtatatatacttgtatatacatccatacttaacactggatatctcatcacttttttcataatatatgttttattaagtccaatacaggtttgtttgttttttgttgttttttttcccctgaacatcgaatgaagtaacaagcttacctttaggaattatgttgtatgaaaaataactttaaaaaattagactctgcaacagagtgatctagacagacagttacaggggcagcagattgatatcactatagtgcatataatcattgagtgaaatggtgggcagaatcatcctttgctatttaaatagttatcccttcccaccagcctctcccctgcttatgtttttgttagattaactcttaatacaggttgagcatccctaatccaaaaatccaaaatctgaagtgctcccaaatccaaaactttgagcactgacatgatactcagaagaaatgctcatttgagcattttagattttggattttcagattagggatgccagtctggcacctctccttgggatgttgtgagggaccttgtttgtcatgctctctgaaaattttcataagcaaatgaatggcttttaaaataatttatgagccagttgctaactggcaaatattccaaaatctgaaaacaaacaaaacaaatctgaaacacttctggtccgaagcttttccgacaaggaataatcaacctgtatttaaatgtgtattagttaaaagtacttataatgcatgatgttactccactcttcatctgacctgttacctttaaatgaaggaaagcctctctttgttttctattacttcagtcctgtatttcaggatacctgtgtgcctccctcagagaccgtggtgcagtgatttcatgtttttcatatatcaattttttttgggggggggaagatgagaaaaatgtacccaaatctagaagattcataggaaggtaaaggaaaaaaaaagataattggggagtggttttttttttaagacagtttttaaaagggctaactagaatagctatcaaatataaaatgaaaaatgtaaatggatgtgaaaaccagtgctgggaatgtttatttttggaataccatatagtacaattgcaagcgtgccatggatggcactgccagccagtgcagctctatttgatggccttggtttgtgtactttgaaggcatgattagaatgcatacaactgggaaaaggcgggagagggaaagaaaagagaaagaaaaacattaaaaaaaaaagcatgtatacaactggatctattgggagtatttgggcagaatgtgaaggaaaaaatcagtatctaagtgttagaaatagtgggaaaatgtttcaaaggatgtaagcagatttcttggagtttgtccttagcttagctagggatcctgtaaacctatacccattgctcaggtgatagtcttattttcaccactggggaacacatgttctattgagggtagtggtatcatctttgaaacaaaaactgcagtgttttggatattctaaactgtaagatgacaactctgcagtaggaagctatttctgttttacttgataaggtgttggacactgtagtgtctagtactggacttgtatttgatcaggacagatgtgtcattattatgtgagagtgtgcatttacaagggaaatgattatttcggcccataaattattttaaaagctatttattcgcttatgaacatttttagaggggataacatggtccctcacaacatcccgaggagacaaaaacatagcagatttaataatctaatttagcaagataaaagtgtggatttttgtgaaaggtacacattttctttaacaagtaaaagtttcagatcattattgatatttacttattttaaagtaaaggcattacacactcaacatttggcctgatctgatttttaaacttcatccctaggattgatattgctgatgatattattaatgccagtgaaagtaacagagactgttcaaaacctgtggctagcactaatttagacaatgaagctatgcagcaagattgtgtatttgagaatgaagaaaatacccaggtaaggaatgtcaaaaatatgtgttagatgtacaactttgattgcttcatgtgtttctttgatgccagaagttatagttcagtattttgctgatacacttaattgtctcaattataaatccccaagaatatacattgtttcagagtttaggaaacatcactgggtagagaagtataaaacaacttattggctgggtgtggtggctcacgcctgtaatcccagcactttgggaggccaaggcgggcagatcatgaggtcaggagatcgagaccatcctggctaacatggtgaacccccatctctactaaaaatacaaaaaaattagccgggcgtggtggtgggcgcctgtaatcccagctaccggggaggctgaggcaggagaaaggcatgaacccaggaggcagagcttgcagtgagccaagattgcgccattgcactccagcctgggcgacagagtgagactccatctcaaaaaaaagaaaaaaaaaaacaacttattttaaattattttcctagaaatcatgatgtcagcagaggtagctaggtggtattatggttgacttttgttatttttaagacagcttccgtatttcttaggagttttgctgaagaacatggtataggggagaacatataatattctcatacacttcttaggatgggatagatccctgtaacagaatattggttaacaagagaaaaacaagttttaagacatgtatacctcatatatacatgggagatactcgggggaagtgagtaaatctctcagaggtggcttaaataccatcatgtcctgaaacaaaggaaaaaagggtgttggggagacctagttgtaatgagatgaccaggaaaagcactgtaagcaaagttaaggttagctctcaagattggtagtttttagtgatttagagtcatctttctcttgctcgtacagagaggagacacccgtagaaatggagatttctactacagatgaaaatttcttttataaaagggtaacttctctgtattatcctgtgtttgctatttctgaaaataataagctgaaaataatccttatgccaaagaggaataatttggtgtggcatgttctgaacctccactgttggcatcctttcttgattagcagaaacctaggaacattgttgtaataatgactaaattattgtcactgtcacatttgttagtaactttttttaatataattgccattaaatgtaaaaagcagcatctaagacattcaaaatgtaattttgatactacttttaaaaataagatgctaaattaatagataaggtgggtttcctcagtatattttcattctaaaccatccactaaagtagggctaaagaggaatttagagtaggaagacttaggttttgtattctgcctttgttcagtatcagtgtgactttggccaagttacctgacttctgaactgcattttgcttttctctaaataagtgggggtaatacctatattagaggattatgataaaaagatgtgaacatattataaaattattttataaactagaagacatttcaaagaagttaagctgccactgttagtttcacagacttgggtgtattagatgaacagcttttcagttattgcttctatagttgtcctcttgccctttcctggattatcagtttctgcctgtctacctagtcattcccatcagtgtaaaacatttatactgttatttcttccaagttcagaaaaaaccctctctcgactccccccatcccattctagcacatacaccctgatttctctgcttccctttataaatagaattgctggaagaattgtctgtgtctcttttctttaactcttctcctcccattctctcttaaattcactgcagtgatcctttcctccgaccattcattcctctgaaatagcttttgcaagtcaccagtgatgtctgttgaatgttttacttgacctaacagcaaggtttgattcaattaattactcccactaccttgatatacttttttcacttggcattcaggatatctcactcggtttttttttttttttttttttttttttttttttttttttacctacactggctgttctttctcattcccctctgctgattgctcttcctcttctgaatctcttaaatttggaatggcccagggcccatttctcagattgcttatttttattcacttccttggtaatcttgtttagtctaatggctctacctaccatctatgtgctactgattcccaaatttgtatctcgagtccagacctgttttggaactttagattgctatatccaactaggcacccagcatttccactggtatatttttaccaagcatctgttgagtaggaaagatttctttccttacccatcattaggttcatagctgaggcatctgtaacagaagacattaacaagagaaaagcatgcacatttatttaatgtaagttttacatgacatgaacaccttcagaaatcaagacccacagaaacagacacacctgtgtattttaatgctttggtttgatgaaaagtggacagtggtgcggatgaataattagacaaagaggatgataaataaagggcggctcattaaccaaggcctgtttgttcagattcttttctatgtccctgtgtattcagagataagggcattcctttcatccaggtatagggtagatacttctggaatgaaggttgttgttgttgttgttgttgtttttgagatggagtttcgctcttcttgcccaggctggagcagtggcacaatctcagctcaccacaacctctgcctcccgagtagctgagattacaggtgcctgccaccatgcccggctaattttttgtatttttagttgagacagagtttcactatgttggccagactggtctcgagctcctgacctcaggtgatctgcctgccgtggcctcccaaagtgctgggattataggcctgagccaccacgcccagccaaaggttttatgacttacttcagaagataagtctgaccactttttactgtttctactgccatcctctcacctggattaatattgcctcctaattaatctcctcatctttgtttcttgatggtatgttctcaacactgagccagaatgatccttttaagaggaaaattagataatgccacttctcttcctaaaaccttccagtgccttctagctatcaaaatatagctataggcactacggaatattggctgtgatagtcaggattgagacagctaaatcataagtcctatctggattgcttatttgtggatatctccttagcttacattcttacctagtcttgcagatacttcctcagttttaccaaatctcctcatcactgtctgtttatggcaggccctcccacttacccacccactccagtctctgaactttttgtcctttttccctgcttcgcattccgccgcactttttttttttttcctgagatggagtctgtctctgttgcccaggctggagtgcagtggcacagtctcggcacagtacagcctctgccccccaggttcaagccattctcctgcctcagcctcccaggtagctgggattacaggcatgtgccaccacgcccggctaatttttgtatttttagtagagacggggtttcacagtgttggccaggctggtctcaaactcctgacctcaagtgatctgtgtgcctcagcttcccaaagtgctgggattacaggcgtgagccactgcacctggccccctccccactttagatagtgttataattattttatatatcttttaatttttatttttagagacaaggtctcactctttcccaggctggagtgcagtggtatgatcatactcactgtaacctcaaactcctggcctcaagcgattttcctacctcagtctcctaaagtgttgggattacaagcatcaggcaccatgcccagccatttcttttatattactagtctgtttattgtctgtctcccactattagattaaaacttcatggggctactcacagtggctcatgcctgtaatcctagcactttgggaggtcatggtgagagcgtcatttgagcctgggagtttgaaacctgcctgtgcaatgtaaggaggagaacccatctgtacaaaaatggtaaaaaaaaaaaaaaaaaaaaaaaaaaaaatagccaggtgtagtggtgctcccctgtggtcccagctacttgggaggctgaggtgggaagatcacctgagcccaggaggtaaggctgcagtgcgtggtgatcacaccactgcagttcagcctgggcgacacggtgagaccctgtctttgaagaaaaaaaaaaaactttatgagggctgaaatttttgtctgttttgttctttattacatccctattatctagaacacttagtaggtattcattaagcatttgttgatgtaagaccagaatagcatctggcacatagtaagctagtaaacaactcggtaaataatttgttgaatgaaattggtgtattaggctgggcgcagtggcttacgcctgtaatcctagcactttgggaggctgaggcaggtggatcgcttgagcccaggagttcaaggccagcctgggcaacatggtgaaaccccgtctctacaaaaataaaaattagccaggctaggtggcgtacgcctgtagtcccagctacttgggaggcttaggtgggaggattgcttgagcctgggaggtggaggttgcagtgagctgagatcgtgccactgcactgcagcctgggtgacagagtgagaccctgtctcaaaaaaaaaaaaaaaaaaaagaaattagtgtatcaattactttataaagagagcaggaactaattctttctaaaattgtttttaggaaacctttatgaatgatgggttcttggccttgaaaaacctgtcaccatttcttccccccaaccccagctaagaagttcagtgatactcttattatttgaataagttagttcagttgggcaatacacaataatacctgtttacttggacagtataagcaaaaatacctgatttaagttttctttcttttttttttttttcttgagacggagtttcattcttgtcgccccggctagagtgcagtcgtgtgatgtgggctcagtgcaacctccgtctcctaggttcaagtgattctcctgcctcagcctcttgtgtacctgggattacaggcatgtgccaccacgcccggctaattttttttttttttttttttttttagtagagacaggatttctccttattgatcaggctagtctcaaactcctgacctcaggtgatcctcgcgccttggcctcccaaagtgctgggattataggcgtgagccaccgtgcctggtcgatttaagttttcaatgacttgataatctaggttgtacatgcacatactttctaatacagaatatgactagtgctattagggcactatagtcttgcagaagagaggaaagaacttctggccagggtagttatggaaggtcttggaatgagggggattttgaacttggctttttatagggctggatttggttcaagatttgtgaaagaaactaaaatgaatagtataagtaaagattacagggtaatgttgaatgttaatgaaacagagctacttgtagaactcagggtattgtgggaggatatatagtagaagataattctggaatattggtagatttgggtcatacgtagagcctggaatactatcttaagaattgtagattttctcagtagaagaaaaatatagaaaactttgaagcagagggaatgatgtacccagatctgtattttaggaagaaggttttttgtagtagtcataaaaagtttgtgggaaagactgggggtaaggacaacaacaatcagtaggctttttgcactgtatttggcgagcacttaaaatatctgagctggtgggcatggtggctcatgcctgtaatccttgcactttgggaggccaaggtgggcagatcacctgaggtcaggagttcgagaccagcctggccaacatggtgaaaacgcatctctactaaaaatacaaaaattagcggggcatgatggcacatgcttgtaatcccagctactcgggaggctgaggctggagaatctcttgaacccaggaggaggaggttgcagtgagctgagattatgccactgcactccagcctgggtgaaagagtaagaccctgtctcaaaaaaaaaaaaaaaaagtctgaactgtgagccctagggaaggaaggaaaaatagagaaaattccaaaggtgaaaatgattaagatttaggtgcaaactggggtaagaaacacagacactaagagattggaaaagaggtcagtgttgcagaactggaatatcaaggtggtttatatgaagcagatgttcaggtcttgagctgtggctggtggtggaggctcattttgtctgtgagtgaatgccattgccaaagcagtgacttgaatagaataaacggggattgaagaaacccttggggaacctctgtattctagctctttggaggaaaaaaagcagccatgaccatagcagttgggaatgtcaaagaggatgggattttttcctgagtctgaaagttggtcaaaatagagaggtaaaaggaggaaaaaaggtggtgggaggcaaaggtacaaaaataagaagagtaagtttaattttatttgcttgctagggtggttaaaagtctaatgaaatggctttttttttttctttgcctttgctgttgaacaaaaaatttaagaatacccaggaacaatatatttaatgctggtgagggtaggttaaggtaagtggtcttatacagacatcggaagtataaattgctgtaaacttcctggaaaacacattaacagtaagaacaaaagaccttaaacctttgatccagaaatttcaaaatctaggactctttcctaaggaaatacatacaaatcagaggtgtatgcaaagatttttctactagaattcttactgggggtttcttcatcggaaaaaaaaatgggaaacacaaaaagtcctaaatggaaaatgattagataaatcatagtatatccatatcataggatatagttgagtcatttaaaattattttaaaggcccaagtaatagttgtgaggtaaagttattttgaaaaaaaaacaaaaaacaaaaaacaaaacatacaaaaccaagtgtagattactaaagctaatgcagtcccaatttctttgtgtgcatgcactgcatgtgtgtgtggcacatagtcaaaaggccaagtcagaatattcacagtggccttctgtctgatagattgtggatgattttacttttcttcatatgtccttatatttatgtttccaacagtttctctgatttataatcaaataattaaagaaaatttattggatttagtgatagaaattattggtaaagaaagaggagctttggtaggtagaggatttcatggttgagaatgaatatcaggtgagtaggtagaagctgcagtgtgtggaatgccttttgcacaagttttgcattgaaattaaaaggaaagagaaggccaggcatggtggttcatgcctgtaatcccagctgtaatcccagcactttgagatatcagggaacctgctcccgatagtcatgtaggttcttttctattttccctaagcattggctgggttgagaaataaagggacagagtacaaaagagagaaattttaaagctgggcatccgggggagacatcacatgttcgtaggttctgtgatgccccccaagctgtaaaaccagcaagtttttattagggattttcaaaaggagagggagtgtatgaatagggtgtgggtcacagagatcacatgcttcacaaggtaatagaatatcacaaggcaaatggaggcagggcgagatcacaggaccacaggactggggtgaaattaaaattgctgatgaagtttcaggcacacgttgtcattgataacatcttatcaggagacagggtttgagagcaaccggtctgaccaaaatttattaggcgggaatttcctcgtcctaataagcctgggagcgctatgggagactggggcttatttcatccctacagtcttgaccatagaagatggccacacccaaggaggccatttcagagacctaccctcaggggtgcattctctttctcaggggtattccttgctgagaaaaagaattcagcgatatttctcccatttgcttttgaaagaagagaaatatggcactgttccacctggctcaccggcagtcagagtttaaggttatctctcttgttccctgaacattgctgttatcctgttcttttttcaaggtgcccagatttcatattgttcaaacacacttgctctacaatttgtgcagttaatacaatcatcacagggtcctgaggcgaaatacatcctcctcagtttacaaaaatgatgggattaagagattaaagtaaagacaggcataggaaatcacaagggtattgattggggaggtgataagcgtccatgaaatcttcacaatttatgttcaaagatagcagtaaagacaggcataagaaattataaaagtattaatttggggaactaataaatgtccatgaaatcttcacaatccacgttcttctgccatggcttcagctggtccctccattcggggtccctgacttcctgcaacaacagtggccttctggctgataggttatggatgattttacttttcttcatatgttcttatatttaggtttccaacagtttctctgatttataatcaaataatttaagcaaaaaattccaattaaagaaaatttattgcatttagtgatagaaattattggtaaagaaagaggagctttggtaggtagaggatttcatggttgagaatgaatatcaggtgagtaggtagaagctgcagtgtgtggaatgccttttgcacaagttttgcattgaaattaaaaggaaagagaaggccaggcatggtggttcacgcctgtaatcccagcactttgggaggccgaggtgggtggatcacgaagtcaggagatggagaccatcctggctaacatggtgaaaccccatctctacaaaaatacgaaaaattagccaggcgtggtggcaggcgcctgtagtcccagctacttgggaggctgaggcagaatggcatgaacccgggaggcggagatcgcgccactgcactccagcctgggcaacagagcaagactgtctcaaaaaaaaaaaaaaaggaagagttgagcagtctggttgtggaagagatattccccccttccccactcccgtcccccatttctgctttcttgatacaggatggagatttgagcatgtcagtaggaatcactcactagatagggagagactaaaaaatgtcagaaagaaaaaaaaaaacccagggtagttaggggaacactgcatagagggggttgggagtgagagatggaagaaaggtgattcagtgtgcaagttgagtgactattcctaaataggagaggctacttttaatcttcagtaaaaggggatatatagaatatttttttaagcgagaggtgttttggggacttaattcagatggctttgaccattttaaaatgaaatgcatttgcagagggtgaggagacaggaattgggtttggatctgaagaaataggtagttttgcaggagtctctgtggggagaaatcagacagaactgagtcaccagatgtttgagaaccaatggaggtctaactgaagtttgatgacatgaatttgtagtgagccaactaggaaggtacgttaagtgacacattttattgtagcatctgtctgtctggaggacagaaagctggtcataaactagaccacattggttagggcattgactaaatagctttgaaatagttagccagggtacagagtgcgtgttgggtggattagaaatttagaatgaagttttcaagcggtgacagtaaggtgaagaagttgcagaagaggggaatattagttggacaggatgtatgagtttcaagtgtattatggcatggcgtgattcaagtggctttcgtagaaagtaacttgtgtctaggaaagtgtaaggctagatagagcaggagtcagcaaactttgtgtaaaggtctacacagtaaatattttaggcattgtgggtatatagtctctgccacaactacttaactctgctattgtagcatggacgcagccagaaaaaaccgtaagaaatgagcatggctgtgttccaataaaatttaatttatggacactaaaattgaattttgtgtcattttcacttcacagaatatcattattcttttgattctcccttctacccacaatcattaaaaacgtagaaacccttcttagccaagtgaccatgcaaaaactggcaacaggttggatttgtctagtatgctgtagtttgccaacacctgggctagaatattgtaaggagatcaacattttagacataaaagataatgttggagatttgttttctctgaaattgacttgcagtgtaaggaaaacaaattgcttgctttttttttttttttggagaaatgctgtatggttgcacttctttttttttcttttttttatttattattattatactttaagttttagggtacatgtgcacaatgtgcaggttagttacatatgtatacatgtgccatgctggtgcgctgcacccactaactcgtcatctagcattaggtatatctcccaatgctatccctcccccctccccccaccccacaacagtctccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctgcaaaggacatgaactcatcattttttatggcgcatagtatagtattccatggtgtatatgtgccacattttcttaatccagtctatcattgttggacatttgggttggttccaagtctttgctattgtgaataatgctgcaataaacatacgtgtgcatgtgtctttatagcagcatgatttatagtcctttgggtataaacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgaaatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgtgaaaattttctcccattctgtaggttgcctgttcactctgatggtagtttcttttgctgtgcagaagctctttaatcagatcccatttgtcaattttggcttttgttgccgttgcttttagtgttttagacatgaagtccttgcccatgcctatgtcctgaatggtaatgcctaggttttcttctggggtttttatggttttaggtctaacgtttaagtctttaatccatcttgaattgatttttgtataaggtgtaaggaagggatccagtttcagctttctacatatggctagcctgttttcccagcaccatttattaaatagggaatcctttccccattgcttgtttttgtcaggtttgtcaaagatcagatagttgtagatatgcagcattatttctgagggctatgttctgttccattgatctatatctctgttttggtaccagtaccatgctgttttgattactgtagccttatagtatagtttgaagtcaggtagtgtgatgcctccagctttgttcttttggctcaggattgacttggcgatgtgggctgttttttggttccatatggacttaaaagtagttttttccaattctgtgaagaaagtcattggtagcttgatggggatggcattgaatctataaattaccttgggcagtatggccattttcatgatatcgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctgtttgtctgttgttggtgtataagaaagcttgtgatttttgtacattgattttgtatcctgagactttgctgaagttgcttatcagcttaaggagattttgggctgagacaatggggttttctagatatacaatcatgtcgtctgcaaaccgggacaatttgacttcctcttttcctaattgaataccttttatttccttctcctgcctaattgccctggccagaacttccaacactatgttgaataggagtggtgagagagggcatccctgtcttgtgccatttttcaaagggaatgcttccagtttttgcccattcagtatgatattggctgtgggtttgtcatagatagctcttattattttgagatacgtcccatcaatacctaatttattgagagtttttagcatgaaggttgttgaattttgtcaaaggccttttctgcatctattgagataatcgtggtttttgtctttggttctgtttatatgctggattacatttattgatttgtgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctgttgattggaatagtttcagaaggaatggtaccagttcctccttgtacctctggtagaattcggctgtgaatccatctggtcctggactctttttggttggtaagctattgattattgccacaatttcagctcctgttcttggtctattcagagattcaacttcttcctggtttagtcttgggagagtgtatgtgttgaagaatttatccatttcttctagattttctagtttatttgcatacaggtgtttgtagtattctctgatggtagtttgtatttctgtgggattggtggtgatatcccctttatcattttttattgcgtctatttgattcttctctctttttttctttattagtcttgctagcggtctatcaattttgttgatcctttcaaaaaaccagctcctggattcgttaattttttgaagggttttttgtatctctatttccttcagttctactctgattttagttatttcttgccttctgctagcttttgaatgtgtttgctcttgcttttctagttcttttaattgtgatgttagggtgtcaattttagatctttcctgctttctcttgtggacatttagtgctataaatttccctctacacactgctttgaatgtgtcccagagattctggtatgttgtgtctttgttctcgttggtttcaaagaacatctttatttctgccttcattttgttatgtacccagtagtcattcaggagcaggttgttcagttgccatgtagttgagcagttttgagtgagattcttaatcctgagttctagtttgattgcactgtggtctgagagatagtttgttataatttctgttcttttacatttgctgaggagagctttacttccaactatgtggtcaattttggaataggtctggtgtggtgctgaaaaaaatgtatattctgttgatttggggtggagagttctgtagatgtctataaggtccgcttggtgcagagctgagttcaattcctgggtatccttgttaactttctgtctcgttgatctgtctaatgttgacagtggggtgttaaagtctcccattattaatgtgtggaagtctaagtctctttgtaggtcactcaggacttgctttatgaatctgggtgctcctgtattgggtgcatatatatttaggatagttagctcttcttgttgaattgatccctttaccattaagtaatggccttctttgtctcttttgatctttgttggtttaaagtctgttttatcagagactaggattgcaacccctgcctttttttgttttccatttgcttggtagatcttcctccatccttttattttgagcctgtgtgtgtctttgcccgtgagatgggtttcctgaatacagcacactgatgggtcttgaccctttgtccaatttgccagtctgtgccctttaattggagcatttagcccatttacatttaaagttaatattgttatgtgtgaatttgatcctgtcattatgatgttagctcattattttgcttgttaattgacacagtttcttcctagtctcgatggtctttacattttggcatgattttgcagtggctggtaccggttgttcctttccatgtttagcgcttccttcaggagctcttttagggcaggcctggtggtgacagaatctctcagcatttgcttgtctgtaaagtattttatttctccttcacttatgaagcttagtttggctggatatgaaattctgggttgaaaattcttttgtttaagaatgttgaatattggcccccactctcttctgccttgtagagtttctgctgagagatccgctgttagtctgatgggcttccctttgagggtaacccgacctttctctctggctgcccttaacattttttccttcgtttcaactttggtgaatctgacaattatgtgtcttggtgttgctcttctcgaggagtatctttgtggcgttctctgtatttcctgaatctgaacgttggcctgccttgctagattggggaagttctcctggataatatcctgcagaatgttttccaacttggttccattctccccgtcacttgcaggtacaccaatcagacgtagatttggtcttttcacatagtcccatatttcttggaggctttgctcatttctttttattcttttttctctaaacttcccttctcgcttcatttcattcatttgatcttccatcactgataccccttcttccagttgattgcatcggctcctgaggcttctgcattcttcacgtagttctcgagccttggttttcagctacatcagctcctttaagcacttctctgtattggttattctagttatacattcttctaaatttttttcaaagttttcaacttctttgcctttggtttgaatgtcctcccgtagcttggagtagtttgatcgtctgaagccttcttctctcaggtcgtcaaagtcattctccgtccagctttgttccgttgctggtgaggaactgcgttcctttggaggaggagaggtgctctgctttttagagtttccagtttttctgctctgttttttccccatctttgtggttttatctacctttggcctttgatgatggtgatgtacagatgggtttttggtgtggatgtcctttctgtttgttagttttccttctaacagacaggaccctcagctgcaggtctgttggagcacccggccgtgtgaggtgtcagtctgcccctgctgggggtgcctcccagttaggctgcttgggggtcaagggtcagggacccacttgaggaggcagtctgcccgttctcagatctccagctgcgtgctgggagaaccactgctctcttcaatgctgtcagacagggacatttaagtctgcagaggttactgctgtctttttgtttgtctgtgccctgccccccagaggtggagcctacagaggcaggcaggcctccttgagctgtggtgggctccacccagttagagcttcccggctgctttgtttacctaagcaagcctgggcaatggcgggcacccttcccccagcctcgctgccgccttgcagtttgatctcagactgctgtggtagcaatcagcgagactctgtgggtgtaggaccctccaagccaggtgcgggatataatgtcctggtgtgccgttttttaagcccgtcggaaaagcgtagtattcaggtgggagtgacccaattttctaggtgccgtctgtcaccactttctttgactaggaaagggaactccctgaccccttgcgcttcccgagtgaggcaatgcctcgccctgctttggctcgcgcacgatgcacgcacccactgacctgcgcccactgtctggcactccctagtgagatgaacccggtacctcagatggaaatgcagaaatcacccgtcttttgcgtcgctcacgctgggagctgtagaccagagccgttcctattcggccatcttggctcctccccccacaaattgctttttaatgtttcaaagctgatcacataaacagctttatgtgatctacataaactgtagtactaggtgctacataaaccacagtcctataatgtattggttagccaggctgaaattaatcttaagaattttttttttttttttttttgagacagagtctcagtcttgcccaggctagagtgcagtggcatgatctcggtttgctgcagcctctacctcccagattcaagtgagtctcatgcctcagcctcccaagtagccgggattaaaagtgtgtgccaccacacctagctaatttttgtactttttttttttagtggaaacttacattgtgactttcttttacattgactttttttttttttttgagacagtcttgctctgtcgcccagattggagtgcaatggcgtgatctcagctcactgcaacctctgcctcccgggttcaagcgattctcctgcctcagcctcccgagtagctgggattataggcacacgccactacgcctggctaatttttgtatttttagtagagacggggtttcaccatgttgatcaggttggtctcgaactcctgacttcgtgatccgccctcctcagcctccaaaagtgctgggattacaggtgtgagccaccgcgcctggcctacattgacatttttatagaaatgttaagtctttttattctattttttgagacagggtcttgctttagtcacccaggctgcagtgcagtggcatgatcacagctcactgcaatctcagcctcccaggctcaagcaatcctcccacctcaccttaccaagcagctgtgactacaggggcatgccatcacacctggctaatttttaatttttttacagagaaggagtctcactttgttgcctgggctggtcttgaactcctggcttcaagcaattctcccacctcagcctctgaaaatactggaattacagatgtgagccaccatgatgggtctcgtcttttctgtttccagttgtccacatccacatttttctgttgggttgatggtatttttcctttttggtttgtacattttttttttgagacagagtctcggtttgtctcccaggttgaagtgcagtggtgcgatctcagcccactgcaacctccgcctcctgggttcaagcagttctctgcctcagcctcccgagtagctaggattgcaggcacctgccaccacgcccagctaacttttgtatttttactagagaccgggtttcaccatcttggccaggctggtcttgaactcctgaccttgtgatccacccacctcggcctctcaaagggctgggattacaggcataagccaccgtgcctggccatattttttatttattaaggaactacctactttcttaacgatcagtcgcaaatatttgtttccagttttttgtcttttgactacttaaagtcatttttgatggtgttaaactttatcgtctttttttttttcccttttttaagattttaggttttaatagttgggaaggccttccctattctgagattataagctaactttcttcttttaaaaaaatacttctatggtttcattttctacatttgaatatttgacccatttggaatttatcatggtgtaagatgtgaagagcagattcagctgtttgtcctacatgtttacctagatatcccaacaccgtaattttttgtataatatatccttttcccaccaatatgaaatgccacctttattataaactaaatgcctggatacatttgtaataaaagtggtgtttcaaatcagttgagtgtgtttctcattcattcaccagcaatgagtgacagtgccacattcttgccagtatttggtagtgttagtgttttggattttggccattctgatagatgtgtaatggtatcttgtttaaattttgagtttcctaatgacatacgatgataagtttttcatatgctatgtgtatatcttctttaatgaggtgtttattcaggtcttttgcccgtttttaaattggattgttttcttattgttgagttttaagagtttctctctctctttccctctctctctctctctctctctctctctctctctctatatatatatatatatatatatatatataaaatctatttctttcttttttttttttgagacggagtctctgtcacccaggctggagtgcagtggtgcaatctcggctcactgcaacctccgcctcctgggttcaagtgattctcctgcctcagcctcccatgtagctgggattacaggcgtgtaccaccacgcccagctaatttttgtatttttagtagagacgaggtttcgccatattggccaggctggtcttgaacgcctgacctcaggtgatccgcccacctcagcctcccaaagtgctgggattacaggcatgagccaccacacccggcctatattttggataagcttatctagtaggtttttgcaaaatagaattttttttttaatgtgctactagattctgtagtaaatatttaggagttttatctgatacaaagagattattcactatagattttgaataggtataagttgtacagtaatcaatattttgggagttgaaagtgtatgaaggtgaaaaaaaaaagtgtatgaagttgaatagcctgattagaactcacatcaaaatacctggatttatcatcagtaaaatccattcatttcagggtaccttcattgatggtgccccttcaaaacttagaattattcataccttgcaaacactgagaaactgttttatctcctttcagaagtggaggccagaagtatttataaactctagtagatagtcaagaggaagagaaggctataaatttgacgtgtactagtcttaagacctcatcagttttgatcatattaattcagtagaagagagagagtaggctagatagaagtatatcaatatgcaatttattgagtgtttgttcagcaaatgcaaggtacagaatggagtggagatatgtagcctatttaatagaagtaactagcatgcttgagccaaaggtaaatgagagaaatgggaagatgcagaactaagcaaggtgggtgcaccaattatggacccctaaggaagggatggagaccagaggaattaccggaaatgcctgtcaggttttaattaactcttggcagtaatctccgatagctcctaagatattgctaatatgactgtgctgtatctgctgctcctcctgctgctgccactgccaccgccactgccaaagctctctaacttacctgaattgagaccagagcaccttagctttcctttgcagaccttaatgtttgtggaagggcacatgggaggaagtggggagaaggtatgggttattttgcctgctgatattttattttatttatatattttatatttttttgaaacagaggctcgctctgtcacccaggctggagtgcagtggcacagtctccactcaccgcaatctgctcctccccactgggttcaagtgattcttgtgcctcagcctcctgagtagctgggattacaggcgcacactactgcacctggctgatttttgtatttttagtagacgggatttcaccatgttggccaggctggtcttgaactcctgacctcaagtgatccatccgccttggcctcccaaagtgttgggattacaagtgtgagcctctgtgcctggccaatatagatggtttttcttataagctatttcttttgattctctgtggtaactctgaggtagtcaagtaaattattgttattctcatatttgtgatgagaaaggcagagctagggcttgaatttggttcttttgagtgagataccaaggttctgtttgtttgtttgtgacggagtcttgtactgtcacccagactggagtgcagtggtgcaatcttggctcactgcagcctttgcttcctgggttcaagcaattctcctgtctcagtctcccgagtagctgggactacaggtgtgtgctaccacgcccggctaatttttgtatttttagtggagatggggtttcgccatgttggccaggctggtctcaaactcctgatctcaagtgatttgctcgcctcagcctcccaaagtgctgggattacaggtgtgagccactgtgcctggccccaaggttcattttaaatattgggtctggttgtgcacagtggctcatgcctgtaatcccaggactttgggaggctgaagacagatggatcacttgaggtcaggagttcaagaccagcctggccaacatgccgaaacccatctctactaaaattacaaaaaaattaccctattcaacatgctgaaaccccatctctgctaaaaatacaaaacaattagccaggtgtcctggcaccacacctgtagtcccagctactcgggaggctgaggcaggagaatcgcttgaacccaggagatggagtttgcagtgaacctgcatgagcctcactctggcctggatgacagagtgagactgtctcaaaaaatttttttaagtaaataaataaaaattaaatatttggtctgggtaatggttatttcatgtgcccagaaaccttcagaatgtaaagctatcttctagagcagagatccccaacatttttggaaccagggactggttttgtggacaacagtttttccatggatggtggatagggggttggggttttgggatgaaactgttctacctcacatcatcaaagcattagttagattctcataaggaacacaacctagatcccttgtttgcacagctcacaatagggtccatgcctctgagaatctaatgccagcactcatatgactggaggcgcggagctcatgccatagtgctcactccccactcccccagctgctcacctcctgctgtgtggcctggttcttaacaggctagcgatcggtaccggtccaggggttggggacacctgttattgatcataaaagttaccgaagtctgatttctgtatcagtggttctcacactttgggtctcagggactcattcatactcttaaaaatattgaagatcccaaagagcttttgtttacataggtatatctgttaggatttaccatattaggaattaaaactggtaaatttaaaaaacattaatttaacaaactcatttatggtaacataagtaaggttgctcttttccacaatagataactgttttcataaaattttttaagtttgaggagtggcattgttttacatagctagaaatattgttgatacctgtttgacttacagaagacagctggattcttgtatatgcttctgcatttaagtctgttgctgttacattgttttgttgaagcatatgagacagcctcacagatgtgtagtttgaaaagggactagtattttaacagctttttttgcagattcttgtggaccttctttcacgctaaacaaagctggacaagtggtacttactttctaaagaagaatcagagagtctaggaagtatggaaccttttgttgatttgaaaggtgatcatcaaaaacaccacaacgttcatgtattttgtagtaattctctgggtatttgtattagacttggtaggtttttagtttgggggggaatagggatgagatggtgtcactaagctcgttggaaaatgggagagttttctcatgtggggactttctttgtggaaaatagttattacttcaaatatacaaaggaatctagtgaactcctctatgactcctatcttacctacaagaagtcaccaaacttgtatctttgtagctgaggagaaataaagcaagcagcagttggcaagcaggatcagaagaccatcattttggaggagataattctaaggaagaaggatggtagtggtgatacatattacctaatagagagaaatgcagagtacctgctatacttcatatgacccaggttttgagggaagataaattactctctgtaaaaagagatgctaagtactacagactattataaatgatagctaattaggggtgtttgactaatctgtattctaatatcctaatttagattggcaacttctcttatctgagtattgggagctccattaatacatggtagtgttctttttgtcagtctgtaggtatattgttagagccatgcagtgaccgtggtgatagtgaagatggctgtcttgagaggtaagcattttttcttgttgctaattaatcattttgagaattggagctcttcacagatttttgaggtgatttttttagatgaatgtccattataaatatatagtttagataatcttaaacagccttcttgttataatggtaggcataaaggatattaaatacccataaatgtttggatttgtacaggttcagacagtagttataacttggaaaacattcagagggaaaaacagcctttttggagacatttaaatctttcagttgattgtggaacaattgggaatttactgatattctgagtatacctgtcagtgagttaattcatgatcttgtaactgtgtataactaactgagagatactgtatttgattcaacaaatatgtataggatgtttttcttcctctttgaatttatccttggtgtgtctcagtacactcttaggcagctggtgcttttttaacctctttggctggctgtaatggtagagaaatactggaggcaatgagtatttcgactaatgtagagtctcaatagatagcctctttgaatagaagctttctagaatgttttaaatcacagagtaagatttgggttcttgttaccctttgcatcagtcttcaagatgctgccaaaaagtataactttcttaggaaggtgatttgagattctgaaaacacttcagtaatgaagttgcaggctagattgtaaatattgagagatcccagacagtatactaatttgctgacagcctgttggccaggacatatttgtattctattgtttcttttaattataagtaggaagcctgttctttaagggtaagcaaattctttggagccacgtctctggagcctccccatactctgaaggtccacagatttccttatagcagttccttgtccttcctttcaggaggcaggaatcatcctcttccagcccaggaagtattggagctatgggctgaagatataaaattaacaacattaacaggcacccccagaatagtgacatctggatttggtagaacaataaggacccatttagtgaggactcttctgttgttgttgttgttgttgttgttgttgttgtttttggaaaaagctctctcctcttcaacttcaactgtgtataagttagcaaactggtttttagatccagagtaccttggttaggtggattacattttgtatgtttaacattcatgcttctcaaatgtaggtgattaggtcttttaggctgctaaggtagtaattactcatcctaccatttgctcctactctaagcaaaggaatgcctttaagcttaacagagcatttagttcatttcttattctcagcaagaataaggtaattatctgtatgagaagatgacttgcaatatttagatcaaggcatgtctcctgagtgcatactctgttatggccggttagaagtgacatctcgatgtgtcattgtaaattgccactgtgtctttggggaaaagaactttcccccagtaggcatattgataatctactgtataatagcaggtgctctcttgactggtaaaataggtacagatcacttacgacagcttgctataacacttgttctaaataagggttagtttttctggggaagtaaaaggtggactgaaattttttaaaatttccttttagtatgttactgttatattttgaggagggaaaggtttggaagtagtaaccttctctgattggaagtagtatccttgtgatagaatacagtcaagtttaaagtaaaagacatagtgatacctttttaaaaagttttctttgaaagtctcaagaatggagagaatagagctgtttatttggttaaaacatttattttataaaatctttattatacattcattcttttgggtttctacttactgtggattttagttttcattttataaaggtttttcttttttgctgtggtttgtggggtggagtagggattgttacttgatttttctaaacccgaagtgattctgtggatcttttcagtattgtgtgatttttcagatatagggctccaaagaatgggcatgtgtccagttggcattttctcctcgcacattgtaaatgctaactgtgttatggagtagaggaatctaggtaagaaatatataatgatagtagcctttttattcttaatatactaacaactttacttgtatttttagggaagaatatttgttatttgacagtgataaattgtcacacttgattctggtaagaactatttttttgtcttagtctttaaaaacttgcctaggtttaaactgttatgtctggtctttaatgtgggttagctaggtttaaagatttaaatataaatactcttaccaaatattttacagttaaacagcaacttaatttgccacttttggttacaagagacttggttgtgaaaacactttcctgaatttgggatccaaacttgtcttccaataagacatattctaaaactgcatgtttatatttgaaaatagtttgcacagtgggagtgggacagttggctgtataggcacagtaaactaatgaagactacacttggatatgtgctggatgtgtttaagctgggtgtgaaaagcttccgtagttgtgaaatatattctttattttaaaatacaggattctagtagcaagatatgtgatttgaatgccaacactgaatcagaagtaccaggaggtcagagtgttggtgttcaaggggaagcagcgtgtgtcagtattccacatttagatctgaagaatgtttctgatggtgataaatgggaaggtaattttacccacacgcattattttcctgataatgttacttgtaaccgaaattaccctaagcaatgataagactacagcccttttctggataaccttattcatcttgatcttctgttctccctttcatgtaagatgaacaagtgggtgtttttagtgaaacacactgagattttggggcagcatctcatatgaactagaagttcttgtctgatccatcaacagctttgaaaatggatgttagaactgatttttttaaaaagtcacccagcatacgtttttgttaatatttaaatcaggtgctatctcctagtctttggaagcccagtatgttaaggcttagggatctcaccagtttaagcagagcgtgtataattaccttgtccttagtatcatcagtagtacttttttgaaaaatgaccttcaagggtacttctaaacaaatattgtaccatattcctgtatttctgtcttaggttatgaaggtatggtgcaggggactctaaaaatttgcacaaaggagagaagttaaaatttaacaagcaaacaacatgggtatatgcatttctcaaaactcagcaaatacatagatttttgtgtttctttgtatataaagttctctttttacttcaagaggataaaaaactgtaaacaaatgctgaacttcagtggatgatttgcatgctggagtgtttatggggaaatttactgatacctgcagtttactctgaaatccatgaaaaaaataagatggttaatgggatggataaatgttataaagcaagtatagtagaatgttaatggtagattgtgattggtatatggatattcagtgtaaagttctttcaattttgctatgtatttgtaaactttcaaataaaatgttgagtgggggtgggaatcaagcaataaatttggatctaggagtttttctggatcatacactttggtaaagagacaatgagataactcaagaatcttaaggatagttacatattcattcacttggatgaagatccctgggttgtctcacctttggcaagtatctgttgacatacactggcaataacaggaattctaatgccagtgccacggactccttttggcactgtttaagtgtactcacctgatcgcaaatggagtgtgtgtgggtcttgtttttttttttaaggtctaggcatttttttttaagagccccaaccaagtcattgtctgtgccaatttttattgccatctcctccccaccctcctttttatataggtctagatgtttggcatgcccagtggcatattatctgttttaacttagactaaattagaaagttgtctttaatttgctttgttctgggttattcaggacatctggaatttatgaagatgcttcccagtgttgggggatatgttagcatactggtggcagttgaagattaaatgttcttttttgttatttattgtggctgaaataaaaggaatggtggtcgacagagcatcccttgcagcattgctaggaaatgagtcttcaaaggaagcagcttggattctgataaagcacttttgtttcttcctattagaagatgcagataaatagttctttatgatctttggcctgggagtcctgattaaattttaaacatagaagaataattgtttttcattgtctgaagaggatagaccttctctgtctagcgtcagcgttcttgagtctccctgaaagagaacctgatactggactgtcttttttttccatgtcagaatccagcacctataccttggtatagataaaggaggtaacctgtaggctgctgatgcctgattttcagtgcctgagctgccctggttcaacagcctaaacaagtctatgtaggtcccctacttgttcttccagaaataggggtccgcaactttcagaaagccgacagttacagacacctgagcgaacttcccagccatgaactgtgcatgtgctttgtagagtggctgtttgtagaccatgttgtttcttctaactttgtcactaatgcaaacattgattggagttaggatattcctccaatttttttttttttttttttttttgagacggagttttgctcttgttgcccaggctggagtgcagtggggcgatctcagctcaccgcaacttccgcctcgcaggttcaagcaattctcctgcctcagcctcctgagtagctgggattacagacatgtgccactacacccggctaattttgtattttagtagagacggagtttctctgtgttggtcaggctggtctcaaactcccggcctcgggtgatccgcccgccttggcctcccaaagtgctgagattacaggtgtgagccaccgtgcccggccaggagttaggatattctaaatgaaaaagtcttatttatttaagagaccaacttactttagaccctggataccttggaatcagacatgctttgtttgatgtgactctttgtagagaagtgggatgactccaaatagagccctatgtcactattcctaagtacatagtttctgttttgttttttcctcaaaggataagaaaaatagcagaatgcagtagtagttagcaagcaggtagcacatgactgtcaccagtatgaatttgtagcagctgtttgcaaagttttgacttttaatggaagtggataccatcttcagattctctcctgctaactctggaatgaaatgcagtaggattttttcaaagagcaaactaagggagatattttcctttaaaatcatttacactgaaaagcttcaaacagtacctgcttaagaatttccatttcttcagttttatgtttgagttttaataaaatagcacgactttgagttttccccccccttttttgcattgcttgctgaaatggaaatgttatgtttgtgtttgttaaaatctagttagtagtgatttcttttaataacgtttttgaacagaatgcctaactggttttagggaaatgtttttggtatctttggctttgtgttatgtgtatggtttgttctgactgtgctgtgtgttcactttagtattttttgccattttttccattttattagcgtcatgccctatcacttttcccctcattgatttcaaaacaatgcatctgcagagagatggggagggtaagtatggttcaccatagtttagtttttttgccttttatggttcactttgtttgtctttttattaagcccttctcctgctgtccccatatcttaggaaaactgttctgggttcaaagtgaacccagaaaaaattgctattacttttgtcttttcttaaaataggatatttctcataaaatgtttactaccagttacttatttgctggggcacaggtacaagggttgctttgaaaatcactttattgttgggtttattgtgggattgcacgctttgtacccaatttttaattctcagattgatctgggcttcaaaaacaaactaaattatgttcttattattttgaaaggaaaggtaatgctttaaattgctaatgcataaagttaaactaaattactaaagcagcgatcttagctattgtgtgaggaaaaagaaaacatcactcttgaattttgacactgtcaagccctctttgcattcattttcgctattgctaatagccaatagcatcaaaatttttaagtgtagttacttaaaaaaaagctgccgggcgtggtggctcacgcttgtaatcctagcactttgggaggccgaggcaggcggatcacttgaggtcaggagttcgtaaccagcctggccaacatggtgaaaccccatctcaactaaaaatacaaatattagccaaacatggtagcaggcgcctgtaacaccagctccttgggaggctgaggcaggagaatcgcttgaacccaggaggcagaggttgcagtgagtcaagatcgtgccactgcactccagcctgggtgacagagcaagactccatctctaaaaaaataaataaataaataaaaagctaatgtgtagatgggaattttttctttccctcctgtgcttaatgttgtatttggggtatatttgtggattgtgtgtatgatctgtatgtgttctatatgtaatcaaacattatatttgcaaagacatcaaatgtattaacatagctttcatttgagggcatacaggataactgcagtaaagtaaatgtgcttaagaaggcctagtgctattaagttttgtcttagtaacactgttgggtattattaaaatatatattatacataggaatcctgtagcagaagataaccatcacagtttaatgttagaggccaggtgctgtcaggtgaattagctcctcctttgggaatattagaattcttctaaagtcagagaactccatttggtgagtgttccatgtaacatggggaacagctcccactttttcttaatatagctatttgacagtgagggacaggtcatacacctgacatcatttggcttttaaattaaatttctaagaaagaactgttcagttcttgctgtttctggttttcccctacttgaaaactaacatttgtaaataaaacatcttttgaaaagttcagaattatattaaataacatctttagaattaaattgagttttaaagagcttgacaatgtcctttcttgctttgccactgggttcagaaatttaaatttatatggaaatagaactctgggctgggcacagtggctcatgcctgtaatccctgcacactgagaggctgagatgggaggatcacttgagcctagcagttcaagaccagcctggccaacatagtgagacctcgtctctaccaacaacaaaaaaaagaaaattagtcaggcgtagtggcaagcgcctgtagtcccagctactcgggaggctaaggtgggaggattgcttgagcctagaaggtcgaggctgcagtgagccaccatcatgacactgaattccagagcctgggcagcagagcgagaccttatctcaaaaaaaaaaaattgaactctggactaaaaagtgaagcttgaataattttaaactatagtaggctttatgaagattatatatatatatatatacacacacacatgtatgtgtgtgtgtgtgtgtgtatgtgtgtatgtatatatgaaccactacataatgatatgatttaaggaacacatagctgatattttgtgacttttttcccacgtggaatcaagagacccatggtactattctttgtgtttgttttatagagccatttcctgcttttaagtcttggcaggaggactctgagtctggagaagctcagctgtctccacaagctggaagaatgaatcatcaccccttggaagaggactgtcctccagtattatcacaccgcagtttagattttggtcaaagccagcgtttcctacatgatccagaaaagttggattcctcatctaaagcactgtcttttactaggtatatgatttttatgtacttacaagaggcaattcctattatgtacccaagtcttttgagagatttagtcttccagcctgggcttcaatagtgaaactccatctcaaaaaaaaaaaaaaaaaaagagagagattgagtcttctagacatagaattcagagctttctcactgattttatagagcacatttttgtaagttttggttttttttgaccctgctgagttcagtgaggtgtagcgtttgaagtttgctctcaaatagacattttctcgtggtgtattattcatttatttatgtattcatcgctgaaatacagagctctgtaaaggaagcagcaaatggtgctgagcagttcctaatctttttttatcaaagctttaaatggatctgaatgtcaaaaactttgttatgcagtttgaacagttacaagagctctgagctgctaggtatctttgtttctttgctgcctttgtccaaaccagttttaaatgattccaaactgttttcatcaccacttgtattagctaaatttgtggtctgtaacattacagtgtttctttatactacctgtcctttagtgttagggacttatttttacctttaagatttacttattgctaatagtgccatgtcagggcaataagagatacagtgttggtacttgaaaatttaacagtgttggccttttgttttaattcagaattcgaagatcatcctttagttcaaaagatgaaaagagagaggacagaacaccttatcagctggtcaagaaacttcagaagaaaatcagacaatttgaggaacagtttgaaagggaaagaaatagcaaggtaggtttgtagcattccccagagtgagcttaatctaatattagaactgagaggatagtttttcaaaagcattagtttagatctgtgtgagaaaggtaacaaatctgagatacccggaggaacagtgatcatgtagatctgagattatataactccttggtctcctgacttccaggccagtattcttgccatttgcaccgtggcatctttatatttccactggcaaagcagcttttagaatttttaaagcaaatactttacattgacaaatcatgttactgctatttctgctctatcaaaaactacaagtaccaagtggggaggagagggagtttgtgagggatggagtggaggaggggaaagagaattttaatagttagaacatatgaagtggaaagagtcctgtacttggagtcagaagacccatattcaaatctggcttctgccagttacgagaccttaccttgggagaacttgacttaatatcctgccctatctaattaaaataagatgaaatgagaattgagcagtctttgctgtgggaattgtaaaatactatttggacataaattaatgtaactattgcttatcacaagtgtcagtgattctgctccataatttttcagccctcctacagtgatattgctgccaatccaaaggtattaaaatggatgacagagcttacaaaactgcggaagcaaattaaaggtatattatgtgccattttgtaatatatttgcattttaaaaatttttttatattaatgtctgagaatcacaaatacaacttttgataattttaaatcttgggcactgtttgacaaaaataaaagttacctttttttgttttattagggtcaaaattgcatactgtagtactgtgttatagtacagtactgtagttctgtattatattttaaatgtcttttttgtgtttttattagtaatatctttttgaaagatacctgagattgtatattaataagtgaactgatgttataaagtttatctaaaatatatttcagatattaagcagctttgagttttgttggatatttcattaagattttttggtaggtattttcatctaagactaagaatgtctaatcacagtgactcgtttataccacaaagactaaattgtaactcttgaatgataaactaggcattgcatttctgggtgtcaaaccagtatagtaattgttgaagtatatttagtttgtggatgtttagtgagtatgtgttttaataattattactttaaaaattatgcaaaataggggtttattatctggagcatcactttggtttaaatttactcaataaagtttttatttttatttttatttctaattttttcgagacagagtctcactctgttgtccaggctggaattcagtgacgccatctcagctcactgcaacctctgcctcctgggttcaagtgattcttgtgccttagcctcccgagtagctgggattacaggtgcacgccaccaagcccagctaatttttgtaattttagtagggatggggttttgccatgttgcccaggctggtctcgaactcttgggctcaagcgatccccctgcctcagcctcccaaagtgctgggattataggtgtgagccactgcacctggcctataaaaataaaaaaatatatattttttatttttttgagacagaatcttgctctgtcatcgaggttgaagtgtggtagcatggtcatggctcactgcagccttgaactggtgagctcaagtgatccttccacctcagcctcaagagtagctaggactacagacatgcactgccacacccaggtaattttttaaaattttgtatagagttggggtcttgctttgtgcctggattggtctcaaacttctggccttcagcagttctcccacctcggtcttgcaaagtgtggggattacaagtatgagccaccgtgcccagcccagtaaagtgttaagtatttctgaggtactaaatactttgtagacaactagggatatagcagtgaacaagacagacagagtccctgctgtcatggagtttatattcttgtggttaagataatgtttgcctctctctctctccttttttttttttttttttttttttgtttgagacagggttttactctgttgccctggagtgcagtggcacgatcttagctcattgcagcttccacctcccgggctgaagcgatcctcccacctcagcatcccgagtagctgggactacaggcacatgccaccatgcccagctaatttttttgtattcttagtagagatggcattgcaccatgttgcccaggctggtctcaaaactcctgggctcaagccatctgtctgccttggcctcccacagtgctgggattacaggcgtgagccacctcacccggccaagataatgtctcttaactcctctttagagtatcacttaattttcccctatacttctgttaaagatttccttgtttaatgccaatttccagtcatcagtgaaaattattaccttgattttattagtagttgataccattaaattgtctagcattggcctcctaattttcccattttctttcacttttactgctctgtagtccgtctgctgcatggtagtcagaattatctttaaaaaagtcatgttagcctgggtcccagctactctggaggctgaggcaggaggaccacttaggcctaggaggtcaaggctgcagtgagccatgtttgtgccactgtactccagccagggtgacagggcaagaccctgtctcaaaaagaaaaataaatagtcttactactttctttttcaagcccttcagtgggcttccacctagaataaagtcaaaactccttactgtggttttcaaggccttgcacagtctgcccttggccgattttatcactttcatctcttttctgttcctcaaacttgccaagctttaggaccttcacactggctattgcctcactggggacagatgcccttccactaaatcctttgtgctagacaagctccttattccgtattctaccaggatgatactattcagagaggtcttctttgtcaatcccgtccaatgtagttgttcctccacaaattatactccttttagcgctgtgactctaccctgttttacctatagatcatagcattctttaaagttattttactaatctgagtatttggttattgttttccttctctgaatatatgctccacaagaacaggaaccatgtctgttttgttttcttctgtatctcccatgcccatcagagcattttattcaataataggctctctatggatataaaaataatagcttgttctctctttttttgttgttgtttttgtgtttttttgagacagggtctgactctgttgcccaggctgcattgcagtggtgcagtctcagtttactgcagcctgagcctcccaggctcaatgtggtcttcccaccccagcctcccaagtagctgggacttacaggcatgtgccacagtgctcagcttttttttttttttttgagacagagtctcactgtctcacccaggctggagtgcattggctgatgttggctcactgcaacctccgccttctggattcaagtgattctcctgcctcagcctcctgagtagctgggattacaggtgtgtgccaccaggtacaggcacatgacaccacacctggctaacttttgtatttttagtagagacggggttttgccatgtggaccaggctggtctcgaactcctgacctcaagtgatccacccaccttggcatcccaaagtgctgtgattataggcgtgagccaccacacccagccttggctaatttaaaaaattttttgtagagatggggtctcactctgttgtccaggctagtctcaaactcctgggctcaagcagtccttctgcttcagcctctcaaagttctgggattacaggtgtgagccaccacacccagcctagaatagctgtcttgctgttttttgcttcttaaatgttttatttggctttgaaatatctaagtctgtgtgctgttaatgtatactttcttgttgtgtattttgcttattctttgacccggtcaaagctaaaaccaattattactgatctgtccttatttctgacatgtagatgcaaaacacaaaaattctgatggagaatttgtacctcagacacgtccacgtagtaacacacttccaaaaagctttggctcttctctagaccatgaagatgaagagaatgaagatgaacccaaggtcattcagaaggagaaaaaaccatctaaagaagcaacccttgaacttattcttaaaagactgaaagaaaaacgtattgagaggtgtcttccagaagatatcaaggtaatcttgagctatgatttttgcccagattagcctttagaattcctgaaacaaaataattactatagcagggtagagatgtctaggtagtctgattttcctgaatctgctccccatctttgcagattcagaaacatgatttaatcagcataacagaagtgccaaatacttcaagaattgaatcataataaaactgaaaaaactagaatgctgatgagttcatttatgttggagtcagttggcaagatgagtgtataaagagcatgaaacaggtagctcatgcctcaattccagcaatttcagaggtcgaggcaggaggattgcctgagcccaggagttcgagaccagcctgagcaacaaagtgagaccctgtctctacaaataaaatttaaaaattagctggatgtggtagtatgcacctgtagttccagttacttggaaggctgaggtgggaggatcaatggagcccgggagattaggactgcagtgagctgtgcctccagcctggatgacagagtgagaaaataagtaaataaataaataaataaataaagcatgaaacagacctacagaccttagcttgaatcctgtccttgtgtcttaatagctgtatgtattgagctcctagcttatgccccacgttggctggttatattttatgcattatgccactcagccccttcaacaatcctataatgtatattgacgtgattatgtccattaatactaacttgatatggttgttatgaggattaaatgattttttttttttttgaagagccattattcttccccagtaaagcctgtgcctagggcagtcctgatcaaagcacttggcaacctaatcttatattggatgagatttgcttggagaatggagagagtagatggtctcaggtgaacttttatctaggtaatagtcctaatgtggaactcttatcttgacaacagagtacacctctctcatgatccaaatattggagtctttctttcccttgaacagagctgaattagtcattctcatctcttcccctcttaacttttcttttgcttaaaaaaaaatttcttttggccaggcgcggtgcctcacgcctgtaatcccagcactttgggaggccgaggtgggtggatcacctgaggtcaggagttcgagaccagcctggccaacatgatgaaaccccatctctactaaaaatacacaaagaaattagcaggttgtggtggcacatgcctgtaatccagctactccagaggctgaggcagaagaattgcttgaacctgggagacggaggttgcggtgagccaggattgcaccattgcactcaagcctgggcaacagagcgagacctcgtctcaaaaaaaaaaaagaaatttttttttgtagaaaaattgttttggtagaaatcgtgtctcactatgttgcccaggctgggctcaaactcatggccttaattgctgagattataggtgtgaaccacagcaccaagccctttcttttagttttaagttttatgttagaataaatattcccctacctgctacaactttatgcaaatgtattatctttggtttaagactgattcaagcttgaggttgaaatcacagtatttgacagactacactcagctatcctctactgaatgtgtgtaatctaaagttatatttgttatagcaagatgttatccagtgaatttttttttaatcttcaattttactctcatgagagaccagggtggtattaatgagtcctgggaataagtagagagattatttggtctagtgttaaaggatattctgtggaacacacattcaggtgttaatagttgatcctatagaacgaaggggacaagtttgttttaattagtagagtatgcgagacttaccatatttatttgtctatggagcttgtttgtggacaaatgaatttgggaagcattgcttactctgctaattagactactaaaagctgtgagaagagtattgcagtataaagaatgtgccaactcagatgaagggaaatggaggtaatagagaagtatgaggtcacaaatggacattgttgagctttttccaggatctttccactatactgcttccagattttcttaatggtttagaataaatattgtattataaaacctatgtgtgtatgcacatgcgcatgcatgcccactcatcttaatgccaataaaatgccaacaacattaaatgaaatagcaagcagttatgtatgtttactctgtgctaggtaggcagtgttgcaaatactttacatagaactcataaatagtcctctttagagccctttaaggtagaacgaagtattcccattttacagatgaggatgttgaatacaaagaggttaggtaatttacccaagccatattcataatctattcagataaaatgtaaagccatcaaaggggttggtacctacttattataagagcaaattgtacaggagactgaaaattttgcctgcaaatctgcaagcaaaggcctgggctagactgttgatcgtctgccctttctacctaattatttacattgtgggagtgaggagaatattaatggtgccagtggagtttttttgtttttgtttttttttttttgtattttgttattttttttgtttaattccagaaaatgaccaaagatcatttggtagaagagaaagcttctcttcagaaaagtcttctttactatgaaagtcaacatggaaggccggtaatatctctcttgctaaaaagatttgattttatgtcttaaaaaagaacatgaatcaattttgtggcctacattcttcagggctgttttttgagcattatttcctacaattgggggattgcctatgtatttaatataaaatttgaaattgggcgaataagtcattgtttaatgttttggacattttagatttgtgatgactagacaatttcttttttttcttgcttcaggtgaccaaggaagaaaggcacattgttaaacctctctatgatagatacaggcttgtaaaacaaatgctgacaagagctagcatcactcctgtccttgtaagtaaaataagcaataattctctggttcattttatcaagatgtactcttcccaaaaaaaattattattgtggtatattggagaaatacacagccaagacagaaataattgtcactgtaaggtgagattactgattttaaaataggaaactaataatgtctgctagtatatcccagacacttgtgtaagcatttttatgtatgcttatgtcattaaatcctgacaagtaaaatcacagcaggtagaatatgatagcatcatttcacaggtgatgaaactgaggcttaggcagtgagtgatgtgcctaatctactttgtaagtgacagaagcagaatgggaaactcattcagactccttgtctagtttctttccatttaaattcatgtcgttgaaaatgcatcagttttgtggtggccatgatgatgtccttttatttgcataatgatataagctgacttttaaaataagttaatctttttaatgagaagaagtcacttaaaataatgcttattggtatttgtgtgcatttttaaagaaaaatgaaaactttagtgtttaaatgcatattaagtgctgtccccaaattaacctttagatagtatgactgtagatagattggtcttgggttcaaatagaaaacagcatgtagcccattttacattatttcctatgaattaattcactgaaccttctggtttgctgtggctttcaggctatttttatgtagacagctacttgcatggcagcttcctttaggtgatgactgcctggtgactttcttttttttttcctaacttttattttagattcaaggggtatatgtgcagtttaattacctgggtgtattgcttgatgctgaggtttggggtacaaataatcctgtcacctaggtactgagcatagtgcacaacatttttcattccttgcccccctccctcccttccccctctagtagtccacattgtctgttgttgccttttttttatgtccatgagtacccgatgtttagctcccacttatagatgagcacattcagtatttggtttgctgttcatttattaatttgtttaggataatggcctccacctacatccgtgttatcccaaaggacatgattttgtttttttttttttttgtttttgagatggagtctcgctctgtcatccaggctggagtgcagtggtgtgatctcagctcactgcaacctccgcctcccgggttcaagcaatttttcacctcagcctcccaagtagctgggattacaggcacccaccaccacacccagctaattttttagtagagacagggtttcaccatcttggccaggctggtcttgaactcctgaccttgtcatccacctgcctcggccttccaaagtgctgggattacaggcatgagccaccgtgccctgccgattttgttcttttttatggctgtataatatttcatggcgtatatgtaccacattttctttatccaatccactgttgatgggcacctgatttcatgactttgctattgtgaatagtgctgtggataaccatgtgactgcatgtgttgtttttggtagaatgatttgttttcttttggatatatatacctagtgatgggattgctgagtcgaatgtcagcagatgaatgagtaaataagatgtggtaacccgtacactcaaaatactcttcagccataaaaaacaatgaaataataatagatgccacaacatgggtgaaccttggaaacaagctgaatgagagaagcctgacacaaaggggcacatattatatgatcccatttgtatgaaatatttagaataggcaagaccatagagacagaatttagattagtggttaccaagggctaggcggagaaggcaaatgagtaacagctaatgggcacagagtttcttctgaggtaatgaaacgttccgaaattagtggagatagttgcacaacttggtaaatatactaaaaaccaccaaattatacattttaaaagggtgaattttatgatatataattatatcttaataaagttatttttaaaaaagagtatagaatggtcctcaaaccaaaaaagttgatacctatttttaaaaagaaaagtgcttcccattaaactatatgtatgttcttatcatttagaattttttttttgaggcagagtcttggtctgttgcccaggctggagtgtggtggtacaacttggctcactgcaacctccacctcctggggttcaagcaattcccctgcctcagcctcctgagtagctgggactacaggtgcgtgccaccacgcctggctaattttttgtatttttagtagaggcgggctttcaccgtgttagccaggatggtctcgatctccttacctgtgatccgcctgccttggcctcccaaagtgctgggattacaggcgttagccaccgtgcctggcccatttagaatttttaaaatatctgttgtatgagctctttcagacttttctagacataaattattatcttccttgtgcataaataaaaatataagcaaaaataaatgtaagcaattcctaaaaagatttaaagcaaatgtttaagattttgaaaataaagttgaagattcgtaacataatgaagggaagcttcactggacactttgaatacttaaaatgtaaaactatttatattattgattgttatagggatctccatccaccaagcgaaggggtcagatgttacagccaatcatagaaggagaaactgcacatttttttgaagaaatcaaggtaatcctttaaagaaataattatctgatcccttccctaagggaagagttcaaagacaaggcatgtttgattctctgtttggatatctttttaggaggaagaagaagatggtgttaatctgtcctctgagttaggtgatatgttgaaaactgcagtacaggtacagtcttcattagaaaactctgaatctgatgttgaagaaaatcaagaaaaactggctctggatctccgattgtcaagttctcgagcagcttctatgtatgtatgctgatttgtgattttagcctatttttataataaaatgtatatgccaagaaatttgatgttaaatgagtattaaggaattaataggagatgaatcaagaatttatcaaaggacacatgcttttcaagtgtgatttgcaaatatttattgtcattcccatttttaaataaaacattactgtatttcaaaaattaaaaaaaaatctagccaggcacagtggctcatgcctataatcccagcagtttttgaagctgaggcaggaggatcccttgaggccaggagttcaagaccagcctgggcaatatagtgggacccagactgtataaaaattttgtttaaattagccaggggtggtggtgttcgcgtgtagtcccagatacttgggaggctgaggcaagaggatcacttgattctctgtttggaggatgttgaggccactgtcgcaccgctgttccagcctgggcgacagagtgagactctgtctctaaaaaaggaaacaaacaaataaaatcctacagttgatttataacaaagtacaggaactagttgcgagttgatctttttgttctatatccacttctttacctttggatgatatggtgtatgtcactggttctgagccctgacttcactgggaagattttaaagtactgatgcttgagtccttcagctattctgatttcattggtttgcagtggagcttaggcattggtagacctaacagttccccagccacttttaatttgcagccagaaatagaacctctcttaagaatataatgaatcaagtgtgcccttcagtattttaccatttcaattctaggcctgaattattggaacaactttggaaagccagagctgaaaaaaagaaactacgcaaaacgttgcgggaatttgaagaagcattttatcaacaaaatggaaggtttgttgagcatcacaaaattgagtcatctttcttctctaactcacaaactgaccatatgttgaaataatggaatacgtgggattagaaattgtgcatataggatgctagcactgaaaaattttaaaacattcctttatgctctgaggccctgcttttaatggccaggaatagtcacagccagtgtaaacaacatctgattaactattttcggattgtcctagggagccttggttgtattgcagtgattttatattctttaattctacatccttacccttttgggagtggttgtgaaatgagatatctcttattttagaaaggatcccatgacaggagtggtatccttaactagtttggattttttattttatactgagaccattgtgttcatactgtgtgttgaggttgcccgtttccaaggtgtctaacagtgtgccaggcatgtggctcctataatacagtatggcacatgcctttatctaactaggtaatgcacagttgacttggaagggctctttttaaaaactaagaaaaatacattccagttctgatggtggccagaagtttgggttcagttatctcaggcctgagaaacatttttctaagtagctgggttatcttaccaagctgatagctaatattacaaattctaaaatatctgtactttaattccctttgctttgtgagtctcctatataggttggcacatatggttaaaaaaaaatctgaagtgggccaggcgcagtggctcacgtctgtaataccagcactttgggaggctgaggcgggtggatcacgaggtcaggagatcaagaccatcctggctaacacagtgaaaccctgtctctaccgaaaaatacaaaaaaaattaggcaggcgtggtggcgggcacctgtagttccagctactctagaggctgaggcaggagaatggcgtgaatccgggaggcggagcttgcagcgagctgagatgtcgccactgcactccagcctgggcgacagagcaaggctctgtctcaaaataaataaataaattgaagtgcagaaatgcatttttccaagtgtctactgtttcattgtattattgggagaaaattttgcttatagttaggatagtttgatgctttagctagcgattaaactgaattgcattgggtcattactataaagttagaaaattactcttgttgcagataagatagtttacttttacatctcaattcactggagccgcagttaactaaatgtattaaatgactcagtgtagcctccaacacttaatagacactcacagacctggcagagtctagcactggatgtcctgttaaaatactgggtttcctccagttatctatgttgattatttataagtatagcatcatttaatctatcagtagagaagtccatcaaaaattttagaagtgttccttggggatgagggtattagttcaataacctttttttttttttttaacagaacaactttttatttgaacttatgtttagtaacagtatgtctcatattaagacaacttttggatctttttttccaaatgatctctagaacattacaaattttattttctcccctaggaatgcccagaaagaggatcgtgttccagtgcttgaggagtacagagagtacaagaaaattaaagccaagcttaggcttcttgaagttcttataagcaaacaagattcttcaaaatccatataagatacgttccttgaaaattcatatcataaagtcagttgtattccttgaagctatcatcgtgtgtacttggctggtacttaaattcgttttgtcaggcactcagagaatctcattttgtacttggttgtggtgccactaaacaaaacaaatgatgggagagtaagtaggccctctcaagggagcgtaagtgatgttccatattaaccacagactgtcctctccacctttagcaaacatatggtttacttcattgttttgtactacagatacatccttttagcaaaagactggaattttatcctttcaacttcaagaactttggaaatgcaagctttttgttattaccaactttttgtttctcattactgaagaaaattggaggaaaatcttcatactgaattcttctgttgcctttttcttacagaatgactgaaaatttgaaagaaaagcctataaaagtgcacatacgcaactgtgttctctgttttcctagaaaaccaaaatcaaactgagatttcaagtcgtactatggaacacctttctgtttaattcccaaagtgacatcttctcacaggtagtatgttagtaaaattttgcaattcgctggtcacacagctcccggatgaagataacagttggtagaccaaaaggtgacctcgcttagtatattgaaaacacacaccacacatcacacacagaactgaatcataccacatgctgcctatgggacttcagttactgtttcctgagttactgtttatccgctggcaatggtgtgatttgtctggatcagatccgcgctattccccaacccacctccagataatgtgagaaaatagccatgtcagtatgtaggaactctgatggtgctcagatttgtgtgttcaatcaatgggcttaaatcagcaaaatattatgcctaaagtaaatctgttcttaacaagggctctaccactgcattttcacatgtaccttcagggggttatctttttttttttcccctcctattttaatcagcaaaatccataccaaaacaacgacaacaacgccctcttaagggaccaccctttggtcaatcataacatgctgtttaaagcagctgtttacaggatgtgtagtggtatgccccttgtcatatactcttagcatatctttttttcctttggctttgcatggcttttcttcaggtactgtctcggtatcattctgctaatcattgttacagaatggtgacttcatttgtgctaacagtacaacagcagatttgggtcaggcttaatctaagtgttaacttttttttctggtgcttttttggattgatgactgtctcactttgactatacccatgttttgcatgcaatgactcatgcatggttttcttaactagctaatattaacaatttattccatataaaaatggaattttgcaacatcctttaataaggtgagggaagcatgaacctcagacttctggcactattacatagtaagcacatgaagtagtttgataataaatagcagttctagtacttcacatttcacccgtgtgtgcaatgcctttttctggggggtggggggtgagggaaaacctggtagtgaatgtgtagttggggaataaagaaaagcactaaatcctgccctttttgtgtggtttccttttgatacaactaggttattcataatgtatacctagaaaagtgaaattgaaaataccaaaagatgtatcatttttatttgaatccatcatgcagtgtacatttcagataatttccttcagtctccagataggagtgtatccaaacatctaattttatgtgcactgtgtatcttatatgaatgttttattttatataccacatgcaaaaatgtccatatgcactatttaaatgttttaaataatatattccttctttataatgctaaatctatatgagtaccatatttttataagtcagtggtctgactggtttcattttagaattaacagctgcttcaatatgttattcaatgttaatgtttggctgtgagtagaatatgtaaaagtggcatggcagcacttatgctctgtgacagtattgtgtgtcatagttgagcagtagctggtagaattaggcagttggtgatagttttactttggtacaaataaaaactgtatatctatatacaaataatatatagatatatatgtccaccagtataatggcattgctgtgtctggcacttcattgtacagacttttataataaaagaacttgaaagttct

SEQ ID NO: 38390 - DNA, 14060 bp, Homo sapiens
ggccgtccctggcggcggagatggcggcgacagcggcggaggctgtggcctctggctctggagagccccgggaggaggctggagccctcggccccgcctgggatgaatcccagttgcgcagttatagcttcccgactaggcccattccgcgtctgagtcagagcgacccccgggcagaggagcttattgagaatgaggtggggggcggggccgcgtctaaagggagaggaggaaggtacccggttgagaggtcagaggtgaatggtgaaagagatgggagactggcagggctctagactagggcctatgggaagatggagagaaaggcgaggagatacggaacttaggggttcgtgctgattaacaggagaaattattctgaagttgagaagtagttgggatcatggaggccaacccaccggctccttggcattacttcatttggtgtttttcacctgttgttttcatttaggagcctgtggtgctgaccgacacaaatcttgtgtatcctgccctgaaatgggaccttgaatacctgcaagagaatattggcaatggagacttctctgtgtacagtgccagcacccacaagttcttgtactatgatgagaagaagatggccaatttccagaactttaagccgaggtccaacagggaagaaatgaaatttcatgagttcgttgagaaactgcaggatatacagcagcgaggaggggaagagaggtaaattccgaaagcttaattttctgttggatttaggacactcatttttctttcctatacttgtttgaaggtgtggcagaattgggtcaattagagattggcctctcccatctctggattccagttgaaggagtagtctggtcttccagcctttaaggggtttgagttcttagtggttcttggtgctacagccagctagttctgtagcttgagggatgagggaatgattaaacttgagctatgaatctctgggttcccatcttcttcctcataaagagttagttgcctagaagggtcaggcaggtgaatggaaggagtaatatcgtctgtgtgaaatcagtgatgaggctgaaggcataagccttgttcaaagtgagaagccaaggccggcgggggtggctcatgcctgtaatcccagcactttgggaggccgaggtgggaggattgcttgagtccaggagttcaagaccagcctgggaaacgtggtgagagctagtctctgcaaaattaaaaactaaaacaaaaaaccatggtgagaggtcattacttgactctgcttgcttcagttttggagtgcagttctagggttgggagatattccgattttcaagagaagttcaaaatcaggatttttatttaaaatcttttgactttaaatggagcaactaaatcagatttaaagaaaaaaagttgcagggggccaaacaaaaatgtttgtcactggatttagctctgaaaatgcctgtttgtagccattgtccttaagtattgtgatgactgaggatagttcaacctgaaaagttgtatagtttgttgtgattctgcagtaaagaaggttaggattctctagcttagggaagatcagattaaatttgtttttcctatcacaacagcaacacaagacacacaagacagtgattcttcctctctgcttttattcctgcttatgaggacagcctcttatgtaggtccgagacagtattcagtcccacactataacactgcctctggggaattgctttcgctcagtacttcacggtgaattaccctctcgcatttggtgtccaaccctgggtttctctctagtctcttgcttcactcactcctgttcctgactccttatcagcagtctgtggctaagtgaatggatttgaaatatctttttttcttcttcttaacacttagcagttgtcataatgatgggatttttgaccagaagagtttccaagatatgaactgtggtcgatctgtccatgatgtcttaatatattggttcagttatctcatgcattaattttctaaaatttaacacagtgtgtgtgtgcacacttccatatacacacacccaacattgagagaaagattgatttaaatgatgctgttggagtgtgtaattccattgaatgaacatatacccaagaataagcataagatatgtgaatcttgtggttcttcagtcgcttgaagtttcttgtgtcccatagtgagagcattttgcataagaatgagtgtaatctgtactttatgggtgattaaagagttttcaaggaaaatctttaattgtttggaagttttaccctatcagctgactttagcaccgagcagcttcaccagtcagcttcacttcaacctgattggacaggttgtggcgactatggggtgaaatgtattaggatcctctgagctattttgagcattaaccattctggtgtaatcataatattgtttagattcatatatgggcagtatcactgactctttcaaagttacttgcatattttttgggtgaatatataattattatctttggggagcgttgcattgagtcttgaggatttcatgttcctacaaaggtagtgtttccaactcatcaagatttcctattaaggctgggcatggtagctcacacctgtaatctcagcacttcgggaggcagatcacctgaggtcaggagttcgagaccagcgtggctaacgtggtgaaaccccgtctctactaaaaatacaaaaattagctgggcatggtggcacgtgcctgtagtctcagctacttgggagactgaggcaggagaattgcttgaactcaggaggcagaggttgcagtgagccaagattgcgccactgcactccagcctgggtgacagtgagactccgtctcaaaaaaaaaaaaaaaaaagatttctgattaacattgccttaaacattgtgattctaggcagtgagatgagatgcctttgaacctttcttttttttttttttttttgagacagggtcttgctctgtcacccaggctggagtgcagtggcatgatctcagcttactgcaaccttcacctcccaggctcaagcgatcctcccacgtcagcctgtcaagtagcagggaccacaggcatgtgctgccaccaccatgcccagctaattttgtgtatttttaataaccaatttatttatttaaatacataaggttttgccatgttgcccaggctggtctcgaactcctgagcttaggcaatccacctcccttggcctctccaagtgctgggattacaggcgtgagacaccgcacctggcctctttgagccttttgaaataatgatctcaggaccaggacagagatgcttctgtcttttttttaggtttgcacacttattaaatgtctcttgtgggcttgttcaagtgtgtctgggttttcatatctcttaagtaacttatgaccttcctcaggtatgttaggagcctgaggcctttacctaataagctatcttccttactttagctgtagaaggctgcaacaggataggtggctgaatcagttaagataaactaggcttcaagccagagctcgggctagaaacaacagaggcttatttctcacttactacatgttgatcatgggtaatgtcatattgttctttacatcatcttacttgctctggcacccagattgccccagcagctactatctagaactttggagttgctgtggcagaaggaaagagatgtggtagtggtaacttgttcttaaattacagttggaaacaacacaagtcgcttctgtggacatttccttggccagagcagcgtaaataagcaagcctggcttcaaggggatgtgaaagaaaactcgcacactgagggaaccagctcttggtgaacagtaatacaatttaccacagtggtcatcaagggccaacggagatgtctcaggctctgcgagtctctggagtgagactgattcatcattctagggtctgtggataggcttctaggagtctgaaattgtgtgaaagttctgggtgtatgtgcatttttatggggaacctccgtggattcttttatttatttatttatgtatttatattttttgagatggtgtcttgctcttgtcacccaggctggagtgcaatggcacgatctcagctcactgcaacctctgcctcccaggttcaagtgattctcctgcctcagcctcctgagtagctgggacttcttctccaggttcttttttttttttttaattttatttttcatctcaccctcctactctttggattcttaaaggagtcattctgtgacccaaaaaaggttaagcatcacttctttaaagaaaaagtttgggggccagatgcagtgtctcacacctgtaatcccagcactttgggaggcagaagcaggaggattgcttgagcccaagagtttaagaccaacctggacaacatattgagaccttgtttctttaaacaaaacaaagaaaaaccagtaaattaaaaaatttggtgttgaacataactcaatgaaggataagtaagaattcagttgtatgagaatccatgttggctaaaatttgcctgactacatctgttctctgtgggagatgctggtatggatttgggcttggattttcagatgtggagaggccatgccaggggctgtgtgtgcatgcactaataggattttcttcttggggaacataggttgtatctgcagcaaacgctcaatgacactgtgggcaggaagattgtcatggacttcttaggttttaactggaactggattaataagcaacagggaaagcgtggctgggggcagcttacctctaacctgctgctcattggcatggaaggtaagaaatctttcaaaagcagcatggcttggagtcatatgaacctgatttctaatcctgtcttcaccgcttattagctccatgactttgaacaagccacttcactttcttaagcctcagcctactcagctctaaaagaaacataataggggctggatgccgtggctcacgcctgtaatcccagcagtttgggaggccaaggtgggtggatgatgaggtcaggagatggagaccatcccggccaacatcatgaaaccccgtctctactaaaatacaaagaaaacaaatcagctgggcatggtggtgcgtgcctgtagtcccagctactcgggaggctgagagaggggaattgcttgaacccaggcggtggaggttgcagtgagccaagatcacgccactgcactccagcctggcgacagagcaagactctgtctcaaaagaaagaaaaagaaacataatagggccaggcatggtagctcatatttgtaatcccagcactttgggaggccaaggcaggaggattgcttgaagccagaagtttgaggctacagtgaactatgattgcaccactgcactgcagcctgggcaacagagtgagatcctattgcttaaaaaaggaaaaatgaaaagaaatgaaacatgataatgtcttgtaaatagttgtgaagttgtgaagattaaatgaaataatgtatgtcgagtctgtttttttttgttgttgttgttttgtttttttgagacagagtctcactctgttgcctaggctggagtgcagttgtgtggtctcggctcactgcaacctccgcctcccgtgttcaagtgattctcctgctttagctcccaagtagctgacactacaggcgtgtgccaccatacccggcttatgtcgagtctttaagctagtttcgtgtattctaaaaagttcccttttcccttcctcagctgttatgtgagtgtgtatactgagatattagggacctctctgaaatacagacatgtgatgcttaatgtcagggatacgttctgagaaatgtgttgttaggtgacttcatcattgtgcaaacaccatagagtatagttacacaaacctagattgtgtagccttctatatgcctaggctatatggtgtagcctctgactaaaccatgtactacatggtgttagcatattactgtgctgaatattatagtcaattctaacacaatggtaagtatttgtgtatctaaacatacctaaatatagaaaaggtatagtaaaagtacggtatcagatactgcaggaaaaaggtgacaaaagaaaaaagtatataaaggttaaaaaatggtagtttgggaatttttttattgccaaaaaaaaaaaagataaaaaacggtatacctgtatagggctgctccatcataatcttatgggagcactatcgtagatgcaatctgttgtcgactaaaatgtcatcatgtggcacatgactgtaccacttttctctactagatctgtctatattcagacaatttttgtccctgtgaaagaggagaaacttatttttttagtgtaaattcaactttattgtttttatttatttatttatttttgagacagagtctcgctctgtcgcccaggctggagtgcagtggcgcgatctcggctcactacaagctccgcctcccaggttcacgccattctcccacctcagcctcccaagtagctgggactacgggcgcccgccaccacacctggctaattttttttgtacttttagtagagatggggtttcaccgtgttagccaggatggtctcgatatcctgacctcatgatccacctgccccggcctcccaaagtgctgggattacaggcgtgagccaccgcgcctggcaaattcaactttatcttttaaatagataatacattcatggagttcgaattcaaaaggtgtaaataggtacatagtgataactacccctgtctcttagcctcccaatttcctccctggaggtactgcatattattagttgcttgtgttttctgctagagaaatttatgcatacactaataaatatgtgaatgtgtttttttttttttttttttttttcttttgaatgaaaggagaggcccttaaactccactcaggagaatgagagctttttatgaggcagggtcattgtctcattcttatttttatttctcgcagtagctcaatgccaggcccatggtaggtacttagtaaatggtgaataacctgggttgaacaaggaaacagagaagttatttattgtcattcaccacttagctccttggtttcttcttgtttgattgtctgttcttcagatttggatcctttgctgctggtactaataaagatttccggccatgtggcttgtgaattgataccacctgcctctttttttgtttttgtttttgttttttattgagacagtgtctcactctgtcacccatgctggtgtgcagtggcatgatcagggctcactgcagccttgacctcccagtctcaaacgatcctcccacctcacccttccaagtagctaggactacaggcgtaagccaccatgcttggctaatttttaaagtatttttctgtagagatgggggtctccctatgttgcccggactggtctcgaactcctggccccctctcaccttggccccctaagtgatcctctcaccttggccccctaaagtgttgggattacagacgtgagccactgtggctagtcttacctgcccctttgaaaccaactcttggttgacctgccaagaaagagccagttctggtttacttgactcttttttttgagacagagtctcgctctgtcgcccagactggagtgcaatggcgtgatctcagctcactgcaagctctgccttccggttcacaccattcttctgcctcagcctcccaagtagctgggactgtaggcgcccgccaccacgcccggctaattgttttatagttataatagagacggagtttcaccgtgttagccaggatggtctcaatctcctgacctcatgatcccccgccttggcctcccaaagtgctggcattacaggcgtgagccgctgcgcccggcagtttacttgactcttatgtctttctgttgcctgcgtttcctgtggtagggtgcatggaagtggatccctcaggtagagatgagagagcaagtctgctttgaggatgcatgtggactctcatcacttaagaaagcatctgtcttggcatacccagacagagctggggaagattgtctaaattccatgccctgcaaaagtgtgtgttcaactcatggactgtgcaaaggccaaacaacacacgtggtcctagttagaaaggagtagatggaacatacactagggcacaactaattcaaggtggcatttaaaataatgtgccatatttaaattacacagcactctcttcagtcatctgatattctttcctccaatgaaaatcacttgcaccagtgagccccaatgttgctttaagaagtgttgtcttggctagatgtggtggctcacgcctgtaatgctaacactttgggaggctgaggtggacaggtcacttgagcccagaagttggagaccagcctgggcaacgtggtgaaaccccatctcttaaaaaaacaagtattgcattcgttaggtgtattgaagtgggaggaaaggttgagaatctttgagttccacagagctacccaaaataaatacagagctacataatcatacaacttagaatgactggttaactcctcatgtatatgttgttgataccagtcatttctgttttgctttccttgaattcctgccgtagtcaagaagagtacacggtgtacacagttgattaccctacctgatttttgaggatcattttgatgtgctcttgcttccagtaagggcagcagccttcatttagggaagttgacttagctgatagtggacccttaaccagtgatgtttgctagagttattaccatacaagcttaacacctaattttctgagagttgtaattggaatttccctgattctgcctaaattttgatttggaacttttagctgggagggcaggctgggtttctctttagcactgggtcctgtattccagcttatgcaatagaaccactgctctgcataagaaaatgcctttcttcttacaggaaatgtgacacctgctcactatgatgagcagcagaacttttttgctcagataaaaggttacaaacgatgcatcttattccctccggatcagttcgagtgcctctacccataccctgttcatcacccatgtgacagacagagccaggtgagcttgtgtggtctgagaagggtatagaactctagattctagtaatgcctaggctggaatgtctttccccttccccgtagtgatatgccaggttcggattacaggctgttcttgccttaacacaccaagagggtaatttcattgtagctcacatattccaggctccctggagtggccaccagatgtttgtaagtataactagccccacagagctaattctcaggacagacactgtcattgatgctgatggactctggttactctgtttgattggcttataagtttatggaacaaaatgtgtatgtctccattggatttaatcattgtttgcttttgtcatggatgctatttctttttgataagaagggtgaataaaactgagctatgttgtttaatgtatttcctagatctaaatgaggtatgtggttaactgtggccagccaaagatatcctttcctttcttcagaaagctgtctagctacttcatgtgggagtctttgctggttagaatatgtttttgggaaaagtttctgaaggtttaggtggaggataattcctaattcctcatatcctcagctgtggagtaggtcgtctgacctcaggagcactgaagcctaggattctttatcacttaacattcaaatgtggactgtcttatattgttctctctcagggtttaatgtgcattatatcttctgctggatataaattccaaatactttttttaaggcatcgttttttttttgtttgtttgtttgtttttactgccaaactggcatatagtagttttactggtgaagatttggtgattgatattttttttctttctcttgaacctcttaggtggactttgacaatcccgactacgagaggttccctaatttccaaaatgtggttggttacgaaacagtggttggccctggtgatgttctttacatcccaatgtactggtgagaagggggctagggctgggggctttttgggagctttcttttccattccctggaaagccttgtctgtgtcgcttctgagttatggcatgattggttttatgtggtctataggaaggttggcatatccagacatgagcgtactgaacctgtgggggatagtggcgggaatgatagccctgtctctaggacaggatgacggttcttcaagtccaaagagattccggaggcttgagcctagaaaaactgttcttggctctttggtatttcgagactgaacaccagtacctctaacccccaagtgtgtgtttttttcacaggatgagtgtaaagatattgtcttcactattttccgtaactggactccacctagtttttcagcccaaccctgccacccccccgcacttcgcccctccgcccccgccaaaagtatcagtagtaaacaggagcctgtttgttttcttgcaggtggcatcacatagagtcattactaaatggggggattaccatcactgtgaacttctggtataaggtgaatatggtttgctttttttgttttttccagatggaactggctcttgggtgaggtaggtataataaatgattttggatgggatggttgactatccctggaagtgattgtcaggtgtctggggagatgaaagggacaggattgaattgggtttcttttttttaaatatattttttgagacagagtcttgctctattccccaggctggagtgcagtggcgtgatctcggctcactgcaacttctgcctcccgggttcaagtgattctcctgcctcagcctcccgagtagttgggattataggcacacaccaccatgcctggctaatttttgtatctttagtagagatggggtttcaccatgttggccaggctggtctcaaactcctgacctcaagtgatccacccgcctcggcctcccaaagtgctgggattataggcctgagtcaccgtgcccggcaagaattgggtttcttagaagggaggatggtactaagaacagtagagtgacactgacgcctgctgctaaaggcatttcctgagctactgcttcctttgtagggggctcccacccctaagagaattgaatatcctctcaaagctcatcagaaagtggccataatgagaaacattgagaagatgcttggagaggccttggggaacccacaagaggtaggtgactgccccaaggtggctcagtgggtgggttgaccaaggaaagtcaggatcagagcgacattctttacagcttctgtgtttcagtgtctggtgtcctctctctccatagaggttatgggtatgttcagaaaaattcttgttttctggtgatagctgggcttgactggcagatcaattataattagttccatgctagtagtaatgttccccatgggtattatgtaccatctggggaccccctgaggggattcttctggaacaggaagcgagcactaacacatctccttgcactttcccagctgtgccagggctgctgtaggtaatgttgagagacctgcttcccatgcaggtgtgccagtggcccattgggtaaatgggggaggtttgtatttgtagggttcttgcttgcctcttggaggtaacctcagcatccacagacacctgtggtgttgggagatagcatcagccccagttgcagatgatcattttttgaggatatggaggcagttaacattctggagaaacatatagacactcttgggtgttcggggattattagcttctctgaccatgtctgtccgtttggggcagattacggtaagagacggtgttgtgcgagagaagaataatagtacaagatggacccctgagggaaagactatgtcccagaatactgggttgaccttcaggaagataggtgattagaggattcacaagattgtatgaaaacattgtctctgtccttggctggacatctgatgtctccagacacaccctgtccaattccagggccagggaacagccagttctgattggctcctcatgtttctttacaggtggggcccttgttgaacacaatgatcaagggccgatacaactagcctgccaggggtcaaggcctcctgccaggtgactgctatcccgtccacaccgcttcattgatgaggacaggagactccaagcgctagtattgcacgctgcacttaatggactggactcttgccatggcccaggagtcaggtgtttggagcgaggcagggcagttggcactccactcctatttggagggacttcatacccttgcctcttgtgccccagcaccttctctctctgccccccgcctaaagtcctgcattcagtgtgtggagtcccagcttttggttgtcatcatgtctgtgtgtatgttagtctgtcaacttcggaatgtgtgcgtgtgtgtgcatgcacacgcatgtatgtatctgttccctgttccttctgggtcaggctgtcacttccggctctcagccctatctcctgcaacctcagtgcctcagcctgagagagagatgagatgctcttggactccccactgcatctgggctgcagggccagagctagtctgaccattaggtcagtctgcctcctgacagtttttgcgtagtcaagctctaggcggtatgggaatggctaccgggactctaatggggtgaaagagaggggaggcttgcctttgagagcctatatagccttcctgtgagagaggattagatagggttccaactgggcctacaagctcaagccatacataaaaggaccttgggacataagaaccaatgattgtgcataagttctaaattagagacacatatagtttctctctttcagcaccagctcttgcccctatgctgggtaccaagggagttctcctagctgtggcttctctaggttctaggggtgcaagcctctgtgtgtttgtttgtgtgtgtctgtgtgtgcgtatccacactaggggtgcaagcctctgggtgtgtgtgtgtgtgtgcgtgcgtgtgtgtgtgtgtgtccgtgtgtgtgtgtgtgtgtgtccacactggccagcctccctacttaccaaggttctccactgcttaccttttccagtgggacagtacagtgtgagcccccgggaagtactgcctgacctatcctaagcttttacacttggattttagccatcatatgttggccaggtctcactgcagcctgcccgaggctaactggctagagcctccaggccctatgatgctccctgcccaggccatatcctttattcctgctgagcttcctggctgaatagatgaaatggggtcaagcccaggcagctcattcactacctgtgatccacctcagggcacgggcaaacacataggcttgcgtcttaaagccagctcctctgccagaccccgttgtaatgtgccacaacaccctcaatagtcagggcaactggtggagcatggaagtcgaatttccttttctgttaggagctactcctgggaacccctctcagggctgcagcttacaggtgggcagctgtgattgcacaacttgaagggccatcattcacatctattcagtgggagtggggtccctgggattgggcagtgtggtggccctgtgtctcctcacctctgctcctgtcttcatcaccttctctctggaagggaagaggagttggaaggtctctggttttcttttctttttttttttttttgccaaaggtttacttccagcatctgagctctggctctcacccctgaagctcagttatagtgcactgatgaactgagaggatgcgtgtggatgtgtgtgcatgcctgagtgcgttttttggggaggggtgtttatttttagtaccccattctggggttctctgatgcagtgtggatgtgaagatatggtaccttctcaagtgtagctctttcaaatatagtcaatgctggg

SEQ ID NO: 38391 - DNA, 482767 bp, Homo sapiens
ccgtcgccgccacctccgccgccgcttcgacccctgccgccattttctccgcgtctgggctttgtgtgagcgaacgggctgcaccgcgctgcgcctgcgcgcccacgtgacccgacgcaaccagtaacacctgcgcccgccgctcccggctgcctccttggccccactcgccccgggccacgcccccgccgcgcgcaggcgcagaccggcagctgttgatcgcttctctctcgagatacactcgcgttaggcaccgactggctgttcccggcgcgcgtcctctgagtccgatagaggaggcatctccccaccccaccccacacaaacacctagacctagtcactctcagctttctgtaaccagagctggagcagaggggaagcaatgatcctgtctagagattcctggaagttttagatgaagcttgttcaacccgcggtccggcacacgattcgtaaactttcttaaaacattgtgtctttttgtgtgatttttttctttttgtaacgcaattgcgcggttctccagcgcgaactttgtaggcaacaacggaacggcatggaataatatcagagtattatccgtaattcgcattataattgcaaacagttcgtccagaagaaacggaaaactgttaaaattcactaataatggggccaggcgcgatggctcactcctgtaatcccagcactttgggtatgggaggccgaggcggcggatcacctgaggtcaggagttcgagaccagactggccaacatggtgaaaccgcgtctctactaaaaataaaaaaattagctggacgtggtggcgggcgcctgtaatcccagctactcgggaggctgaagcaggagaatcgcttgaacccaggagccggaggttgcagtgagccgagatcacgccactgcaccgcagcctgggagatagactgagactccatctcaaaaaacaaaaagataagtattgagtactgggcttaatacctgggtgatgaaataatctgtacaacaaacctccatgacaagtgtttacctatttaacaaaccttcacatttacccccaaacctaaaagttaaaaacaaaattaaaaaaaaaattaatggctgggcgcggcagctcacgcctgtaatcctaccactttgagaggccaaggcgggtggatcacgaggtcaagagatcagaccatcctggccaacatgatgaaaccctgtctctactaaaaatacaaaaattagccgggtgtggtggcaggcgcccataatcccagctactggggagcctgaggcaggagaatcgcttcaacccaggaggaggaggttgcagtgagccaagatcgggccactgcactccagcctggtcacagagtgagaccccatctcaaaaaaattaaaaataataataaagagcgagaggactcttgcaatgttgcataaagtgaactgtgacagaattcagggtgtattctgtactaggcataatgctgtatggtcttatttttgtgtgcattcgtggcatcagttttatggtgctgtgcagcctccaatgtgccattttccaagtgcagacagtcgaattggcaccatcagatgttacgtgtgcttgtggcaacttgggcagtaagatgcagcgattatctttttgagacggagtttcgctcttgttgcccagactggagtgcaatggcgccatctcggctcgctgcaacctccgcctcctgggttcaagcgattctcctgtctcagcctcccgagtagctgggattacaggtgcatgccaccacgcccggctaacttttgtatttttagtagagacaaggtttcatcatattggtcaggctggtctcgaactcctgacctcgtgatccgcctgcctcaggctcccaaagtgctgcgattgtaggcgtaaaccactgcgcctggccttcaatgcagcgattatcaataatatatttttttctttttttggagacagtcttgctctgtcacagaggctggagtgcagtggcaccatctcagctcactgcaacctccgcctcctgatttcaagcgattcttctgcatcagctttccaagtatctgggattacaggtgcacaccacgacgcctggctaagttttgtattttttagtagagatggggttttgccatgctggccaaactagtctcaaactcctgacctcaggtgatctgcccacctcagcctcccaaagtgctgggattacaggtgtgagtcaccgtgcccagcctatcaataatatttcaatctacctttgtaaatgatagctcactgcaaccttgaactcctgaactcaagcgatcctcccctgcttagcctgtcaagtagctgggactgtaggtgcacgccgctgcacttggctaattttttatttttattttttggtacagatagggtcttgccgtttttcccaggatggtctcgaactcctgagctcaagggatcctacagccttggcctcccacagtgctgggattataagcgtgagccactgtgctggtccttagaggattattaaagacaggttaacaccaaactaaaactcttctctatgaaagtattagaatagatttgcaaagaaaacacttttccttctctctctctctgtttctttctctttttgtagagacagggtcttgctatgttggccaggctggtctctaactcccagccttcaagcaatcctcctgccttggcctcctaaagtgctgggatttcaggcatgagtcaccccatctcgtctctctcttcctcatggcatgtcctgaggcatctgtacatcaactcctggggcaccacaggccaaagttggcctgaggaaagatgggtgtcaggctgtgtagggagttcagctgcaggagcaaggaaggcccccccaaggggcaggagagctcatgcgcactggtgtgatgctccgtttttgcagaccactggtgcgtcagtcaccccatgcctaggaggccctgcccatctctccagccacctgcccctcaatcacactgctccagccctggggttcctccctgctgctcttcctacaggctaagcagtttccagcctctgggcctttgtgcttagctgtttcctccactcccatggccacacaggcttctccttgcccttccagtccaggcagaaagtttttcttcctttgtgagtgagctacataccaggcagggattcatatggaaaacagaccttgagcaatcagctcctccactctgaggctcagtttgcttaactgaaaatatggataataagaaatgcaatgcaccaggctgggcacggtggctcacgcctgtaatcctagcagtttgagaggccgagtcaggtggatcatttgaggtcaggagttcaataccagcctggccaatatggcgaaaccccatctgtactaaaaatacagaaattagccaggcatgatggttggcgcctgtagtcccagctactcaggaggctgagacaggataattgcttgaactcgggaggtggaggttgcagtgagcagagatagtgccactgcgctctagcctgggcaacagggcgagactccgtcgaaagaaagaaagaaaagaaagagagagagagagagagagaaagaaagaaaggcaccagaactcacctttcagggttgccctgagctttaaaagcagacagatgccaagagcctttaaatataaaagaatcggcaggcagaaagcgctgaagaagtaggtgttgttattagattaactgcattctgggccaggctcggtggctcacgcctgtaatcccagcactttagggggccgaggtaggtgaatcacctgaggtcaggagttcgagaccagcctggtcaacatgacaagacttcatctctactaaaaatacaaaacttagctgcctgtggtcccagctacttgggaggctgaggcaagagagaatcacttgaacccgggaggcagaggttgcagtaagccaagatcaccaagatcacgccactgctctccaacctgggtgatggagtaagactctgtttcaaaaaaaaaaaaaaaaaaaaaaaaaaacacgtattctgcatctttcctgagtcttcctccaaaaggagtcctggtgtcaccccggctccacttcctacagctctgagaccttagattaaggcttccctgccctgggcctcagtcttctcacctgtaaaatgtaggtaataaccacttcttccctaacaagtgacagtcaaaggagggagagactcggaactatgcctaatctatagtcaccctaagtcagcgtggatattgtcaccatttttaaaaaattgtttgtttgctttagagacagggtcttgccctgttgcctagaatagacaacagaagtataattatagctcactgcagcctggaactcctggattcaagggatcctcccacctcagcctcctgagtaactgtgaccacaggtgcatgccaccatgcccagctaatatatatatatttatatatttatttatttagtaaagacagggtctcactatgttgccaaggctggtctcaaactcctaggctcaactgatcctcctgccgaagcctcccaaaatgctgggattacaggcatcagccaccaggcctggcccatgctggactctctacacttaactaaaaactaacagtggctaggcgcagtggtgcatgcctgttgtcccagctgccagggaggctgagacaggattgcctgagcccaggaggtcgaggctggagtgagctgtgtgattgtgcctctgcactccaatctgggtgacagagcaagaccccatctcaaaaaaagaaaaacagaggccagcatggtctgtggactggcagatgcaaagtaagaggaaattgttcttatgtctattttatttttctattttttattttttgagacagagtttcacgatgtcacccagtctgaaatgcagtggtgcaactgatctcagctaactgcaacctctgtctcccaggttcaagccattctcctgcctcagcctcccgagtagctgggattacaggtgtgcgtctccacgcccagctaatttttgtatttttagtagagatggggtttcaccatgttggccaggctggtctcgaactcctgacctcaggtgatccacccatctcggcctctcaaagtgtgattacaggcatgagccaccatgcccagcccgtatgtatattttaaaaatcatttttataaccctgctacctgatttttacttgaagactgagcctttgcttcttcccatgggcttcagaacagatccctcaaaacaagccagtggtttttattgttttttattttattttattttttttgagacagagtctcgctgtctcacccaggctagagtgcaatggtgcgatcttggctcacggcaacccctgcctcccgggttcaagcgattctcctgcctcagcctcccgagtagctgggactacaggtatctgccaccacgcctggctcatgttgtatttttagtagagacgagatttaaccatattggctaggctggtctcgaactcctgaccttgtgatccgcccacctcagcctcccaaagtgctggaattccatgcatgagccactgtgcctggccaaccagtgttttttgttgttgttttgttttgttttgttttggagatggagtctctctctgtcgccaggttggagtgcagtgacgccatctcagctcactgcaacctccacctcccaggtgcaagcgattctcctgcatcagcttcctgtgtagcacctgggattaccggcgcgcaccaccatgcccaagtaatttttatatttttagtagagacagggtttcaccatgttagccaggatggtctcgatctcttgaccttgtgatccacccacctcagcctcccaaagtgctgggattacaggagtgagtcactacacctggctggccgccagtgttatttttttacctccatgtggtccctccctgggaggcctcctttgagaaacataactgacaagtccattttgtccagccagggctccttttattcattcaggggtgggtttttgaaacgcagtgcaacttttatataaagtcgagggtgccaggaaagtgggcctgccgggtgcagagaagcgcaagaagcttgctggaatgttccagctttaagggcgcccttgatacaccggccacagctgctggcccagaaggtgccatgtggacctcagaatgagatcagggtgcctgctccgtccagagctcaggaccatgtccacctgtcctccatatgcaaaaaaaaaaaaaaaaaaaccctgaaaatatcttcacacaggatcacagactaggctctgcatggtgtctcttggcctaagaagcgttcaggccgtgcgggaactgttgaagtggaagtgttgaagtggaagtccttccacaggacagggtatcaccagctacctctggcctctctgctgcagggtccggagagcccagcattcatactggtgtctcctctgccaccttcttcaggagtccagctgccagtggagaatgctgggggccctcggggctgtccgcctcccggatcttcaggcgaactttctggttggtctttctccactcggagtacagctggcagtggtagcggaaggagacctgtggggcagccctgcagtgagcggaggcctccacccgcaagggaggaaaacaagtcgccgtggtggcacctgcgttggcccaaaccatggctggggctcatgcttccagaagcagagctggcttatgaacattcctcccacaaagtgcacacacacagacccattcacactcctggtgacacccaccagcttccagagtcctgcaaagacaagatacaccccacacacaccagcaggaagcaaacgggagctcctttcctgcctctcagtgggaaaggagtgaaacagcctcttggaaggcattaaatgtcaatcaatcaggccgggcgaggtggctcacacctgtaatcccagtagtttgggagcccgggcacgggggaagatcacttgagctcaggagttcaagatcagcctgggcaacatggagaaaccctgtctctactaaaaaccccgtctctactaaaaatacaaaaattagcctggcgtggtggcacggacctgtagtcccagctacttgggaggctgaggcaggagaatcgcctgagcctgggagatatgggccgcagtgagccgaaatcacgccactgcactccagcctgggcgacagagtgagaccctgtctcaaaaaaatttttttaatgtaaatcagtcacataattgccaaaacgtgcaaccagaacgtgcaaacaaaaaaaaaaagtttaaaaaaaaaaaagtcactcaataggtgaatgaggccaggcgtggtggctcacgcctgtaatcccagcactttgggaggccaaggcaggtggatcatgaggtcaggagatcgagaccatcctggctaacacggtgaaacgccatctctactgaaaatacaaaaaattagccggccgtggtggtgggcgcctgtaatcccagctactcgggacgctgaggcaggagaatggtgtgaacctgggaggcagagcttgcagtgagccgagatcgcaccacggcactccagcctgggcgacagagcgagactccgtctcaaaaaaaaaaaaaaaaaaaataggtgaatgaataaataaacagtggtgcttccagataatgagatcttattcagtgctaaaaagaaacgaagctgggtaaggtggctcatgcctgtaatcccagcactttaggaggtcgaggcgtggggaccacttgagctcaggagtcgaaggccagcctaggcaacatagcgagaccttgtctctaccaaatatttaaaaattagccaggtgtggtggcccaggcctgtggtcccagctacttaggaggctggggtaggagaatcatttgagccctggaggttgacgctgcagcaagctgtgctcacgccactgcaatccaacagagtgagatcctgtctcaaaaaaaaaaaaaaaaatgctgggcgcagtggctcaaacctgtaatcccagcactttgggaggccaaggtgggtggatcacctgaggtccagagtttgagaccagcctgaccaacatggagaaatcccatctctattaaaaatacaaaattagccaggcatggtggcgggtgcctgtaattccagctactcaggaggctgaggcaagagaatcgcttgaacctgtgggggaggggtgcggaggctgcggtaagccgagatcgctccacttcactccagcctgggtgaaagagcgagactctgcctcaaaaaaaaaaaaaaaaaaaaaaagaaagcccttaagccacgaaaataaccttaaatgcttatcaccaaatgaaataaaccaacctgaagatgctgcatactgaatgactccaactataggacattctggaaaaggctaaaccatggagacagtaaaaagatcagcagtggatagggcttggggaaaaggagggtggcatgaatagagagagcacagaggacttttagggcaacgaaactactctgtctgatattataatggtgaatatggctgggtgcagtggctcacacctgtaatcctagccctttgggaggccaaggtgggcagatcacgaggtcaagagatcgagaccatcctggccaacatggtgaaaccccatctccaataagaatacaaaaattagctgggcgtggtggcacaggcctgtagtcccagctactcgggaggctgaggcaggagaatcgcttgaacccaggaggcggaagttgcagtgagccaagatcgcaccactgcactccagcctggcacacagtgagactctgtcccccccaaaaaaaaaaatagtgaatacatgtcattatacattcatcaaaacttataaatgtccaacagcaagagtcaactcctagcctgggcaacatggcaaaacccggtctccaccaaaaaaatacaaaaattagccaggcgtggtgcacacatctgtaatactagctactcaggaagctgaggtgggaggatcaattgagcctgggaggttgaggctgcagtgagccatgatcacgccacactgcactgcagcctgggtgacaaagaacaatcctatcccctccccgccacacacacacacacacacacacacacacacacacacaggccaggtgcagtggctcacacctataatcccagcactctgggaagccaaggtttgagcccaggagtttaagaccagatacaacaacatagcaaaacactgtctctacaaaaaatacaaaaactagccaggtgtggtagtgggcacctatggtcctagttacttgggagggccgaggtgggaggatcgcttgagcccaggaggtagaggttgcagtgagcggagatcacaccactgcactccagtctgagagacagggcgagataccatctcaaaacaaacaaacaaaagaagtgaatcctaatgtgaactatggctttaaagggataatgaaggttcactgattgtaacaaatgcactgcttgggtaaacgatgttaatagtgggggaggctgtgcaagttgtgtgcgtatggagcagggtgatatacaggaactctctgtactttctgctaaattttgctgtgaacctaaaattgctctaaaaattagtctataaaaaaatttaaaaatggcctagtgtggtggctcacacctgtaatcccagcactttgggaggcagacacgggcggatcacgaggtcaagaaatcgagaccatcctggccaacatggtgaaaccctgtctctactaaaaataaaaaaaattatctgggcatggtggcgcacacctgtagtcccagctactcgggaggctgaggcaggataattgcttgaacctgagaggcagaagttgcagtgagccaagatcgcgtcactacactctagcctggtgacagagcgagactctgtctcaaaaaaaaaaaaaaaaattaaaaaataaatgttgcttagcgcaatggctcacgcctataatcccagcattttggaaggccaaggtgggcagatcacctgagtccaggagttcgagaccagcctggccaacatggtgaaaactcgtctctactaaaaatacaaaaattagccagacatggtggcagatgccttaatcccagctactcgggaggctgaggcatgaggactgcttgaacccgggaggcggaagttgcagtaaactgagattgcaccattgcactctggcctgggcgacacagtgagactccggctaaataaataaataaataaataaaggtcagtggttcacatcctttgaccaagcaagttcccaagaaacatttgcatggacagtcccaaagcactgttcataatggaaaaaacaaggaagtagaaataaaaccacacacacattggaaaaaatcccagtgcctgtcaaaagtgatttgttaaataaatatggtccacccatacaatgaatgtctgctgggtggctgcctcgttgtgtgtgtgggtttttttttttaaagaacaccagcaaaatgaaaacaagcagatgctaaaacagtagctatgatttcatcctatttacatattttaaaatatgctggtaggggcagggcgcgatggttcatgcctgtaatctcagcactttggaaggccaaggtgggtggatacctgaggtcaagagttcgagaccagcctggccaacatggcgaaaccccgtctctactaaaaatataaaaattggctgggtgtggtggcacatgcctgtaatcccagctactcaggaggctgagacaggagaatcgcttgagcccaggaggcggagatggcagtgagccaacattgtgccactgcactctagcctgggtgacagagcaagaccccgtctcaaaaaaaaaaaaaaaaaaaaagaaatgctggtaggttcattgaaaaatactttgtgaggcagggactcccctacagctggacaatagtggttatgtctgaggggtgagatttgggggagcttttgcctctaagcaagggttctgctgcctaccagaggcctagaacaatacctcacacccccatcattctgtctgtctctcattcaggctttttttcttttttttttttttgagacagagtcttattctgtcactcaggcacccaggctggagtgcagtggcacgatcttggctcactgtaacttccacctcccaaattcaagtgattcttgtgcctcagcctcccgagtagctaggattactggcatgtgccaccacacctggctaatttttcttttcttttcttttcttttttttttttttttttgagacggagtcttgctctgttgcccaggttggagtgcaatggtgcaatctcagctcactgcaacatctgcctcccaggttcaatcgattctcctgcctcagcctcttgagtagctgggattacaggcatgtgccaccacacacagctaattttgtatttttagtagagacacggtttcaccatgttagtcaggctggtcttgaactcctgacctcgtgatccacccgcctcagcctcccaaagtgctggaattacaggcgtgagccaccgtgcctggccaattttttgtatttttagtagaaacggggtttcaccatgtttctcaggctggtcttgaactcctgacctcaagtgatatgcccccctcagcctcccaaagtgctgggattacaggcatgagccactgcacccagccttttttttttcctttttcttttattaatattattattttcttcgagacaaggtcaggctctatcacccaggctgaagttcagtggtgcaatctcggctcactgcaacctctgcctccagtgctcaagcgatcctccacctcaccctccggagtagctgagactgcaggcacgcaccaccacggccgacaaacttttgtattttttctagagatggggttttgccactttgcccaggctggtctcaaactcgtaagctcaagcaatctgcctgcctcaacctcctaaagtgctgggattacaggcgtgagtcaccatgcccagcccctattattattttttgagatggggtctcaccatcttgcccaggctgatcttgaactcatgggctatggtgatcctcctgctgcagcctcccaaaatactgggattacaggcagaagcactgcacccaggctttttatctttttttgatactgggtcttgctttgtcacccagggtggagtatagtagtgtgatcacagctcactgcagcctcaaattcttgggctcaagtgatcctcctgactcagcctcccaggtagctgggactacaggcatgtgccaccatgcccagctaattttttaaaattttttgtagccacggggtctttctatgttgcccaggctggtcttgaactcctggcctcaagggattttcccacctcggcctcctaaaatattgggattacaggtgtgagccaacatgcccagctaattattttccttttgtagagatggggtctccctaagttgccctgctagtctaaaactcctaacctcaagagatcttcccaccttggcctccagagtagctgagagtgtaagtgcacaccaccactaatttttaaattttttatagagatgggcatctggctttgttgccccgtcctggtcttgaaccttcttgcttcaagcaatcttcctgcctcagcctcccagtgtgctaggactgcagatgttacaaccactgggcctggcctcactcagtgttttcatctcagttcctctctctcttccccttcaatttttcttttcttttctttctttctttttctttttttaaagacagaatctcactctgtcgcccaggctggagtacagtagcaggatctcagctcattgcaacctctggcttctgggtttaagcgatgctcctgcctcaacttccctagtagctgggatgacaggcacatgccaccacaccaggttaattttttgtatttttagtagagatggggtttcaccatgttggccaggctggtctcaaactcctgacctcaaggaatccgcctgcctcagcctcccaaagtatggggattacaggcatgagccaccgcacctggctttcctctttcaatttatttttgtttttatttttattgagacagagttttgctcttgtcgcccaggctggagtgcagtggcgcaatatcggctctctgcaacctctgcctcccgggttcacgtgattctcctgcctcagcctcccgagtagctgggattacaggcacccaccaccacgcacagctaaatttttgtatttttagtagagacaaggtttcaccatgttggccaggctggtcttgaactcctgggctcagatgatccacctgccttggcctcccaaagtgctgggattaaaggagtaagccactgtgcctgggttttccctttcaatttctttcttttttcttttttccttttttttttttttttttttttgagatcgagtttcgctctttttacacaggctagagtgcaatggcatgatctaggcttactgcaacctccgcctcccgagttcaagcaattctcctgcctcagcctcccaagtagctgggattagaagcatgtgccaccacacctggttaatttgtatttttagtagagatggggtttcttcatgctggttaggctggtcttgaactccctacctcaggtgatccacccaccttggcctcccaaagtgctgggattacaggcgtgagccaccatgcccagcctcaatttcttaatcaatatatatttccccactatcttgttctcccccgatctctctctcaggcttttgctcctctctgccccactcctaatcttgggggttcatggatgggggttcctgcactcaggtcaaggttcacacctggctcagggattccctagacctttgtcacatttggaatctcaagctcctggagaggcagggtgacctcagaagctctcttccacccacggccatagacagaggcagccagggagccccgtgccccacaagccaggggccaaatccttggccctgctgctcccagcggcagagctcgagacgcgtgctgcacaaccacagccactcaccagcgtccagaggacatagatggtgaagagggcgatggtgagggcaatgagacccacggcctccagctggctgtggagccggaggtggtcctgggccccgcgcaggcacaaccagcctgagatggcggccagcggtgtgatgaacaggaaacacaccatgtcgcagcacagtgtccgcttctccgtccgcggccccgggtccttcagccactgcaggggagaggatagggggcagaggagagggggcagagaaggggctactgagggggaggggtaaggacctccaggcctaggcctccctctgtcctttccttctttcttttttttttttttgagacagattctcactctgttgcccaggatggagtgcaatggtgtgatctcggctcactgcaacctcgaccttctgggtttaagcaattctcctgtctcagccaccggagtagctgggattacaggcaagcgccaccatgcacggctaattttgtatgtatatatattttttgagacagagtctcgctctgtcagccaggctggagtgccgtggcacgatctcggctcactgcaacctcaacatcccaggttcaagcgattctcccacctcagcctcccgagtagctgggattataggcaagcgccaccatgccctgctaattttgtatttttagtagagatggggtttcaccatgtttgtcaggctggtctcgaacttgtgaccttaagtgatctgcccacctcggccttccaaagttctgggattacaggtgtgagccaccacgcctggccctttccttctttcaaacatttattgagcccatgaggagccaggccctgccaggtgctgggcacatttacccccattttacagatggggaaactgaggcacagaggaattaactcaagtgagcaaactcacacagctacatagtccacaaagctggggttccaacctgggaagtcttgctccagggccgaagcgtctttggctactaatctactacgcttggccttccccagatgacaggccaaaagaaatgggctaaaaaaaaaaaaaaaaaaaaaaagccctggtgtggtggttcacgtctgtaatcctagcactttggcaggccaaagtgggtggatcacttgaggccaggaggtcaagaccagcctggctaacatggagaaaccctgcctctactaaaaatacaaaattagctgggcgtggtagcacgcacctataatcccagctactcaggaggctgaggcaggagaattgcttgaacccaggaggtggaggttgcagtaagccaagatcgtgccactgcactccagcctgggtgacagagtaagactctgtctcaaaataataataataataataataataataataataataataagttctttcatttctttgatttttttgtagagacagggtcttgctgtgttgcccaggctggtcttgaactcctggcctcaagtgatcttcccaccttggcttcccaaagtgctgggattacaggcatgagctaccacacccagccaagaaatgggcttaattcatgaaattctggtggatgagacagaaagggcccctgccctcccatgctggcagtggaggtatgaaatgggtgaacggtcacatggggcaaggccttgccaaggaggtgacattgaagagaacggaatgaacagaaggaaccacgtgaagaatgggggagatggggctctaggctgcaggggcggcagatgcaaaggccctgggatagggggaggcggcctagacaagatgtgtggggagggggctgtgtggctgtagcacggagaccaaagtgggtgtgggagggtgtgtgaaggggctggacctccctcccacttttctccctacactctggctcctaggtgggccaggggcttttctagggtttttgttttttgttttttgagacggagtttcgctcttgttgcccaggctggagtgctgtggtgcaatcttggctcactgcaacctccgccttccgggttcaagctgggattacaggcccccgccaccatgcccagctaatttttgtatttttagtagagacggtgttttaccacattggccaggctggtctcgaactcctgaactcaggtgatccacccacctctgcctcccaaagtgctgggattgtgagccaccacgtccagccttggttttttttttttttttttttttttttttttttttgagatagagtctcaatctgttgcccaggctggagtgcagtggcgctatctcaactcactgcaaactccgcctcccagctttaagtgattctcctgcctcagcctcccaagtagctgggattacaggcatgcgccaccacacctagctttttcctcatcgtttgagacagagttttgctttgtcacccaggctggagtgcagtggcttagtctcagctcactgcaacctccgcctcccgggttcaagcaattctcctgcctcagcctccctagggttcaagcaattctcctgcctcagcctccctagggttcaagccagtctcctgcctcagcctccctagtggatgggattataggcacccaccaccatacctggctaatttttttttttgagatggagtctcactctgtcgcccaggctggagtgcagtggcctgatctcagctcactgcaagctccgcctcctggattcaggccattctcctgcctcagcctcccgagtagctgggactataggcacctgcaaccacgcccggctaattttttgtatttttagtagagatggggtttcaccatgttagccaggaaggtcttgatctcctgacctcgtgatccgcccgcctcggcctccccaagtgctgggattacaggcatgagccaccgtgcccagcccacacctggctaattttgtatagctagtagagacagggttttcccatgttggccaggctggtctttaactcctgacctcaggtgatccatgcatcttggcctcccaaagtgctaggattacaggcgtgagccaccgtgtctggactttttttttttttttttgtattttttgtatttttagtagagacggggtttcaccatgttggccaggctggtctcgaactcctgacctcaagtgatctgcccgcctcggcctcccgaagtgctgggattacaggcatgagccaccgcgcccggcagcttgttccttttcatctctcaggcctcagctggggggttcacctccttttgaggccttgcctgacaccccaagttgccccaccccctgtgacatgtttttcccttactgcactattgctcccagaaaccagttgcttcgttgattttttttttttttttctgtaacctcatatcagaagcgatgctttgaagtccagattaaagttactggactttaatctccatgagtgcccagccctacgtgtcttgttggtggctgggtccccagtgcctaacagagtgctgggcatgctggaggtgcccaggaaatctctgctaatgaaagacacaggctgggagcggtggctcatgcctgtaatcccagcactttgggaggctgaggtgggcagatcacttgaggtcaggagttcgagaccagcctggccaacatggtgaaaccgcatctctactaaaaatacagaaaattagctgggcatggtggcgcacgcctgtcatcccagctacttgggaggctgaagcagaagaatcgcttgaacctgggaggcagaagttgcagtgagccgagatcgcaccactgcactccagcctggacaagagttagactctgtctcaaaaaaaagaagaaggagaaggaagaagaagaaagaagaagaagaaagactgaatgaaaacagggagaggttaatgggtctgggagctcttaaaccctaggcctggtttctgacacaccatcagcagacccacctggtggacaggggcggtagggagttctgccctaggaggaccaccagattgcccggggcagctcctgcctttggcccccatgtctgccctctccccactgcccaccgcagtctcagactcttaagggtacctctgtgaggggtcgaggccgtttctccactgcaaactccgtgtggcacagctcgcagtagctggtgttagatgaggaaagccacttctccagacagctcttatgcacggcacccagcgtgccggtgcagccacacggggacagcaagcactccccgttcgctccctcatggcagatccggcagaaaggaccatcactggacacagagataggacccatgagcaatgattgggctttctgtctatacctgcttcactacccactggatcacaagctcacccttaccccatgctgccacttagtgaactcctactcatccttcaatgcccagctctaaatgtccttccctttgggaaggagatgcagggaaggtaaccttgcgaagccttcccagactcccacaggtggagtgatgtgttcccttcccagggaccctgcagcaccctctcagacccaagatgggcatctgttatacccgcccccatgtcctctccaaatttccctaaaatacccaccctgattgtcctgcacaacttccccaccctcaactctttttttttttttttttttttttgagacagagtctcgctctgtcacccaggctggagtgcagtggtgcgatctcggctcactgcaagctccgcctcccgggttcacgccattctcccacctcagcctcccgagtagctggaactacaggcacctgccaccacgcccggctaattgtgtttttgtatttttagtagagacggggtttcaccgtgttagccaggatggtctcgatctcctgatattgtgatccgcctgcctcaggctcccaaagtgctgggattacaggcgtgagccaccgcacccggcccccaatcctcgactcttaatcctcaaagaccagctgggtgaggtggctcattcctgtaatcccagtactttgggaggccaaggcaggaggatcatgaggtcaggatttcaagaccagcctggccaacatggtgaaaccccgtctctactaaaaatacaaaaattagctgggcgtggtggtaggtgcctgtaatcccagctactggggaggctgaggcaggagtatcacttcagcctggaaggcagaggttacagtgagccgagattacaccactgcactccagcctgggtgacagagtgaggctccgtctcaaaaaaaaaaaaaaatcctcaaggactagggcagagcagacaacactcctcatgacctcaggcctcatactggaccagtcagaacaccaggccgggagcagtagctcatgcttgtaattctagcactttggaaggctgaagcgggaggatcacttgagccgaggagttcaaggccagtgtgggcaacctagtgagatctcatctctataaaaaaaaaattttctttttttttttttgagatggagtctcgctctgtcatcaggctggagtgcagtggtgtgatatcagctcactgcaacctccacctcccaggttcaagcgattatcctgcctcagcctcccgagtagcctcagcctcccgagtagctgagactacaggcacatgccaccatgcccagctaattttttttttttctgtattttagtagagacggggtttcaccgtgttagccaggatggtctcaatctcctgacctcgtgatctgcccgcctcagcctcccaaagtgctgggattacaggcgtgagccaccacgcccggtcccaaaattttttttaaagacttatcttggcgtggtggtacatgttgtggtcccagctacttgggaggctgaggcaggaggatcacatgtgcccaggagttcaaagctccaatgacccataattgtaccactatactccagcttggacaacagagtgagaccatttgaaaaaaagaaaaagaaaatagaacagcacgcacccctgctcatgcaaccaactcaggcttgtatgataccatcagagtcaccgataatctattcctaaaattctttgtttccccgtaaactccagaactgtcggccacaaggctgacagaagcctggagctcctgcagctgcctagtctgtgtggagcctgtgaatgatgccagcacagaggagagcagagccaagagacagggaaaggtagatttttttttttcttttttttgagacagtgttgctctgtcacccaggctggagtgcagtggcgcgatctcggctcactgcaagctcgacctcccaggttcatgccattctcctgcctcagcctccagagtagctaggactacaggcgccggccaccacgcccggctaattttttgtattttttgtagagacggggtttcaccgtgttagccaggatggtctcgatctcctgacctcgtgatccacccgcctcggcctcccaaagtgctgggattacaggcgtgagccactgcgcaaggcctgggaaaggtagattcttaaggacatctttgcgggcccctggatctaatcacacctgaagcccgtgctacctgagaaacctgtgcatccagagagaagtgctcacctgctcctctgcccttgtgagggggaaatagaaataaaaagcatctgcagaaagctgcctcggaaaagtctccagccctggcccagtctctggggatgccgggtccttcccagggcagctcaggaggcagggggcgtggcccagaggccaaacagccatgagtcactgtttcccaaacatttctggccagaaggcagactgtgaggtcacacaaagaagagctattttccagacaacgccaatttcctctcagagagactgtatttttttttctttcttttttttttttttttttgagtcacccaggctggagtgcagtggtgcaatcacagctcactgcagcctcggactccctagctcgagcgatcctcctgcctcagtctcccgagtagctgggactacaggtggcaccacgccacacagctaatattttttaactttttctagagaggggggtctcactatgttgaccaggctggtcttgagcttctgggctcaagcgatccttcagccttggacttccaaagtgctgggactacaggcatgagcgaccacgcctgcctggaaatgactgttttctatccttttctcagattctcatgctgcggggtggagttgggcggctttaaaaagagcccaacaggctgctcatggctgctttctcaacagtcctgtccctggactgctatttcctcctgcaatggcaaaagggcatgcctgcctgcctcctttctgaacccataccccgatcccaccctcccccaagtacacacacaaacaaagttaacaaaaaaggaaccctttgtccggaaaccaacccagggaaacagaagtgacgagaatcttgaggaagaatcatgtcagtttggagcttgttctgggaaactgtgaaaaagtttgggagagcaaattcagagaagaggccaggcacagtggttcatgcctgtaatcccaacactttgggaggccgaggtgggtgggtcatctgaggtcaggagaccagcctgactaacatggtgaaaccccgtctctactaaaaaaatacaaaaattagtcgggcatggtcggggcgggggggctgtaatcctagctacttgggaggctgaggcaggagaatcgcttgaacccaggaggcagaggttgcagtgagctgagatcatgccactgcactccagcatgggtgacaaagtgagactctgtctccaaaacaacaaaacaaaacaaaaaaacaaattcagagaagagaggaaaaaaaaagccttaatatttgttgagcacggccaggcgcggtggctcacgcctgtaatcccagcactttgggaggctgaggtaggtggattatgaggtcaagagatcaagatcagcctggccaacatggtgaaaccccatctctaccaaaaatacaaaaattagctgggtgtggtggcgcgtgcctgtagaaccaggtactcaggaggctgaggcaggagaatcgcttgaatccgggaggcggaggttgcagtgagccgagatcacgccactgtactccagcctgagtgacaaagcaagactctctaaaaaaaaaaaaaaaaaaaaaaatttaaaaagaggctgggcacggtggctcacacttataatcccagcagtttgggaggccgagacgggcagatcacctgaggtcaggagtttgagaccagcctggccaacatggcgaaaccccgtctctgctagaagtacaaaaactagccaggtgtggtgacgggtgcctgtaatcccagctactcgggtggctaaggcaggaaaatcacttgaacctgggaggcggaggtttcagtgagctgagactgcgccactgcactccagcctgggcaacaaaatgagactctgtttcaaaaaaaaaagagagatacagtggtgaagtaatttgtcccaggtcactctgggagagagagaggtgtccactcagggtcagggccgaggcactgagcccacagcctgcactcctgaccgccccctatactgcctcccaaaagtgtgttacttgacaacatttgaccttcagatttcacataataatctggaatttcagcttttcctaaagaatcagacccggccaaagctaggcctctgtttccacaaggcgataactgtttgtgtctctttctctatttacccacttggccctctgtcaacggttggacttctaaccccaggctgggagaaactcactgcgcccagagagaagaggcaacaaaggccaggatatccacgcagtcaccactcacctcggtgtgtccaaggcacggatgacggtggagaggagccggccatcccttgaagtcacctgtgccacatactggggcggtccgaggcccgtagcctccacgaccttggagaaggcagggctgccggagcagtcacacagggagccggggaggtggcagcagtcacccgtcgtcatggccaccgggagccccgtatcctcagggcctgaggcccatggttccaggagcctgggaacaggccagtgcggaggttaggggcaaggttaatgagcctgacggactaaggtttgagtcccctcttgtcaaggctgtagggaccactagaccatttacatctctgagcctcagtttgcaccatctgtaaaatgggcctctgtagggccagtgaggattcaaggagacgatgcatgtaactcagcacaaggctggtatacagcaggagcttgggttgtattatttctcactctcctaagaaaagctatgcttccctggccaggcgcggtggctgacgcctgtaatcccagcactttgggaggctgaggcgggtggatcacgaggtcaagagatcaagaccatcctggccaacatggtgaaacactgtctctactaaaaatacaaaaaaaaaaaaaaaaaagaaaagaaagaaaaaagtaaaaaaaaaagaaaagctaggtttcccattctggctaacacagtgaaaccccatctctactaaaaatacaaaaaattagccaggcttggtggcacgcgcctgtagtcccagctacttgggaggctgaggcgggacaatcgcttgaacccaggagggggaagttacagtgagccgagatcacgccactgcactccagcctgggcgacagagcaagactctgtctcaaaaaaaaaaaaaaacccaaaaaaaacaggaaagctaggcctggccaggtgtggtggctcatgtctatagtcccggtgctttgaaagccaaggtaggaggattgtttgagccccaggagtttgagaccagcctaggcaacacatcaagactctatctttataaaaaatgagaaaattaggccaggagcagtggctcacacctgtaatcccagcactttggattcaagacaatccgcctgcctccgattgcctcagctcaggagtttgagaccagcctgggcaacatggtgaaaccctggctctactaaagaaaaccaaaaatattagccaggcatggtagcacaagcctatagtcccagccacttgtgaggctgaggtgggaggatgacttgagcccaggagtttgaggctgcagtgagctatgacggtgcccacagcactcctgcctatgccacagagtgagaacctgtctctaaaaaagagaagacaagaaaagctaggcctcctcttaccctcaaagcctccagggccaggaccacctttcaactaatatcacctttccagataaggtatcagaaccagttcttttttttttttttttttttgagacagagtttcgctgtgttgcccaggctggagcgcagtggcacgatctcagctcactgcaacctccacctcctgggttcaagcgattctcctgcctcagccccccaagtagctgggactacaggcatgcaccaccatgcctggctagtttttgtatttttatttatatttatttattttttttttaagatggagtttcactcttgtcgcccaggctggagtgcaatggcatgatctcggctcactgcaacctccaccttacgggttcaagcgattctcctgcctcagcctcccaagtagctgggattacaggggcccaccaccacactcagctaattatttatttatttatttatttatttatttatttattttttgagacggagtctcactctgtcgcccaggctggagtgcagtggcgcgatctcagctcactgcaagctccacctcctgggttcacaccattctcctacctcagcctcctgagtagctgggactacaggcgcccgccaacacacccggctaattttttgaatttttagtacagacggggtttcaccatgttagccaggatgatctccatctcctgaccttgtgatccacctgcctcagcctcccaaagtgctaggattacaggtgtgagccactgcgcccggcaattatttttatttttatttttattttttatttttatttatttatttatttattttttttttgagacggagtcttgctctttcgcccaggctggagtgcagtggcctgatctcagctcactgcaagctctgcctcccgggttcacgccattctcctgcctcagcctcccgagtagctgggtctacaggcgcccgccaccacgcccggctaattttttctatttttagtagagacggggtttcaccgtgttagctaggatggtctcgatctcctgacctcgtgatccgcccgcctcggcctcccaaagtgctgggattacaggtgtgagccaccgcgcccggccaattatttttatttttattgtattttatttatttattttttgagatggagtccggctctgttgcccaggctggagtgcaatggcgcgatcttggctcactgcaacctccgcctcccgggctcaaatgattctcctacctcagcctgctgagtagctgagactacaggcatgcgccaccatgcccagctaatttttgtatttttagtagagatggggtttcaccattttggccaggatagttttgatctcttgaccttgtgatcctcctgccttggcctcccagagtgctgggattacaggcatgagccaccacgcccggctaatttttgtatttttagtagagatggggtttcaccatgttggccaggatggtctcaaactcctgacctcaggtgatccatctgcctcggactcccaaagtgctgggattacaggtgtgagccactgcacccggcccggcagagaatttcattgaagaaacaagggccctttctggagacctccttgaagccaatacaggtgccctggagccaaggatctctgttcccagcttgtccaacccccaagagctacaatgtccagagcccctgcagcccctaaagtgttcagaaagtccaagcaagagaggcaatcaagtactcagcgaagtattcccacccccaccccaagtcagcttgtaaactgccaatcaaaatccgagccctgggccaggggaagttgttcatacctgtaatcccagcgctttgggaggtccaagcaggaggatcacttgaggccaggagtttgagacgagctagggcaacatagagagaccctatctctctgaaggtttttttgaattagccaggcatggtgctgaaagcctgtagtcccagctacttgggaggctgaggagggagcctcaacctcttgagcccaggagttcaaggctgtagtgagctatgatcacaccactgcactccagcctgggtaacagagcaagacccagtctccagtctctaaaacagaacaaaagaaagcaagcaaacaaacaaacaaaaaaacaaatctgagctccaaagtggggaggtgaaggaacaggggagcaattactaactcttgcgctaggacggttcactgctggataaatgccctctaaacagctcagccagcagccttcctggcctcacatgttcttctgagcatcatagtcaggcctctgcaggccagataagcaagtattgcccaaaggcagggacccaagaggaagactgcaggcctgagataacacccacagggcagtggccgggcctgacacagggtgcctgctgctctccctcccaagtccctgcaaccagaaccttaagctcagaggccaaaggggaagcggctgggctctttacgggaaggcaggcagaggcgagtcctttcctccagcccagcccttctgaggctaggtctttacatttctttttttttaagacagggtcttggccgggcgtggtgactcatgcatgtaatcccagcactttgggaggccgaggtgggcagatcacctgaggtcaggagttcaagacgagcctgaccacatggagaaaccccgtgtctactaaaaatacaaaaaaattagccaggcatgttggcgcatgcctgtaatcccagctactcgggaggctgagacaggagaatcacttgaacctgggaggcagaggttgcagtgagccgagatcgcaccattgcactccagcctgggcaacaagagtgaaattctttctcaaaaaaaaaaaaaaaaaaaaaaaaaaaaaaagacagggtattggccgggcgtagtggctcatgcctgtaatcccagcactttgggaggccgaggcgggcggatcacctgaagtcaggagttcgagaccagcctggccaacatggcaaaaccccatctctactagaagcacaaaaattacttgggcatggtggcgggcaactgtaatcccagctacttgggaagctgaggcaggagaatcgcttaaacctgagagatggagtttgcagtgagctgagatcacgccactgcactccagcctgggtgacagcaagacttcatccccccgcccaaaaaaaaagacagggtctcactctgttacccaggctgaaatgcagtggtgtgatctcagcttactgcaacctcaggctcctgggttcaagcaattctcctgcttcagcctgtcgagtagctgggactacagctgtgtttcaccacacccagctcgtttttgtatttttagtagagacagggtttcaccacgttggccaggctggtctccaactgctgatctcaagtgatctgcccgcctcggcctcccaaagtgctgggattacaggcttgagccaccacccctggcctggtctttacatttctgcaaataactggatattacaggaactatcccagctcctgcatgtggtgttctaatatttcttctatcagggagaaaaaaaaaaaaccacaggtaaatctcttaatgcaaggcctgcaaaccaccaaaattatactagcagcttctatctattaagaaccagacactatgccaagcaatctccatacatagtcatcatctcactgaactcgaaacagttgttataagtgtctccttcaaaggtcaccttcctggagaagccttctcgacaatgctgtctggggcctggcgcattggctcatgcctgtaatcccaacactttgggggctgaggtgggaggatcgcttgagcccaggagtttgagagaagcctgggcaacataccaagaccccgtctctacaaaaaatacaaaaatgagccgggtgtggtgatgtgcgcctgtaatcccagctactcaggaggctgaggtgggagaatcgcttgcacccaggttgaggctgcagtgagccatgatcacacaactgcactccagcctgggccacagagcaagaccctgtctcaatcaatcaatgaagtgccaatggggtccacttgattccactcgtggcatgtgtccctgtctgaaacattctacttattcacctacgtatttagccacgtctgttgtcctaccctacagtgaattctgtaaaaaagagaccctgtcagattgcctcccgctgtccccagcacctggccctctgtctagcccagagctgctgcatttctggttgctgctgcagtcattttttttttttttttttttttgagacagagtctcgctctgtcgcccaggctggagtacagtggccgatctcagctcactgcaacctccacctcctgggttcaagggattctcctgcgtcagcctcccgagtagctgggattacaggcacccaccaccatacccggctaatttttgtatttttagtagagacagggtttcaccatgttggccaggccagtctcgaactcctgacctcgtgatccgcccacctcagcctcctaaagtgctgggattacaggcatgagccactgtgcctggccatgttgtagtcatttctcaatcctcactccgtttaagaacagcgtgagagagccacatctcttgaccctccgatcctggtcggccagcccctgtggtgggcatcagagatatttagaggctagaggtccactcaaaccacagaggcccaggcctggaagaggccaaacttgaggctggacacaaagagagggtgactgcaagtcggactcagctctgaggctgctgaaatgggagagtgatctgatggctccagcaaacttggcccagtgcccaggagatttatttctcttctttcttttgtctggtttttttttttgttttttttgtttttttttttttgagatggagtttcactcttgttgcccagggtggagagcaatggcaccacctcggttctctgcaacctccgcctcccaggttcaagcgattctcctgcctcaaccaccagagtagctgggattaccggtgccctccacccacagctggctaattatttgtatttttagtagagacggggtttcaccatgttggccaggatggtctcaaactccttatctcaggtgatccacccgccttggcttcccaaagtgctgggattacaggcatgagtcaccgcgcctggcctatttcttttctttcttttgtctgtttttttttttttttcttttgaggcagggtctcaatctgtcacccaaaaggctggagggcagtgtagtaatcacagctcactgaagcttccaccgcccccaggttcaggtgatcctcccacctcagcctcctgagtagctctgcacaccaccacatccagctaatttttgtatttttttgtagaaatggtgttttgccaagttgcccaggctggtcctgaactcctggcctagtgatctgcccgccttggcctctcaaagtgttgggattacaggcatgagccaccacgcccggcctggagatagatctcattgagtcttcacaacaaaccaataattacaccctatgatggggaaagaggctgaagctcggagagaggcacctactttcccaaggtcatatagctaggaaggggtggtgtcagaatttgaacttaaaacagtccagggagtggttctggacctcaagagacctgggttctttaactcctggccctcctggctatgccaccgatgctgggtgtcctggttcaagtcactttgcttctctgggcctcattctaatgatggagctggtggactctgtccgtggaggggtctcctgagaaggagcctccaggctgaattcatccagtaaagctcacccttagctaggcttgtttagggtggcactgaggccccccagtcttttccatacctgcccaggctccttttcctgaaggtaggaaacagagggcagaggaatcagagggccctaaaactccctacattgtggtctcaggcagctgttttactctctcagcctcagtattatcatctctaaaatgagtgttacaggccgggcgcagtggctcacgcctgtaatcccagcactttgtgcactttgggagttcaaggaaggtggatcacttgaggccaggagttcgagaccagcctggtcaacatggtgaaaccccgtttctgctaaaaagacaaaaattggccaggcacggtggcgggggcctgtaatcccaactacttgaccagggtgaggtaggaatcgcttgaatctgggaggcagaggttgcaatgagctcagatcgtgccactgcattccagcctgggcaagagagagagactctgtctaaaaaaaaaaaagacggggagtcataatgatatgtagttcataaattagtaaaaaattaagaagttaataactattagctcttattataattactatcatcagcttacagagttgttgatgagaggtcacacagtcaaccctggcacacacagtaagtgctcaataaaagctctattaatattttttagggtaaatgtggaggttgttattgcattcattcctccctgcatgagaagcaaggttccaatcccagctctactccttatgtgctgtgtggccctgggcaagacacttaacctctttgagcctggactctctcaactgtataacaggggacatttctactgcttccacctactcagtatggtttcaaaagaactgaatgagctcaacatgcccatttgactaccccgttttgagcacccacatagcacagggcatcctgtttcagcatctttgtgcaaagtggctgggtcattatattataacttactattttgcaggcagagccgctctgagaaggaggttggggaagggcattggccacttagcagttgcctactgtgtgtcaggcgttttctgcaccagccacctcctgaatcctcccagaagccccatcaggttggcaatgggatgacccagtttcacaggtggggaaaccgaggctcggagaggcgcctatgtgtgccggaccccggagacctcccaccggccttgacacgggaactgaggtccccgcgtccccgagaaggctgtggccaagggatcgagcccagccgtcccgcccgggtgccgagctccggcctcgaacccggggccggcccgcggactggcgtcctccggccctacctgcaggcccgtgcctacctgatccgcggccgggccgggcggccgcacaggcccctcggttcgcctcggccccggtcccggcccggcccggcccgtcggcgccactagctccgctccggccggcacctgcgtccgggcaccgcccgccgagccgacagcgccgcggaccaatagcgaccgcctctcgcctgcattcgccaatcgccttgcacgtcccgccctaagaggcggggccggaggccacagggacgacttgggccgcacaggccccgctgtgccgcagctgctggctccgcccctgccgcgtcttggctccgcccccagctccggctccgccccagcactggccccgccccagccccgccccaggcacgagggggtgctgctgcgccacctgcagacggccagcgtcctctaataaataaaacctctgcagaatttaacttttttttttttgagactggccgggtgcagtggctcatgcctgtaatcggagcactttgggaggccgagacggaaggatcgcttgaggccagatgttggggaccagcctgggcaacatggtgagttcccgtctctacaaaaaatttaaaaggatgggcgcggtggctcacgcctgtaatcctagcactttgggaagccgaggcgggcggatcacgaggtcaggagatcgagaccatcctggctaacacggtgaaaccccgtctctactaaaaatacaaaaaaattagccgggcgtggtggcgggcgcctgtagtcccagctactcgggaggctgaggcagaggaatggcgtgaacccgggaggcagagcttgcagtgagccgacatcgcgccactgcactccagcctgggtgacagagtgagactctgtctcaaataaatacataaataaataaataataaaataaaataaaataaaagttagccaagtgtggtggcccaggcctgtagtcccagctgctctggaggctgaggcaagaggatcacttgagcccaggagttcgaggccagtctgggcaacatagtaaactcacccacccccatctctaagacagatcaatttttaaaaaaatactgcactatatgttcacttagtataagcacacttttgcacataatcacagtataaccttcaaaatcagaaaattaatgttcatctaatattatcatgtaattcccagagcccattcaaaggccaggtgcagtgactcatgcctgtaatcccagcacttggatcatttgaggtcaggagttcgagaccagcccggccaacatggtgaaaccctgtctgtactaaaaatacaaataattagctgggttttgttgtgggcacctgtaattccagctactcaggaggctgaggcaggagaattgcttgaatctgcaaggtggaggttgcagtgagcggagatcttgccactgcactctaacctgggcaacacagccagactctgtctcaaaaaaaagaaaagaaaagtttccaataaagtcctttaaaaatccaaagtccaggccaggcacagtgagtcatgtctgcaatcccagctctttgggagcccaaggcaggaaggtctcttgggtctaggagtctgagatcagtctgggcagcacagtgagaccccatctctacaaaataaaataaaaatattagccagttgtggtggcatcctcctgtggtcccagctacttgggaggctgaagtgagaggatcaattgagcccaggagttctgggctgcagtgagccattacctcaccactgcattccagcctgggcaacagagcaagatcctgtgtcaaaaaacaaaaaatcccaaatccatcccaggatcaagcattgtattttgttgttaacgactctaatttagtctctctttctggaacattttatcaatcttaccttctctccatgacatcaatatttttcaaaaattccaggctagtaattttgcaggaagtccttccattgctatttgtctaatactttctcatgattttgcatttgtggcaggaaacagatgtgacgttgtgttttcaggatgcatacaatgctgattttgtccactatcgattgtgctaacttggttcaaatggtgtctgccagtttctccagtgtgaggttagtatgttacactgtggtgttttgttgttgttgttgtttttaatattttatttaattttaattttttttttttttttttgagacagagtctcactctgtcacccaggctggagtgcaatggtgtggtctcagctcactgcaacctctgcctcccaggttcaagggattctcctggctcacctcccgagtagctgggattacaggcccgcaccaccacgcccagctaatttttgtgtttttagtagaggcaggtttcactatgttggtcaggctggtcttaaacgcctgacttcaagtgatctgcccacttccgcctcccaaagtgctgggattacaggcaggagccaccacgcccgaccaattttttttttcttttttggcgatggagtctcattctgtggcccagactggagtgcagtggcgccctctctgctcactgcaacctccgccaccggttcaagtgattttcctgcctcagcctcctgagtagttgtgattacaggcccgcaccaccacgtccagctaatttgtgtatttttagtagagatggggtttcgccatgttggccaggctagtcttaaattcctaacctcaggcatgagccacggcacctgactttacactttgttaataagtgctttctggggagatacttcgaaagtaattaaatagcctgttcctcaacacacgccgtttccaagagcttaatatcaattgatgacccttgcctgagtcagttattaccataatagcaaccaaatggtgattttcttttttgagatggagcgttgctctgtcgcccaggctggagggcagtggcgcgatctcggctcactgtaagctccgcctccggggttcacgccattctcctgcctcagccccccgagtagctgggactacaggcgcccgccaccacgcccggctaattttttgtatttttttttagtagagatgggatttcaccgtgttagccaggatggtctcgatctcctgacctggtgatccgccctccttggcctcccaaagtgctgggataacaggcgtgagccgccgcgcccggccccaaatggtgattttctaattccatcttggggcatttccttactaactggctcaacaaactcttccaggctgacttgtcttgtcttttgcctgccccaggcctggactcaaccatttttccgaagagccctggttcattttagtggcgaatgatattttatttatttatttatttatttatttatttatttatttatttagagacggagtctcgctctgtcgcccagctggagtgcagtggcgtgatctcggctcactgcaacctccgcctgccgggttcacgctattctcctgcctcagcctcccgagtagctgggactacaggcgcccgccgccccacccggctgatttttttgtattttttagtagagacggggtttcaccatgttagccaggatggtctcgatctcctgacctcgtgatctgcccgcctcggcctcccaacgtgctgggattataggcctgagccaccgcgcgcagccaattttttattttattttattttgagatggagtctccctctattgcccaggctagagtgcagtggtgcaatcttggcttactgcaacctctgtctcctgggttcaagcgattctcctgcctccgcctcctaagtagctgggaatacaggtgcacgccaccatgcccagctagtttttttgtatttttagtagagacggagtttcaccgtattggccaggctggtctcaaactcctgacctcgtgatccacctgcctaggcctcccaaagtgctgggattaaagacgtgagccactgtgcctggccttaatttttaaataatagagacggggcttgctatgaggcccaagctagttttgagctcctgggctcaaaggatcttcctgcctcggcctcacaaagtggtaggattacaggcgtgagccactgtgcctggcagataatttcatttatttatttattatttatttatttatttatttatttttgagatggagtttcactctatcgcccaggctggagtgcaatggaacgatcttggctcactgcaacttctgcccccaggttcaagcaattctcctgcttcagcctcctgagtagctggattacagtcacttgccaccatgcccatctagaatttgcatttttagtagagacggggtttcatcatgttggccaggatggtgtcaaattcctgatcctagcactttgggaggctgaggtgggtggattacttgaggtcaggagttcaagaccagcctaaccaatatggtgaaaccccatctataataaatatacaaaaattagccgggcatggtggtgtgtacctgtagtcccagctactcaggaggctgagacaggagaattgcttgaacctgggaggcagaggttgcagtgagccgagattgtgccactgcactccagcctgggtgacagagccattctgtctcaaataaataaataaataaataaatacacaaaaaagaaaacaaaaaaaagaaggctgggcacggtgtcttacacctgtaatcctagcactttgggaggccaaagcaggtttatcacatgaggccagtagttcgagaccagcctggccaatgtggtgaaatcccatctctactaaaaacacaaaaattagctgggcatatgcctgtaatcccagctacctgggaggctgaggcatgaggatcacttaaacccaggaggtggaggttgcagtgagccgagacagaatgagactgactcaaaaaaaaaaaaaaaagacccgtctcaaaggaaaaaaaagtaacctggctgggcggtgcagtggctcacgcctgtaatctcagcattttgggaggccgaggcgggcggatcacgaggtcaagagatggagatcatcctggccaacatggtgaaaccccgtctctactaaaaatacaaaaatttagcctggcatggtggtgtgaacctgtagtcctagctactggggaagctgaggcaggagaatcgcttgaacctgggaggcagaggttgcagtgagccgagatctcaccactgcactccagcctggcgacagagtgagactccatctcaaaaaaaaggaaaaaaaaagtattccagaaataagagaaggaatacaatttgcatatcaccattttgtagccgctaatggattatgaagcttggtaatgctcattagcagctgctaatgccacaaaagagggaaacattaatgtaatgtgtcttctaatgtatgtacacgacactagttaggcagcgctcaatccagtcctgactctaatcaaacctttaggtggtttttttttttttttttttttgagacagggtctcactcagttgcccatgctggagtgcagtggtactatctctgctcactccaacctccacctcccaggttcaagtgatcctcctgctccagcccctggagtagctgggattacaggcacctgccaccatgcccagctaatttttgtatttttattagagatggggttttgccatgttggccaggctggtctcgaactcctgacctcaaatgatctgcctgcgtcggcatcccaaagtgctggggttacaggcatgagccactgcacccaccccataaaacatttttaaaaagttggtatacttcttcccagtctccattcattcattcattcattcattcactgtgacagtgtctccctctgttgcccatgctggagtgcagtggtgtgatcacagctcactgcattctctacctccctgactcaattgatcttcccatctcctcctcctaagtaggtgcgtgccaccatgcctggctaatttttgtattttttgtagaaacgtggtttcatcatgttgcccaggctggtctcgcattcctgggctcatgcaatctgcctgccttggtctcctgaagtgctgtaattacagacgtgagccatgctctcagcgtttctttattatttttttagagactgggtcttgctgtgttgcccaggttggactgtaactcctgggttcaagtgatccttctctctctctcttttttcattggcagtttctacttgaaatcctcctgttgccctggcgcggtggctcacgcctgtaatcccaggactttgggagcccaaggtgggcggatcacaaagtcaggagatagaaaccatcctggctaacacggtgaaaccccatctctaccaaaaaaaaaaaaaacaaaaaaaaatcagccgggtgtggtggcatgtgcctgtaatcccaactacttaggaggctgaagcaggagaattgcttaaactcaggaggcgagggggaggttgcagtgagccgagatcaagccactgcactccagcctgggcgacagagcgagactccatctcaaaaaaaagaaaagaaaaaagaaattctcctgtctcagacccagagtagctgggactacaggtcacaccactgtgcccggctgtcttcccagccttttatctgggcattttatccacttcttagagttttctggctcatagctggtactcaataaatgctcagagaagcctcataacttagcggttacacacagttctgggtttgaaacctgtctgcatcttactaattgtgagaccttaggggaatcacttaacttctgtaaaaggggccagtatattatgcccacctcgttgggttgttgcaaataacaaataatgatgtgtgaaagatttaacacggtccctaagaaaagtaaacgtagaattgccatatgggccaggcatggtggctcaagcctgtaatcccaacatcttgacaggctgaggtgggtggatttcttgggcccaggagttcgagaccagcctgggcaacacagtgagacccctgcctctacaaaaaatacaaaaattagccaggcgttgtggcgtgtgcctgtggttccagctacttgggaggctgcggtgggaggatggcttgagcctgggagttggaggttgtagtgagatcatgccactgcactccagcctgggcgacagagcgagaccctgacttaaaaaaaaaaaaaaaagttttttttttgagacggagtctcgctatgtcgcccaggctggagtgcagtggcacaatctctgctcactgcaagctccgcctcccgggttcacgccattctcccgcctcagcctcccgagtagctggaactacaggcgcccgctaccatgcctggctaatttttttttgtatttttagtagagacggggtttcaccatgttagtcaggatggtctcaatctcctgacctcgtgatccacccaccttggcctcccaaagtgctgggattacaggcgtgagccaccgcgcctggccaaaaaaagttaagttttatgttatgtgtatgttaccataataataaaagatttaagaacagagtctggcagagtgagcaggacgtgcttattaaatcactgaaatcagagtaattaaactggcattgctggcttctgactcttaaagggacatagagtatgtcagtcagtccccatctcaggcctagcagataatggcggctctagaaatatttgttgatcttttgactgcttgaaattcaaggtgctaaggccaatcacggtggctcacgcctgtaatcccagcactttgggaggtcgaggcgggtagatcatctgaggtcaggagttcgagaccagcctgggcaacatggcaaaactctgtctctactaaaaatacaaaaataagctgggtgtggtcgcatgtgcctgtaatcccagctactccagaggctgaggcaggagaatcccttgaacctgggaggtggaggttgcagtgagccaagatcacactactgcactccagcctgggtgacagagcaaggctctgtctcaaaacaaacaaacaaacaaacaaaagctcaaggtgctttcttgcttagcacccaatgcctctgtccaccacatgacctgccctgcccaaacccaggggaatccatgtcccaggggtctctgtgaatgggccttggagcccagggtgcccaggtgcctccaattctgccagttagctctgtgccaggctgctccctgggcctggagcgcacaccttggctcattccaactcctgtgtctacacagctcccagcgacctggagctcttctgggaaaaggtgtctgtgatcccctatccctccaggcagggcagccagtctagaatcaagagggagtggtgctgtcctctctcatgggtccccagggtcttcagggtgtgggtggcctcttcagctagaggctggagcttttggacagctgctggcagctcacactggtcccaaggtcactgcaggggtgaggtggagggagacgctggatcctgggaagaggaactccatgccacacattttgctgtccctggcatttccccactgggccctcctccggtgtcagtttagggtggagacatctggcatcaccaacatccactgggcaagtcaccctcgtcaggaccccaggggaggggaggccctggcaggagacaaagtgatgaaccctggccactgctcttggctcccatccccatcaggggacgcccgcaggcctgaggtcctaggacccaggagtttaaagtcaaggacaagcggcagccttccatccctccctgccacaggggcagcttgaccagggcccaccccaactgcgctggctgacttccacgctgcccttggcaggtgctggggtcctctcgcttcctgtggggtgggctggggagacggggggtctggcctgcattggggaacgtgcagcgagaggggcctcagcctaggagctggcgcctggcggaaaagaaagaagacagaggcgcagcggcaggtttctgtacaggaagtcagattatacatttcagtaacgggcggggtgacggggacggggcaacagcgcaggggccacagggagaagaagagatcgagagctggggtttggcgtaaatcttacaaagtgtataaagaatctgtgtttctctacattaacaaaaaccaaaggctacaagagcggttgtatatacaaaacacggagatattgcttcacttgcaaacaggttccagaccagatggggagacgagacagaggagggggacagggagggccgagagggcgcgttgcgtgcaggagaggggaggggagaggggagagggggggacgggcttctccctgcatcaatcaacaggcagaggtgggaggcctgtgcgagctgctgtgtgcggaggagcgggtgggcgctgagagcccggggggtccgcctgccccggcccccgctgcctggttcttcgggctttggcccagagcacggttctgggtggggacgacgggctggctgggccacccggtcacggagggagggaggcaatcgctccctagagtcggccaaggaaaaggggagaaggcggcgccgtccgcccgtcctcctcgcctctggccagccccgtccatcctgccgccctccccaccccgccaagacgctgtggggacccgagtttcatgggtgcagcaaaccggggcttctagcttttccccgggcaggacggggtagcactggctcctgtccttcctgggccccggcccggccgtgcagagctcactgggagggctggaacgagccggccacagagggacagcagggaggggccagaggataccgtggcgggggcgggcggaggacgtgcacgcacgctgggtggaggcgcaggggtcacaggttctggcagcactgcagcttgttgggcttctgtccgtccgtggtgggcggcacgctgatgtccaccacgttgttccccggggactcgtcgtgggcagcgcggtctgcgatctgtttctgtgacacgatgcggtagatctctgcaaagggggtacagggggacgtggggtgagccagcacgtgccctgcctgccgaggggaacccctccctgcaggactccagaggccctctccagacccccacagcgcccccatcacatcaggggtaacaaggacaggggctgcgcacccagccaggacccacatctggtcacagccagccccggcctctcgctccctaagatcagaagcgccctcctccctcagaggtaaactcccagaagccaaaaggctccaggtccctgaggctacccgcctccccgcagcgccaagagttaaggcagggcccatccccaggaactggggccagggggtctctgtgtccccagtgccagcaagggctagacctggtctgaccctgtgaagtgtccaggtggaccggcaggtttaaaaagcaaaggttaggggtggtggtggaaaaaaatcaaacaggccaggtgcagtggctcacgcctgtaatcccagcactttgggaggctgaggcaggaggatcacttgagcccaggagttcgagatcaacctggacaacattgtgaaatcctgtctctactaaaaattacaaaaattagcgggtgtggtggcaggcacctgtaatcccagctactcgggaggctgaggcaggagaattgcctgaacctggaaggcggaggttgcagtaagctgagatcgagccaccacactccagcctgggcaaagagcaaaaatccatcctgccccgacaaaaaaaagaaaaaaacaagcaaacgaacaaaacaagcgaaggttcagaggccgtgttccaccctgcctggctggtgccctacccacacccatctggtccccggccacctgtgaggatgttcttgaatgcttcctctacgttagtggaatccaaggctgaggtctcgatgaaggacaagttgttcttttctggaacaaagaatactgcctaggtgagtggggaggcagggtgacaggctcccacatgctctcagggaccccgcccacccacctggcccatcccaaggccactcctcagggaagggaagccagggctgtggccagggccccaacactgtgaggggcctcctgccttccagacacctctctgatgcctgcgtctccgtctgctcacctgcgaaggcgcgggcctcgtcagtgggcacagcccgcaggtggcgcaggtcactcttgttgcccaccagcatgatgacgatgttgctgtctgcgtggtcccgcagctccttcagccagcgctccacgttctcataggtcaggtgcttggcgatgtcgtacaccagcagggcgcccactgcaccacggtagtacctgcagggtcaggggcccatgagcctctctggaggacaaccatgggcagcggcagcctcacgggataacagcacacatcacgcccagggtgggtcgtccagggccgagccaaggggcagtcattgtggcctcaagggaagggtgtgtgtctggaggccccagcgctgctccctggatccagctctgaaatgtgggggtctgaggagggagtttgggagctggaaatagaagataccgtgaggtcatcaaaaaaagggaagaaggggctgggcatggtggctcatgcctgtaatcccagcactttgggaggctgaggcgggtggatcacttgaggctgggagtttcagaccagcctgggcaacatggcgataccccatctctactagaaaaacacaaaaattggccgggggtcgtggctcatgcctgtaatcccagcactttgggaagccgaggcaggtggatcacgaggtcaggaattcaagatcagcctggccaagatggtgaaaccccatctctactaaaaatacaaaaattagccaggcgtggtggcaggcgcctgtaatcccagctactcgggaggctaaggcaggagaattgcttgaaccctggggggcggggggcggaggttgcagtgagccgagattgtgacactgcacttcagtctggatgacagagtgagactctatctcaaaaaaataaataaataggccaggcagggtcgctcacgcctgtaatcccagcactttgggaggccgaggcgggcagatcatgaggtcaggagatcgagaccatcctggctaatgcggtgaaaccccatctctactaaaaatacaaaaaattagccaggcgtggtggtgggcgcctgtagtcccagctgctcaggaggctgaggcaggagaatggcgtgaacctgggaggcagagcttgcagtgagctgagactgcgccactgcactccagcctgggcgacagagtgagactctgtctcaaaaactaaaactaaaaaataaataaattaattaattaaattagccaggcatggtggcacaggcctgtagccccagctactcaggaggctgaggcaggagaatcgcttgagcctgggaggtcaagggggcagtgagctgcaattgtggcactgcactccagcctgggcgacagagcaagaccctgtctgtctccaaaaaagaggaggcgacagccaggcacggtggctcacgccacctgtaatctcagcactttgggaagccgagagggtggatcacctgagggcgggagtttgagaccagcctgaccaatgtggagaaaccccatctctactaaaaatacaaaattagcctggtatggcggcatgtgcctataatcccagctacttgggaggctgaggcaggagaatcgcttgaacccaggaggcggaggttgcagtgagccgagatcgtgccatcgcactccagcctgggcgacaagagtgaaactccatctcaaaaaaaaaaaaacaagaggaggtgacagagagacagatgtacctgagggatgaaggagatgggagggagcccagaggatctcaagacggtggtgggaatggctggggggcttgggaggggtccagaaaaaggcagctgagtgggtcctgatggctgggaagcctttgcagggaatggaggccaggcccaggtgggaggacaggaggcgtgtgggaccaggtgtgggcaccagtgaggagggaagctgagggaggaggaaggctgggatgctggctgggcaggggcagcggcaaggcggagtggcctgagctaggtcctcactgcacttggtacccagagataccctggtgtggcgaaggctgggcgctggtcagcctgagggtcccacggcgcatggctaaagcgttcttccagcctcactccctggtcttgggagcacactctccccttctcctgcccaactcctacacatccttccaagcccacgcgctgcaagcccacgcccccgaatctcagcgtccctgcccaggctgccgacacgcacgcggaggtgatggcgcggtagcgctcctggccagcggtgtcccagatctgcgccttgatggtcttgccgtccacctggatgctgcgggtggcgaactccacgccgatggtgctcttgctctccaggttgaactcgttgcgggtgaagcgcgacagcaggttgctcttgcccacgcctgagtccccgatgagcaccactgggcgggaaggcgaggttctgtgaatccccacactccacccacgactgcccccacaaccttcccgccggttccctgggtgctgcaccaacgcggctgccaacggtgtggaggagtcgagagatgcctggagcccagggcctgcaggcactgtgctaagtggtgcagaagtgaaggcaggctcctgccttccagaaacagccactgcggatagcacaacacctgcctgtgtctggtcctcagagcagggctgtcccagctggggcaaggggacccaggcagccaggcaggcagagcagcttgagatccatcaaccctgagcctccacctgcagcctggtggctgggcagccagacacggcttgagaaggctcctgagcggggtgaccttgggcaagtcacttcacctctggactactttttccaaatgtgtgaacaggaaggcagtcacaggaggaggaagtaagagcaggcatggccaggcacggtggctcccgcctgtaatctcaatgctttgagaggatgagccaggcggatcacttgaggtcgggagttcgagaccagcctggccaacatggtgaaatcccgtctctataaaaaatacaaaaagtacccgggcgcggtggctcacacctgtaatcccagcactttgggaggccgaggcgggtggatcacgaggtcaggagatcgagaccatcctggctaacgtggtgaaaccccatctccactaaaaatacaataaaattagctgggtgtggtagcgggcgcctgtagccccagctacttgggaggctgaggcaggagaatggcgtgaatccgggaggcggagcttgcagtgagccgagatcacgccaccgtactccagcctgggtgacagagcgagactccatctcaaaaaaaaaaataataataataataattagctgggcgtggtggctactgtagccccagctactcaggaggctgaggcaggagaatcgcttgagcccaggaggtggaggctgcagtgagccgagatcgaatcactgcactccagcctaggcaacagagattctgtctccccccacgaaaagagcaggcatcgcacaggaagggacacgagtaggcagctgtcacggttgttgtggtttctggtcagggcatgggaagggtcactgctccaggtatgtaagtgacaggacatgaggagctactcccacctcaacccccacctctcctggtgcagcaaacccacatccagcttcggcacagatggctgagtgggaaacaggaatgtgccctgaggacgcagcccggaggaaagagcctgcagccacctcccaccacccctgtccccagggtcaggtcccctgctgagctgcagggagctccagccaaggctaagtcctcattcaaggggcagtccgtgtggcagtccacgtgtgtgcacagctcctcacaaggctccaacacaggtatgcattgtcccaggaggggggtgcacagcagagcagcttgccaagatgcaaaccctggcccagaaaggagtcagcgcagcgtggacagaacagagatgagggtttgtgggcaacagcacccagggacgggggcctgagcccagtcgacacggggtgtgcagcaggcctgtctcatgctggccaaggagcatcaggaacactttccctgagcagagcaggtgcctgctggtcaggccaggggtgagctgccttgtaaactgtttcctgtcccagccatggaagcactgtccctatgggcccagccgccccaggctctggggtggggtctgggtgagctgtccccagacccagaacataccatgtggggaagatcagtgtgtgtgtgtgcacttgaatacagccaaccagacgccccagccagaagccccgtggacccccaagtgtgggccttgggccccggcacctgagggtgggttggctcagtggcttggtcatccctggtcccagggagttagggggcatccactgaggatgaggcttccttgtctgggaagagatgggtatggctgttcctcctgagctcggggaggtgctggcagccaggctgagccctggctgacccagaggtccgctggccccactcgggacccctgctacattgagggagcaggccctggagcccaccaggcagccctcctctgcccttcccctggccacactgtggggctgtacctacacgtttggaattttccctctagaaaacattctctcctgacccaacttcctgcctcgggcactggaaggtatcatctacactcactcactccacctcctgtcccccagtcctagaactcaaaccaagcacgctttcgcccccacagtcagtgtcagcctcagctacccccactcccccgggcctgtgcagcaggcacccagccagctctccctccttccctgcctgcaggggctccacaccccgactcctctcctcacagtcactcccactcagtctcccactctaccttcgaacctcagggagcctcaggacaggcatctctgtccacacccagtccccaggtgaccccatccaggctcatggctgtaaataccagccatgggctggtaactcctatattacctctctccctagaagcccagactggcgtgcccattgtctccttcatgtctcctcaggggccccaggcccctcatacccagaagagcagagccaagctcccgatcactccctaagcctgctcacccaccgctcacctaccctccttatcttggttaactttggcttggtcctaccaggcactcatgccagaaacctggagtcattctcgactccttcctttctctcgcatctcagaatcaatccttcagcacatccgaaacagatccaagagaagggaggacgaggggtgcaccccaccatgtctccctgggcgattccattccagactctcagaccctggaaggtattgtctgtgcggtccctgtgttcacgctcatcaccaaccaaaacgctgtcctcctgcagcagccaccagagagcgcccgtgagtgccgagccagggcacctccctccctcctctgcagacaaccctccgtggcccccaccttccgcaggggaaaagccacagtcctccccgctgcccacagggccctcccctcctccctcccgccccccccccggctcactctgctccagccacacaggcctccatgctgttcccccaacacgccaggtgcgatcctgcctcagggcctttgcacgggttgctcctgctgccagaaacgctcttctccaggcacacacctggctccctccctcatccccttcgtgtggccccttaaatgccacttggccaagaaggccctccctgctatgctactaaaactctactctccgaattaccctgctcccggacccagttcttcctccgtcactcttgccactctctcacctgtcaggtggcatttatcttttgccagtctgccccaagggcaggaatcaggtcctggcacagtgcttggcacacaataaacacccaagaaaatgtctgtcaagtgaacaaacaaaatgccaaaaaggctggcagagcctcccacgcatgccgcctgccccatacctagaggatgccaggtcaccacccttgggccacaggtgaggagggcaggatcaggcagcccctacaaccccacctggtacccgctctggttggctgcttggaagccaagaataacaagaacaaggagaatattcgatgagcttgtgctaacaaagctcttgatgtgcgttacttcgcagaagcctcctgtagcccatttttacagatgaggaaactgaggcttggatggggaacggggtgcggggcagagcaggaccctgaagctatgcatgtttgtgggctcgccctcacctcccaacggtgctccccaagtgacttgtctggagccaccgcctgggaagtgagccaggcaggatttgaacccaggtcttctgcatccacagtccaagttcttccttcgcaactcactgccacactcactgtcctaccccaaaccccagcacgtggctcgggagtcgtggttctgccttatggggtgggcattgaggctctgggcaccccagctcccaccgcatagggcagcctgtccccctggggcggccagcaaactcctactcatccttcaagacccctcggctcagacctctcctctccccaaagaccactgcttggcctggcgtgaaagacctaagacaacggggctggcattctctcacgtcaccatgggtgccccgcacagggctaccaagtggacttcagagaaagacagaaagatggccgggtacagtggctcatgcctgtaatcctgtaatcccagcacttggggaggccgaggcaggcggatcatttgaggtcaggagtttgagaccaacctgactaacatggtgaaaccccgtctctatgaaaaatacaaaaattagccgggtgtggtggtggaggctgaggcaagagaatcatttgaacctgggaggcggaggttgcagtgagccgggatcgtgccactgcactccaagctgggcgacacagcgagactccatctcaaaaaaaaaaaaaaaaaaaagaaagatggaaagaggtggagtgaatgtaggcgtgtggcccagcacctcccaaccaagccagtagggatgagaatcggctcccaggccactgggggccaagatggactcactgtgagggcccccatctacaccaccaaccttaacctcctttccacggcagctacgggagcctggccaaggccagggaggtctgctcagttctcacgtcctcaggaaataagacaggaaactcgggccctgcccaggcattcccgacaccttcacaccattccagccttgccccagctgtacagccttagtggctcctcagccccatcagtttgtttgtttttgtttgtttgtattgagatggaatctccctcgcccaggctggagtgcactgacacaatctcagctcactgtactctccgcctcctgagttcaagagatcctcctgcctcagcctcccgagtagccgggattataggcgtgcaccacgacgcccagataatttttgtatttttagtagaggtggggttttgccatgttggccaggctgtctcaaactcctgacttcaagtgattcacccacctcggccttccaaagtactaggattccaggcgtgagccatggcacccagccccatcagttttgccctcaagcactttggccaggctgggtccccagtgctttgcaggcctcagctgtccacattctcagggctgccccagggacagatgtaaatattatcattctccctgaacagctggggacactcaacccagagtgaccaagtcagagcaaaggccaaatggccactgaacagatcaatgacaggccaggtgcagtggctcacgcctgtaatcccagcactttgggaggccaaggcgggtggatcacttgagctcaggagttcgagaccagcctgtcaacatggcgaaaccccgtctctactaaaaatacaaaaaataggtgggcatggtggtaggcacctgtaatcccagctactcaggaggctgaggcaggagaatcatttgaacccaggaggcggaggttgcagtgagctgacactaagccactgcactccagtctgggtgacaaaacaggtgaatggcaaagaggctgagctgcccaaccagtccctggcactgggtgcccgatgcagagaggtggccagcggggcagtggcgggctggtccaggatgcaggctggggatgaaaacttcattgtctaggacacaagcaatctgttgtcttggggaaataaagagcccttgaggacacagctccgagcatttccacagaagttggtggcttcactggctgggaagcgacccccctaccccagacacgccacttggctgacagagcaggcaagcccggttggcaaaaacaaagaactggcacctctgagaagtcctaggtgccctggcctgccccatgacagtgtggtggccctgggggcccagaccctaatgctcaggcagactgagagactcttcaggggaatggtgcccccattccggcagagcctggcggagccaagcagtgcccccatccctcccctggaagctggtcctaagcatcctaggccccagggaccggcactgggggccactcttgtctcagctcttctatggggaggtgtacagagccagggcactggagggacccccattctaaatggggaagatggtatgtttgggtccccaaacagcaactggaacagcaggcccactgtgaggtctgcccaggcttgagggctgggagctgcctcaggagcctcagcacagaaagggaagcaccaggcaggccccttccctggggacaggggccaccttgtccttgggcaggggaggggtggacaagacccagaggacagggcctggggcagctgcggcccgtttcccccacgacccatgtcctccagggccaggtgagccctgattggccagggcctctagggtaggggaagggctctgagaggacctcagtggcccttggggacacagctgcaaccatggagtaccgagtccatcagaaaagaaatctggggtcccacggcaattagtggcaggctatgaaaatggcccatggctaaaggagaaaatgttaggaggataaatgtgaggctctataattaggtacaaatcaacagtgtcattcctgggggaaggaaagaacattcacgaaggaaaacaaatggcacacggggcatcacccgggggatctgctggccttggccgctgaagtcaagggagccagtgcgtgatgtggccaccaaaaaaaaaaaaaaaaatgcagaggccaggcacggtggctcatgcctgtaatcccagcactttgggaggccgagacaggtggatcacctgaggtcaggagttcaagatcagctggccaacatggtgaaaccccgtatctactaaaatacaaaaattagccgggtgtggtgggtgcttgtaatcccagctactcgggaggctgaggcaggagaatcgtttgaacccgggagacggaggctgcagtgagccgagattgcgccactgcactccaggctgggtgactagagtaaaattctgtctcaaaaaaaaaaaaaaaaaaaaaagaaaagaaaaaggaaaagaaaaatattgaaagagaatagaggaggtcctctgatgaggcacagctgtgaaggtgagacggcagatgaccagtttgggaaaagctgaacttgtgggttagatttttgctaccaactagcttgagaaggtcagcagggcacctgctagactcagtaaaaggaggccagtgtggggagggcagcagggcaggcaccgcccccccccaccccacaccgcctgcccgccaaatgccagatgccgcagaagctaaatcagtgtttccaggaagcagtctctgcagacaagtcccgggaaccacacagcctctccattgctcctgacccagtaactgttctgctgggaacgcacttcaaggaaataatctaaagggcaaaaccatgacttgagcaagcactcggagctgggtcatttaacacagcaaaagggcaaaaataacaagcaggggataaccacagaaacctggatggggcatgtggggagcaacacccctgccctggcagtgccacgtctgggtgggtgcccagccaggacctgggagcagctgcctcacggtgggctgagtggagatggcacccgatcagcaggacccaaagtttagtccccctgtctccagacggccccttagaatcccagtctccaaaacccttccaaagcttcctcctgccacgaggggcgagaccttgggccgggcacctgctgaccacagagcctcacccaccagtgacattatcaacctgtgtgcagctgccagagccctcagtgccacaggacgactctaggcccttgtagaggcacttcctctccctccccccggaaggctttcgccacacggacagcccaggtggggagacctctgcctcattccccacaatcagaagacgctggatgagaccagacacaaggcccagctaggcctggtgcaagccacagagcacactcggaggaacggctcagcgaggtgaggataccaacagctgatgtgcgacgcaggccctcatagagcaggccgcagggtgaaggcaccttggatccaggggttagccctcaagggctgccattgtcagccagggagcccagcaaccagggcagaccactaggccaaagtgtagctgggcacagaaggctcagctgagaaacaagggactccggcttcctccagctgtccctaaatgggcaatggctgcctgatctacctaggccttatgtgatgctcctagagccccctcagtccctcgggcggggaagaccctccagcaggctggctggggccccggccatcagtgcgcacgtgttggaagaagttggtccaacaacccaaagtcccagatgctggccacaagccccctaagacacgcttcctaagtggtaaggcctacaggtggcctgggctcaatcgggttccaacacttataaactgtgtctttgtcactctgggcctcagtttcccaacgtgtaaaaagagaggctggttagtatcaacctcaaagggctgcagtgaggattttagttaattcgggtaaagtgctcagaaaagtgcaagtactggcttagcactgttgagagttctgagtgaagagatggaattcttgctgcacacacgggtgcctttccactcaatcccagctttgcaccccaatccaaggctcccaccaccacacacctcacccccaggccctcatctcggcccagcccccattgcctgccccgcctctcccgggccccacccccaaacacgctgccccaatcaggacaagcctcgtgagagccccgcctccgtttgcccaggcccaacccacctattggtcacgcccatcacgccttagccccgcccctaaaaaccccgcccccatcccgaatcacgctttcagcccagcccggcccgccaaatcttgggaaagctccaccccctgcggaggccccgccctaacagcctctcccaccgctccgggccccaccccctctaggctctggccccgccccggcgcgtcctaggtcccccaggtctctccgggcctccggctccgtatagccgcgcatcctagcccgaagctgatgctgcccggtcggctccggccttcccggctgcctgacccgccgggccccaagccccgggctccggcctgggcccagcggcctggagcgcggccttggcccgtctgcccgccgcctcgccgccacgacttcgcccgtctgtgccccaccggccgcacctttgaataggtagtcgtactcgtcgtcccgggtccccattgtcctggcgcttccggcgggatcggcgactccgcagccccaccacaaacacccgacgggggcggagccggcgccgcgcagagcggcggttgaatggcctatcagcggcgagtggagtagcgacgggcacccagcgaagccaatcagagatggaagtagtgctctgagggtgggcgccgcttggtaccaccctcctcgccctcggtgtcctggagaaaggcggaaggaatgcggacctttttgaagtgacggacgcgccagcctatcaggggcgagctcaagagggcggggcggaagactgcaggaatgaaatggattgacagaccaaataactaatgagaggcttgattgagaacctacccgactatcagaggacctgtccgggaagagaaatggggctacgtccaggtaatgctacgatgcttaacgtcccgatgacgtcataggtcagcgcgcgctgccctggtcgccccccaagcccataaatgaccatttccggggacctcagcgctgggtcccctttctcggttgcagtctccatctctatattgggactcactgggttatccttctgtgcctcagtttcctcctctgtaaactgaagaaacccgtctcatggaatcttttgaaaataaccagatcagccaggcgcggtggctcacgcctgtaattccaggactttgggaggccgaggctggcggatcacgaggtcaggagttcgagaccagcctgaccaacatggtgaaaccccgtttctactaaaaatacaaaaattagtcgggcgtggtcgctggtgcctgtaaacccagctactcaggaggttgaggcaggagaatcgcttgaacctgggaggtggaggttgcagtgagccgagattgcaccaagtgtgaatcaaccgtccactttctgctattctttgttaaataaatacttttaaatccttactggataccaatgctctccaacaggacctcctaccactacccctcttttgtcctatattttgccacataggtaaaatataaaaataggtaatatagaaaataaaacacatactgctgtattgtcaggtagtgataggatttatcactacctgacaatacagtatgtgtttgttttatatatttagggtgtacagcgtgtgttttgatacacatgtacccagtgaaataataattatgacagtttttttttttttttttgagacggagttttgctgtcgttgcccaggctgaagtgcaatggtgtgctctcggctcactgcagcctctgcctcccgggttcaagcgattctcatgcctcagcctcccgaatagctgggattacaggcatgcaccaccatgcttggctaatttttttgtatttttagtagagacggggtttctccatgttggtcaggctgatctcgaactcctgacctcaggtgattcgcccaccttggcctcccaaagtgctgggattacaggcattttcaccacacatggccaattatgagagttaagcaattaacctatccattgccttccataattaactgtgtgtgtagtgagagtatctaaaatgtactttcttggcaaattttcaatatactatgcaaaattattaacacaaagtatacgttactttttgtttgtttgttttggctggctgcggtggcttatgcctaaaaacatgccctttgaggaggctgaggtgggaggatcacttgaggccaggagctagagaccagcctaggcaacatgtcaaaacccagtctctcaaaaaaaaaaaaaaaaaaagaaaaaaaggaaaaaaaagagaaaaggaaaaaaaagaaaagaacaacaacaaaaattagccagatgtggtgcatcatgccagggtcccagatacttgggaggccaaggcgggaggatcattcgagcctgggaaatcgaggctgcagtgagccatgatcaccccactgcactccagcttgggtaacagagcaagaccctgtctcaaaaaaaaaaaagccttgctttcctgacccattgatctgtttgttttttgtcctctgtcagcagcatatcagcctgatgacatcagggactgtatctgtccccatcattgctgtaagttccccactgctgaataaatacgtttatttattcagtggtgaataatctaagcctagagtcaatgtactagttattagagcagatgccattatcgcctcttggatctcattcccagggtgttcattgggcatctgtcaaaaaaacaaaattacaacacatttagtttaaagatcttaattgattttatttgcaattctacaatcgggcaacacttcatttcacaaaatgaaactaattttcccatgagctgagcaggtaggttggttttacaggcagaaaaagggccaagtaaagcacaaacagaaaataaaacgtggaggtcaggtgcagtggctcatgcctgtaatcccagcactttggaggccgaggcaggcagatcacccgaggtcaggagttcgagaccagcttgaccaacatgataatgatgatgaaaccctatctctactaacaatacaaaaatattagccgggcgcggtggcaggtgcctgtaatcccagctactcaggaggttgaggcaggagaatcacttgaaccagggaggcggaggttgcagtgagcgaagatcacaccattgcactccagcctgggagagcagagcaaaactccgactcaaaaaaaaagaaaaaaagaaaagaaaacttggattggtcattttaaagtttccttttggagtctgagtcttgctctgtcacccaggctggagtgcagtggtgcgatcatagctcactgcaacctcaacttcctgggatcaagcaatcttcccacctcagcctcctgaggagctaggatcacaggtgtgtgccaccatgcccagctaattttttttttccagagacagggtcttgccttgttggccaggctggatttgaactcctgaactcaagcaatcctcctgccttggcctcccaaagtgctgggattacaggcatgagccaccaccgcactcagcccaaagttacttttcttgtaaaggttaaagcagagaggacatccttatcatgatggctaaaactgacctggtgggagacttggctatcccatctctctctctcctgattttgtagaaggtcagataaacaacttagtttctttttgatcacgtaaaactttagcatgagtgactccattttggtttagtttgttgggcctggtgtaggaagtcagtccaaagtaatagcctcctataagttttgtataacacatcctgtgtccagattggtgggttcttggtcttgctgactccaagaatgaagccacagaccctccggtgagtgttacggttctgaaagatggtgtgtccagagtttgttccttctgatattcagacatgtctagagtttcttgcttctggtgggcttttggtctcgctgacttcaggagtgaaactgcagacctttgcggtgagtgttacagctcataaaggcagtgcgcacccaaagagtgagcagcagcaggatttactgggaagagtgaaagaacaaagtttccacagcatggaaggggacccaagcacgttgccgctgctggctgcggtgtcctgcttttattcccttatttggccccacctacatcctgctgattggtccattttacagagagctgattggtccactttacagagtgctgattggtccgttttacagagtgctgattggtccgttttgacagagtgctgattggtgcatttacaaacctttagctagacacagagtgctgattggtgcatttacaatcctttagctagacaggaaagttctctaagtcccctacgcgattagttagacacagagcgctgattggtgcatttacaaacctttagctagacacagagcgctgattggtgcatttgcaatcctttagctagacagaaaagttctccaagtccctactcaaccaagaagcccagccggcttcacctctcaatcacccctctaaacagaacaccccaactgctgttgggaatttggccgatgaccactctagctacttcctgctggaagaaggggccctgcaattgtagtgtcctccagaggggaactctttaggccagtggaagggccagtgggtcggtccaggggtcctcagtagaagttgttagttgaactcatttggggttccatttttaagaccatctgtagcttgatggcctcgattctagaagaaacaaatttgacaagaaggttaaaaatgcagggcccaaaggtgagtaagagcaagatggctgccacaggacctaggggagaagccatgttgcccaactccagaggttggtattagagttcgaaaggcattgtctgatttcagaagccttttcctgtaaatgccaggtggcatctcgtgctatccctgactgtttagtgtaaaaacaacactcttcccctaagaaggtgcagagtcctcctttctcagcagtgaggaggtctaggcctcagtggttttggagagttgctgctgccaaagagtatatttgggattgtagagtaaggatagattttgttatttcttacaaactgtctgagaaatcctttgaaggtgtatggtagtagaataatgaagtggataaactggctattccggttcctgtagcagtagccattcctaaccctataagtagggatattagttgtatggccctgcgctgatagacttgagctttgaggggcacagatacggtctgatttccataagattagaagttaggataatacatgttacactgttaacttttttagcaaactttacttttgttgaaaaccttgtaagtttgggatttcaattattctttgctattagtaagaccttgttcagtccatattaacttagaattggtatagatggctgcttcctgattctgtaagtactttaagatttggctgagtggaaacaactggcatgtttgagcagaccaattattaggcaattttcctaactctgcatctacaagagtttccttatcacttactgaatacccattgtgtctttttcccttaatcgcctgggaggaaccatctatcatcctgtcctgaagggagttcctcctagatctggtcagacctttgtatggtaattaattaagatttagatctcctgttaggaaacctgctgggttaaggatttttgataggaaggctacaggttgtcagtggcctcagtgctttccggctatgcccttgtttacactgacaacaaggtggtattggagtgttataaggttacagagaagaccttcaattatcaattataggttttaaatttacgctagggtacacttttttttttttactacttctatctccttttctctttgacttcttctttgtctctgtctcttcctctctgtctccttctctttgtctctctgtttcttcctctcttctctctttctctgacttcctgtctctttctctctttcctttctgctggtctttccctgcctctgctagccacttatgctgctgttctcccctcttcttcccatttttgatggcttcggctgtgtaagactgccacctccttgggtttttgcactgtgtgcaataactccatggtttccttgtggtatttaatgggggttcccccagaggttagaaactccctttctttccatattgcggcatgggcatgtaggattaggtaagcatacttgctatatgtatacacatttattctttttccgtttcccagttctaaggctcaggtaagtgccactagttctgctaactgggcgctggtccctgggggaagaggcttactttcaagtacagttacatcactaactatggcataacctgcccttcatatcccattctccacaaatgaacttccatcagtatataggttaaggtcaagattagctaaggggacttctaagagatcctcttgggcagcataattctgggctataatttgttggcagtcatgctcaattggttcctcatactctgggagaaaagtggcagggttgagggccacacatgtgcatatttgaagcaccagcccctcaaggaatagtgcctggtatctaagtaggcgattgtctgatagccataaactttctttagcacctaggttgccatttacatcatgagtagtccagacagtgagatcctttccttgtattattttgatagcctctgacactaagacagccactgctgcaactacccataagcaatgaggccagccatttgctactacatcagtttccttacttaggtatgccactggttgtggggttatcccatgagtctgagtaaggactccaagagctatccctgctctctctgtgatgttttgtcctgtgggaaggcttaaagctggagcttgtactagggcctgctttaaggttttgaaggctgtttctgcccctggttcccattctactagatgagtatttgccctctgggtctccttgattagagtatagaggggcctggctatctcgctgtatctggggatccacaatcagcaaaagctggtgatttcaaggaacccctgcaactgttaaatgtcttagggtgaggataagccagtataggctgtatttgttccttgctgagggccctgattcctctggctaagattaggcctagatatttgacctgctgtaggcaaagctgggccttcgacctagatgccttgtacccttgattagctagaaagttcaagagatctagagtagcctgctggcatgaggcttctgaactagtagccaaaagtaaatcatccacatactgaaggaccagagcacctggatttgagaagtggcctagatcttgagccagtgcctgaccaaacagatgagggctatccctaaacccttggggcaagaccatccacgtaagttgggacgtgtggtctgtgggatcctcaaaggcaaagagaaactgagagtcagagtgcaggggaatacagaagaaggcatccttgaggtccagaacagtgaaccattctgcttcctctggtatttgagagagcagggtataggggttggatacaactggatatagaaaaattattgcctcatcgatgagtctaagatcttgcactagtctccattgaccatttggtttttgtactcctagaattggggtgttgcagggactgctgcatttccttactaagccttgagcttttaaatgtttaacaatatcctgtaatcctttataagcttcaggctttaaggaatattgcctttgataaggaaatgtggtgggatcttttaccctgatttggactgggtgggcattttttgcccttccaaattgtccttccaatgcccagacttcaggcttgatttcatcctcaagtaggggacaacaaatgggaaacttgttccccatattcatgtagataatagctccagctttggctaatatatccctccctaataagggtgtgggactttcaggcataacaagaaaggcatgtgaaaagagcaaagtctcccaattacaactgaggaggtgggagaaatacctggttacaggctgtcccaggattcctcagatggtaacggacctggaggacagctgttcaggacaggaaattaacactgagaaagccgcaccagtgtccaggaggaagtcaatttcctggctgtcaatggttaaagttacctggggctcagtgagagtgatgacatgagctgacacttgccccaggcaccctcagtcctgttgttggatcatctggttgggggcttctgtcccagagaagctttgtcctctggggcagtgtgccttccagtgattgccttggcataggggacatggacaagggggcagcttgtttctcattggacaatcttttttaaagtgtccttgcaaaccacactgctaacaagccatactggatgattggcctgctccattttctgtcctctctgaaccaccaaggtttgtttgtctgagggccatgactaagtctgcggcctttctctgatctcacttttccttttgggcctgttcctcttggtccctgttatagaacagtgaggttgccaggtttaataatgcctctagattttgttcagggcacagggctcacttttggagctttctcctgatatctgtggctgattggataataaacttatcttttaggatcaattgacccttgagtgatttgggtgacaggggagtatattttcttaaggccttctgtagccactcgaggaaggcagaaggattttcttcctttccctgagttatggtggacatcagtgaataattcatgggcttcttcctaattatccttagtccttctagaacataggtcaacagatgtttatgactccagtccccatgatctgaattgaagtcccagtggggatccatactggggatggcttgctgaccagtagggaatttgtccctttcttcagctgtcattctatcatttacttaactaagataccaggtacctccaaagtcttgggctgcagctaaagctgcattattttcattaaaggccagggtttgatctaacaatagcatgacatctctccaagtgagattgaagatttgccctagaccctgtaggacatctatgtacctatcaggatcatctgaaaacttccccaggtgtgccttgatctgctttaaatcagagagggagaagtagacatgtacccatgttaggccaaattcccctcccgctacaatttgaaggggacataaccgacagcccaggggagttttgtggtcctttggagatttctttgcttatttccttctgggcaggggagattagaggaggcttgtcactaatacgaaggggagctgtagggaggctaggatatgggggtaagctgaaaggttctcctgtgggatgtaaattgcaacctttgcatagatgtgtattctcctttaatgaaaggaaagcttggacataactatttcactccatttgcctttctcttacagaaaaggtcaagctgcaggatagtattgtaatttgtacttccctcagatggccatttttccccatcagagagagaatattggggccaggccacagtgcagaaaaaaatgagctgcctctttttcagggtttgcaggtcagactggtcccaatggcctaggatgcatttcaagggtgagcctgttgatgcctgtttcccatctgaaagacaaaaccacccacgattttggtgtgtttttcttctccccctgcccaagaatccacaatggtccttgggccctgctgatcggaatagttgcgctcactgatgcagcagcagaaacaacccctgcccaagaacccgtaatggtcactagaccctgctgattggaatagttgcactcaccaacgcagcagcagaaacagtagctttcctcccagaccacaaggagaaccgaggaaggtcggatttagtggcccttaccaacgcattctcaaaaaacctgcacccttgcctgtcctcctagaccacaaagatgaccgagaaaaattggatttagtggcccttaccaacacattctcgaaaacctgttacagtcctaagcattctccttttagtattgggaccttaccaatttcctacaatgatgttatgccccaaaaatgaagtggagggccataccatgagggaaggaagggatctccagggttggaagagtgacaccttttgtcctcacttatatgaataggaagaatacaatttctgaggctccccatatcctagcttcaggaatagcttttattagtcctgcttgtctgaggagggatcctaaaattccagatagcccccctacaacagggctttgggcaaaaattatgtctttctgattagtgagcctaggtgcctaaagaaggtaacagagtcctgaagtttatactagaagtcattcttataggagaaactagaaaagcaccagagacagggagtggtttttagaggtgggactagcctcggagaagagaggcgagaggaagtttgtctgacaggcattaggacccaggaggcaagggtcaggacagataggatagatgggcgagtctcacttgggcgacatgactttgagagttctgctcatggccacaggatcaaccaacttgttgtcaagaccccagagctgaatggctttcctgtcaaccctcgactcagcccagaagtacaggaaaagcggaagctggttccaggcaaactaacgctcccaactccaaaaagtcggggtttgttagagagccccttcccagaaagcctcacacccatgtctttagtccagcacctgcgctagtcgcttttaactggccgacaggtgcccggtatttagcccccaaattctaaggaaaaataggacgaatagcaagcgaaaggggtccgatggtactcaccgcttggtgataggcgatagtctcaccgcttggtgataggcgatagtcccttcgtggtcgccaaaatgtgtccagtattggtgggttcttggtctcactgacttcaagaatgaagctgtggaccctcacggtgagtgttacagttcttaaagatggtgtgtctggagtttgttccttctgatgtttggatgtgtctggagtttattccttctggtaggttcgtggtctcgctgacttcaggagtgaagctgcagatctttgcggtgagtgttacagctcataaaggtggtgcggacccaaagagtgagcagcagcaagatttattgcgaagagtgaaagaacagagcttctacagcgtggaagggaacctgagtgggttgctgctgctggctcgggtggccttttattcccttatttggccccacccacatcctgctgattggtctattttacagagagctgattggtccattttacagagtgctgattgttccgttttagagtgctgatttgtccattttgacagagtgctgattggtgcatttacaaaactttagctagacacaaagtgctgattggtgcatttacaatcctttagctagacagaaaattctccaagtcccctacctgattagctagacacagagcgctgattggtgcatttacaaacctttagctagacacagagtgctgattggtgcatttacaatcctttagctagacacagagtgctgattggtacgtttacaatcctttagctagacagaaaagttcaagtccccacccgacccagaagcctagccggcttcacctctcaatcccataaacaaatttgactccttccccatatccactccccctcttgtgtctccatccttccttccctccctcccatcaaacccagaggacatggacttctgtctcatcttctcctctctgcctccctccctctatcatcctcagttgccttattctgtctctcctccctctgaaatttctcttgattctttttttttttttttgaggcagggtctcactctgttgcccaggctggagtgcagtggcatgatctcggctcactgcaccctctgcctcccgagtccaagcaattctctgccttagcctctcaagtagctgggattacaggcgcccaccaccacacctggctaatttttttgtatttttagtagagatggggtttcactatcttggccaggctggtcttgaactcctaacctcatgatccacccgccttggcctcccaaagtgctgggattataggcatgagccactgcacccggactttttaaaaatttatcgtagagatgaggtcttgctgtgttgcgtaggctggtctcaaactccaaggtcctccagcctcagcctcccaaagagctgggattacagtcgcgaggcactggacccagcctgtgatgaatattaatgccttattaattctttaccaccccctccccacaccatgaggccaggaagggatggtggcatggaggggtggggtgtcaaaaccatccccattttccaaatgcaggaactggggccagtgagctcctgtggtccaggagagggatgtgatttacagctgcagctctggagtttaacaggtccaggttcacatcccagcttcctggccccttgttagtttcctgccatggtgtttttcttttctttctttttttctttcttttttgagacagagtcttgctctgtcacccaggctggagtgcagtggtgcaatctcagctcactgcaacctccgcctcccaggttcaagtgattctcctgccttagcctcccgaatagctgggactacgggcatgtgccaccatgcctggctaattttttgtatttttagtagagacggggtttcaccgtgtcagccagtatggtcttgatctcctgaccttgtgatctacccacctcagcctcccagagtgcggggagtgtaggagtgcgccaccgtgcccaggtggtggtttttttttttttttttctgtcgttccccaggttggaggggcaggaaatgctttgaggtcaaggtggctgcaggaaaaaggatgacattgaagagatgagcccatcattggcagagcctggaaatgaagagggtgtggctagaggaaccccctctcctgcagactggactcaccaccagctccagtgacagtgggctcagaggagatcctctaagcctgctcagtacaggacacaggcaaacaaggaacctggagagggcagcctctagcctccctggcctggcagctgtaggacctacctctacaaagctaaaaagtttgtcacctatacccagccacagccccagggaaacagctgtgtccccagcacctgccaggaagggtcaagacaaggaaatcacagatattttttcttctagcgcaagaacccccaccacctccccaagagacatctataaggaatatttggagggagatactggggcaaaaataaattaacaggccgggcacagtggcttgcgcctgtaatcccaccagtttcggaggccgaggcgggcagatcacttgaggtcaggagtttgagaccagcctggccaaacccatctatactaaaaatacaaaaattagctgggtgcagtgggaggcgcctgtaatctcagctactcgggaggccgaggcaggagaatcgcttgaacccgggaggtggaggttgcagtaagctgagatcgcactaccgcgctccagcctgggtgacagagtgagactcttgtctcggaaaaaaaaaaaaaaaaaattaacagcagctggggttcagaaaatggacagatgtggttttcctcaaatacatgtcctagatgtagggtatccaattattacaatttttattttatttcatatttatttatttattttttagacagaatctcgctctgttgcctgggctggagtgcagtggcactgtatccggaattggggggttcttggtctcactgacttcaagaatgaagccatggacccttgcggtaagtgttccagctcttaaggtggcgcgtctggagtttgtttcttctgatgttcaggtgtgttcagcgtttcttccttctggtgggttcatggtttcactggctcaggagtgaagctgcagaccttcgcagtgagtgttacagctcataaaagcagtggggacccaaagagtgagcagtacaagatttattgcaaagagcaaaagaacaaagcttccacagtgtggaaggggacccaagtgggttgccactgctggctcgggcagcctgcttttattctcttatctggccccacccacatcctgctgattggtagagcccactggtctgttttgacagggcgctgattggtgcgtttacaattcctgagctagacacaaaggttctccacatccccaccagattaactagatacagagtgtcaacacaaaggttctccaaggccccaccacagtagctagatacagagtgtcgattggtgcattcacaaaccctgagctagacacagggtgctgattggtgtgtttacaaaccttgagctagatacagagtgccgattggtgtatttacaatccctgagctagacataaaggttctccaaggccccaccagagtagctagatacagagtgttcattggtgcattcacaaaccctgagctagacatagggtgatgattggtgtatttacaatccctgagctagacaaaggttctccacgtccccaccagactcaggagcccagctagcttcacccagtggatcctgcaccggggctgcaggtggagctgcctgccagtcccacgccgtgcgcctgcactcctcagcccttgggtggtggatgggactgggcaccatggagcatggggcagtgctcgtcagggaggcgcgggccgcacaggagcccatggagggggtgggaggctcaggcatggcgggctgcaggtcccgatccctgccccgcgggaaggcagctaaggcctggtgagaaatcaagcgcagcgccggtgcgctggcactgctgggggacccagtacaccctccgcagccgctgtccggcccgggtgctaagcccctcattgcccggggccagcagggccggacggctgctctgagtgcagggtccgccaagcccacgcccacccggaactccagctggcccacaagcaccgcgcgcagccccgattccggctcgcgcctctccctccacacttccctgcaagctgagggagccagctccggccttggccagcccagaaaggggctcccacagtgcagcggtgggctgaagggctcctgaagtgccgccacagtgggagcccaggcagaggagtcgcagagagtgagcgagggctgtgaggactgccagcacgctgtcacctctcagcgccatctcggctcactgcaacctccacctcctgggttcaagcaattctccggcctcagcctcctgagtagctgggattataggtgcgcatcactatgcccagctaatttttgtatttttagtagaaatgaggtttcaccacattggccaggccagaccagcctggacaatagagtgagaccctatatagggatctcactatatagagcaatacagcgggatcacccgacctcgggtgatccgctcgttggcctcccaaagtgctagtgttacaagtgtgagccaatgcgcccagccctattctttttttttttttttttttttttgaaatcaagtcttgctctgtcacccaggctggagtgcagtggcatgatctctgctcaccgcaacctccacctcccgagttcaagtgattctcctgcctcagcctcctgagtagctgggattacaggcacccgccaccacacccggctaatttttgtatttttagtagagacggggtttcaccatgttggtcaggcgggcctggaactcgtaatgtcagatgatccacctgcctcggcctcctaaagtgctgggattacaggcatgagcgaccacgccatcttttttttttttttttaacaaaacacagatgtagaattagagccttcaggggtgggtgcagtggcgctcacacctttaatcccatcactttgtgaagccaaggcaggaggatcccttgagtctcggtgtttgagaccagcctggacaatagaatgagaccctgcctctacgaaaaaaaaattatttttgttttgagatggagtcttgctctgttgcccaggctggagtgcagtggcgcaatctcggcttatttgcagcctctgcctccttggctcaagtgattcttctgcgtcagcctctagagtagctgggactacagacgtgcaccaccatgctcggctaatttttgtatttttttgtagagatgggggttccaccatgttggcccggctggtctcgaactgctgacctcaagtgacctgcctgtctcggcctcacaaatggctgggattacaggcacgagacaccgtgcctggccctgggaacatgtttacatggactttgttcactttttaaaacaaactgagggtaacttactagatctgtgaactaaagaaagagaaaaaaaagaaagaaaacaaacaagaacaaagaacaaagtgttctgaggttgcttttattccaagaactctgtgagctccgcccagataccattggcgcctgcttgtgtccccaggggacctacacacaacagcaccagcaccatgagggcgctctcgacccacacaagccctggtccccgtcagtcaatgtgactgagtccgccattgaggccagtctggctggccccaagtggtccctctgagtccccaactccctggccagcaaggagtgaagctccatgccccttggtccacgcctctagagtctgagcatatcctgcagcctcgatctcaggaggcaacgcatgcagcccccctgcactcagaaagggggcttctccagtcgtggtcttcttctctgtccacaagtttccagatggcccctccttggagcccctgcccaggcagggaacggccacatcctcgggcagagccaagagtcaccgtctttcgtgggcctgggaccaggcccagccaggacgctaggaggctgcctctgctgccatgggctggatcaacatggtggtggcctgcagcgggtagtagcggccccgccaggtcttccagaagattcccttcttaagcttctgccgctgctgtgggatggagcggaagtactggccgttgaggttggaatggctgcaggtgccaaaccaccagcctcctgccggggtcaggggagagggaacatggtcaggtctttgagccaccgatggggctgaaaggagatagggatagggttgaggatgaggcaggttggggaccaggctgggctttggacttgacttttttttttttgagattgagtcttactctgtcacccaggctggagtgcagtggtgcgatctcagctcactgcaacctccgtctctcaggtttaagtgattctcctccctcagcctcccgagtagctgggattacaggcgcctgccaccacacctggctaatttttggtctttttttttgagactgagtctcactctatctcccaggctggagtgcagtggcacaatctcggctcactgcacctctgcctcccaggttcaagggattctcatgcctcagcctcctgagtagccgggattacaggcacccgccaccacgcctggctagtttttgtatttttagtagtgagggggtttcaccatgttggccaggttggtctcaaactccttacctcatgtgatccaccctcctcagcctcccaaagtgctgggattacaggtatgacccactgcgcctggcctaatttttgtatttttagtagagacagggtttcaccatgttggccaggctagttttgaactcctgacctcaggtgatccacccacctcggcctcccaaagtgctgggattacaggtgtgagcccccacacccggccttatttttaagtttaaaaacaattttttttgagacagggcctggctccattgcccaggctggagtgcagtggtgtggtgatggctcaatgcagcgtcaaccttacgggctcaagtgattcttgtacctgggcctcccaagtagctgggaccacaggtgtgagccaccatgcctgcattttttctttttcttttgaggcaggggtctcactctgtcacccaggcttgagtgcagtggcgcagtctcagctcactgcagccttatctcctaggctcaagagatcctcccaactcagcctcccaagtagatgggaacacaggcaggcaccaccatgcccagctagttttttgtatttttaattgagacaggatttcgccctgttgctcagattggtctcctgggctcaagtgatccactcgcttcagcctcccaaagtgctgggattgcaagtgtgagccaccgtgcctaatttttttttttttttgagaattgcttgaacccgggaggtggaggttgcagtgagccgagatcgcaccactgcactccagcttaggcaacagagtgagaccctgtttcaaaaaaaaaaaaaaaaaaagaatcctgtggagcaccattataaagatgtttgtggccgggtattgtggctcacgcctgtaatcccaacactttgggaggccgaggtgggcagatcacttgaggtcaggagttcaagaccaccctggccaacatggtgaaaccccgtctctactaaaaatacaaaacaattatctgtgcatggtggcgggaacctgtaatcccagctactcaggaggctgaggcaggagaatcacttgaacccaggaggcggaggctgcagtgagccaagatcacgtcacttgcactccagcctgggagacacagcgggactctgtctcaaaaaataaataagtaggccgggcgcggtggctcacgcctgtaatcccagcactttgggaggctgaggcaggcagatcacgaggtcaggagatcgagaccatcctggctaacacggtgaaaccccatctctactaaaaatacaaaaaaattagccaggcgtggtggtgggcacctatagtcccagctactcgggaggctgaggcaggagaatggtgtgaactcaggaggtggagcttgcagtgagccaagatcgtgccacaaagcactccagcctgggtgacaaagtgagactccgtctcaaaaaataaatacataaataaataaataaacaaacacataagtaaataaaagtaaagacggtcaagacccttttcaggatgggaaaactgaggccagataggctaagttagtggcccaatcacacacacggcatgtaaggaagaggtgggggcaggaaacagatgcaatgtggggttgaaggcaggacagagcagcagaaagataaggagggaagctgctggctgggtgtggcatggcagggcctgctcaccagagaggctcttggcgcagttcttgtccctgcggaggtcgtgatcctggtcccaagtggagaagggtacggagaggccgctgggtgggacggtggtggcgcccagctggccggccacgggtgcagtgagctgcaggctataggccgtgtcctcgccacccaggtgcacggagaactgcagcaactcggcgttgccatcccagtcccgcagctgcacggccaggcggctgttgcggtcccccgtgatgctatgcaccttctccagacccagccagaactcgcctggagtgggagaggccactccatgaggcagggccacttctgagggtccctcttcctcccctgcctctgtccccactagaaacacctaccgtggggatccccaaaccccgccttgtaggcttcccagggccggttgaagtccactgagccatcgtggcgcctctgaattactgtccagcctccatctgcccagaaaggtacaaggtcaccaggaagtccctcttcacagacgaccccactccctcatctggctgccaagcaccaaaccccctccaaacccaggaagacagcagctccctcactcatccctggaggactcgaggagggtgggtcagagggaggaatattatgggctggccttgggaagatctttgtcccaagaacccagcagggactgagtgtgggagggagtaggcagtggaaatctgcaaagcctctctgggccagctgaactgggtaaaaccccgtgttgtaacctcttgtaatggaaaggacttctcagtggaaaaaaaagctttctttttttttttttttttttttagagatggagtctcactctgttgcccaggctggatcgcagtgccgcaatctcagctcactgcaacctctgccttcggggctcaagcgattcttgtgcttcagccccacaagcagctggaatcacaggcacgcccggctaatgtttatgttggtagagatagggtttcaccatgttggccaggctggtcttgaacttctgacctcaagtgatttgcccgcctcagcctcccaaagtgctggcatttcaggtgtaagccaccgtgctcagcctttgtttttttttagaaacgaggttttgttgtgttgcccaggttggagtgcggtggctattcacaggtgtgatcacggctcacggcagcctttaactcctgggctgaagtgaccctcctgccttggcctcccgagtagctgggactacaggcatgtgccaccatgcccagcaagggctgaattttattttattttattttattttctcttttttatttttttgatggggggacggagtctcgctctgtcgcccaggctggagtgcggtggcgtcatctcagctcactgcaacctctgcctcccaggttcaagagattctcctgcctcagccacctgagtagctgggattacaggtgcacaccaccatgcccggctaatttttgtatttttagtagagacggggtttcaccatgttggtcaggctggtctcgaactcctgacctcgtgatctgtctgcctcaacctcccaaagtgctgggattacaggtgtgagccactgcacttggcctttttttttacttttacaaaattttttgtaaagatgagctctcactatgttgtccaggctggtctcgaacttctgggctcaagtgatcctcatgataggcctcccaaagtgtcgggattacagatatgagccactacacccagacaagggctgcattttaaagaaaagaggccaggagcagtggctaatgcctataatcccagcattttgggaggccaaagtcggcaaatcatttgaggtcaggagtttgagaccagccagaccaacatggtgaaacccagtctctactaaaaatacaaaaattagctgggtgtggttgctcgcacctgtagtctcagctactggggaggctgacgctggagaattgcttgaacccgggaggcggaggtttcagtgagctgagatcgtggcattgcactccagctccaagagcaaaactccatctcaaaaaaaaaaaaaaaaaaaaagaccagcttgggcaacatagcaagaccctgcctttaatttttttgttttgttttgttttcaatttaaagaaagacaacagggcctatggggagaggggcccctggtggactaacacaccctacctgaggtcatcttgcagttcaccaaaaatggcggagacccctgaggctggatttcaaatagtccactctgcctctccccaacctggaacagctcctggcaatccctgggcagccctgaagggagataaagtggagacttgaaacaggagggcagcccctggggggggtctcaggagccaggcatatctgggggcttaacagtggatgaccagggaagtaaaaggcaaatcttatctcatgaccacctctctgccatctgcctaacctcttccatggctccctatgtccttcctcagcatggtccacaaggcacctggaggaccagcccccgtgcccatcctcctcctgccatgctgtacccacaccctctctggcacacaggctttcttcccacccttgtaccacacaccgtcctgccacagggactttgcacatgctgttccccctgcctgggactctctttttttgttttgttttttgatacggagtctcgctctgtcgccaggctggagtgcagtggcgcaatcttggctcactgcaacctccgcctcccaggttcaagcaattctgccgcagcctccggagcagctgggactacaggcatgtgccaccacgcccgactagtttttgcattatttgtagagacgggggtttcaccatgttggccagactggtctcgatctcctgacctcgtgatccgccagccttggcctcccaaagtgctgggattacaggtgtgaaccactgcgcccggcgggactctctttcctcacttctctctctgggtcccagcttctggaaggacaccctgccttgcctcacccccagaccaggccagaacaccccaaatgggaattgagcaaggacttcccactcctggacactgaggtcatctaatggtctctcctctgactcaatggaggctccatgaggctggggacaaggagcagctctgcccacagcctggcaccagcatccacgcaggccccagcgcatagcagctgctcaataaagacttgaggaatgggccgggcgcagtggttcatgcctgtaatccagcactttgggaggcgggcggatcggtcaggagtttgagaccagcctggtcaacatggccaaaccccatctctagtaaaacatacaaagattagctgggtgtgatggtggacgccagtaatcccagctccttaggaggcagaggcaggagaatcacttgaacccgggaggcagaggttgcagtcagctgaggttgaaccattgcactccaacctgggtgacagagtgagactctgtctcaaaaaaaaaaaagacttgataaatgaataaaaattagctgggcgtggtggcggtaggcgcctataatcccatctacttgagaggctgaggcaggagaatcacttgaacccagtgggaggcagaggttgcagtgagctgagattgcgccactgcactccagcctggacaacagagcgagactccgtctcaaaaagcaaacaaaacagtcttgacaaatgaatgaatgaatgaatgaatgaggcagcaggtccagaacgggaagaactgtgctgagcaggagcatctcagaggctctgcctggggtcccagctcctagagggagaggaggcagggttgaggaaagaaagagggagggaggaggggaggatggcgttgagcacgtctggaggctcagacgctccagactgggaggaaccgcccccagcccagccggaaaagtaggggaaaggtcgaaatgagtctgcacggtgggggtgggggcgggcccagagtgaccaggaagacgctttccggcccctcaggcatctcccctttcccctactttcctcccatccagtaaggatgggcacgcggccaaaccaccagtgtggcttccatgaatgccagctgttcgccttcccagctctgaactttctcctacttggcgggcctgagccaagagtctgggagtcccgaacccacagaacccctgcccccttccaccgcatttcccagccaggacttgtgccttcccccgtcaccctccagaagcccctcatcctgggatggtggctttgggagggtggacaggaccctgaccacgctgagatgctagcctggcggggttgggggcgggcagcacggaggtgggaaggagcgggagcttggggaggagagaaccctcaggtctacagtgctggaagcctgccactgaccctagggtgtgagagggggatccaaactttcacccagttggctgtggacagccacagatgcagggaaggatgaggaccacagagaaaccgtgtggggccgtgaacttagagaaccgcgagtctgcatcggacacacgtggacatgctgtggttcgagatgaacggagatttgggaataaagcacctacaacttgtggtggcagcaaaagcccactttctgcggtggggagggggccggcgggggcggggagggaggaggagaacaagagaggaaggaggaagaggggtcagggacctggagcattggatttgtaagatacaagagtgtttctggtctgggagctgggggttcccagccctaattcccacataccccaagacattgtggagggcccaaatctacaaacactactacctggcaccccctcctccatgacaccctcccctagaaggttctaaccttcaggatggcaccccgaaccccatttctaccttctccagcacccctgcagctcaagtccctcaagacctctttctccacctctgttccaatcagtgatcagcagggcttcagggacagcccactggcttgcagaggagaagggttgggtggcctggctgggccaggtcagggctgaggaaggaggtgctcccatcagctttgacccagagactggtgagccctcagggactccaggccaggacatcttctccttaaggtggacctgacaaggagaggaccagcaatggcaagtggcggggtaggggtggccaccggagagcatcgaggggcagacactcacggtgcaggcggctgacattgtgagccgggtcaactggctgggccatctcgggcagcctctttcttcgggcaggcttggccacctcatggtctaggtgcttgtggtccaggaggccaaactaggatgggacgggaggagggtgtcaggtcctgcctggccccacgtccccagccacacgtccagttctcaccacctccctctcaacctggggtccagctatcagagggaccttttctcccttgatcctagggttacctggctttgcagatgctgaattcgcaggtgctgcttctccaggtgccgctgctgctgggccaccttgtggaagagttgctggatcctgctgttctgagccttgagttgtgtctggggaggggtgaaaaccttggtgaggacccagcttgcctaccccaacctcttaattcatccactcatccatccttccaaatctccatccgctgaggccaggcaagggagtctttcttttttcttttttttcccaatgacggggtctcgttctctcgcccaggctggagtgcagtggtgctgtcacagctcactgcagcctccaactcctggggtcaggcgatcctcctgttttcagcctcctgtgtagctgggactacagtcatgcagctctatgcctggcttattttttattttttcagacagagtctcgctctgtcacccaggttggagtgcagtggcgcaatcttggctcactgcaacctctgcctcccagactcaagtgattcttgtgtctcagcctcccaagtagctgccaccacacctggctaatttttgtatttgtattttattttatttattattattattattttgagatggagtcgagctctgtcgcccaggctggagtgcaatggcatgatcccggctcactgcaacctccgcctcccgggttcaagaggttctcctgcctcagcctccccagtagctgggattacaggcgcccaccaccacacccagctaatttttgtatttttagtagagacggggtttcactgtgttggtcaggctggtcttgaactcctgacctcaggtgatccactggcctcgccctcccaaagtgctgggactacaagcgtgagtcaccgcacctggctttatttttattttatcgctattatttttttgaggagtctcactctgttgcccaggctggagtgcagtgctgcgatctcggctcactgcaacctctgcctcccgggttcaagagattctcctgcctcagcctcccaagtagctgggattacaggcatgcacaccatgccaggctaattttttgtatttttagtagagacgaggtttctccatgttggccaggctagtctcgacagcaggtggaggctccgtgagccactgcgcccggtcgttttttaattttatatttattttattttattttatttattttgtgtgtgtgtgtgtgtgtgtgtagaagagacgggggtctcgctattttgctttaggtggtcttgaattcctggccttgagcgaacctccctcctcggcttcctaaggggggagcccatcccttgacgcagggaagcccagggagccacagttgcgcaccccgcccccacgccccactcctgtccatacccttccaagccaggagagccactaggggcgcggagaaccagccctggggacacgtacctgcaggctgtgaaggacctcagggtccacccggctctcaggggctaacgggaggtcggtggacccctcggttccctgacaggcggacccgcacgcgctcaggcgccgctccagcgcgctcagctgactgcgggtgcgctccgcgtgttcgcgcagcccctggccgagctgcaggagtccgtgcgccaggacattcatctcgtcccaggacgcaaagcgcggcgacttggactgcacgggtccgccctgagcgctcagtagcacggcggtggcggcgcagagcatcagggctgccccggccgtcggagcaccgctcatcctcttaggtagcctgggagcggggattcggggactctcggggacgttggggttccaggtgcgaggactggagacgcggaggaccgggggtaagacccgcttggttgcagaagccgctggaaagaatcggatcacagtcgtgtgaggatccgctcagctcggcttctccccgccgcgcccgaggacggtttttataagttgggtgcggagtgggcggaggagtcttggaggcggggtgcggggagtgctgggggcagggcctgtggccgggggtggggtcctgtcctctggaggcctggtagtctgcgggctgggggatgccctggggatgccaaactgtggctctcccgcccccgctccaggctcaggcaggccttcctctacgaaccgtgggagacgtgactcttctttcccccacggtgcccgcctctagtgtgaaattgcaagccccctattccgcccccgccttacccagtggcggagagggcgcacgcttgaggtcaagacttccagaccagcccggccaacatcgtgaaacccagtctctactaaaaatacaaaaaaaaattagccgggcttggtagtgcgcgcctgtagtcccagctactcgggaggctgaggcagtagaatcgcttgaacccgggaggtggaggttgcagtgcgccgagatggcgccattgcgctccagcctgggcgacagagccagagtacgtctcaaaatgaaagaagagaaaagaaaagaaaagaaagaaaagagagagaaagaaggaaagaaggaaggaaggacggaaaaagaaaagagagagaggtagggagggagggaagaaggagagagagagagaaaagagagagagaaaggaaagagagaaagaggaaggaaggaaggagggaaagaaaggaagaaggaaagaaaggaaggaaaagaaaaagagctgagttcagcggagcccggaactcaccaaaagtccttgccttgcggaggcttcgtgtgacctccatcccaagaccaggagagacttttctgggctcgcatgttccttcccgtgaaagggttcgtcatcgcagctgtgtttatgagattctttgacttccatttctcccctgagcccgaaattatgagtgccttagcggcaggacttggatcagggcctcacccccatagcctaccctctaccgccagggtctttaatgtcctgagctttgcctataataaagcaggaacttagagaacagaaagaggagacacaaggaagggaggaaccagggcggtcgcccatgactgtggtcgcagctacttgggagcctgaggtgggaggctcacttgagcccaggaggtagaggctgcagtgagccacaatggtgccactgcactccagcctgggcaacagagtgagatcctgtctctaaaaaagaaataaaataaaagtctgtggccaggcgcggtggctcacgcctgtaatcccagcactttgggaggccgggtggtgggaggggggggggggcggatcacctgaggtcaggggttcgagatcagcctggccaacatggtgaaacctcgtctctactaaaaataaaaaattagccgggtgtggtggcacgtgcttacagctactcgggagactgtgtcaggagaatcgcttgaactcaggagacggaggttgcagtgagctgagattgcaccacagcactccagcctgggtgacagagtgagactgtgtgtcaaaaaaaaaaaaaaaagtttcagacatggaagaccttcctctttctctccctcattcattcattcactcatgcactgaacgaaggtgctgctgccctctaagcccagcccctgtatgtttgaagttctcaggcaggtggagataccccaacattctgagcctggggtagggatagagttgggacaaaggaagtactgagtgaggctaaagggctggaccacattcattccacagggctaagtgttcattcaaacttgcaccgatctcctctgcctcttccctacccattcccctataccctgtcaggaaggggaggctggcacagaaaaccagcctgccaggaagaactcggggcaggttggctcagagcactggcaaggagaagggcattgactcagcagggctccaagccagctcattctctggaatctgaaactgcacacccaagggctgacgtgcaggctgccactcatacacttggccccgtcagctgggccagatgccaggacagcaaatccctcccagcagcagtggacaggaaagggagggaggaaaaccccagtgaggagtaggttcagatggtcaccgtctggcctgtccacccccaagcccccagcctctctctgagtagggacacagctatcccaggctatcccagaatgcaagctcctcctcttccccaccttcttaaactgagagaactgatcaattacttccccaacctgatgaccttttcatgatctgattttcagggacttctttggagccatgtgtcccacagcacaaaacacatcacagacccagggtcttaagggcacctgctgtgagcaatctacaaaagagtctatactgtcgcctcaagttggctctagattttattctaaaaactgctctttattttttatttatttatttatttatttatttatttatttattttttgagaaggagtctcgctctgtcgcccacgctggagtgcagtggcgcaatctcggctcactgcaagctccacctcccgggttagtgccattctcctgcctcagcctcccgagtagctgggactacaggcacctgccaccatgcccagctaattttttgtatttttaatagagacagggtttcaccatgttagccaggatggtctcgatctcctgacctcgtgatccgcccgcttcggcctcccaaagtgctgggattacaggcatgagccaccgcgcccagcctattttttattttatttatttatttttttgagatggagtttccctcttgtcgcccaggctggagtgcaacggcgcaatctccgctcactgcaacctctgcctcccaggttcaagcgattctccagcctcagcctcccgagtagcggggattacaggtgtgcaccaccacacctgactaattttttgtatttttagtgcaaacggggtttcactatgttggctctgctggtctcaaattcctgacctcaggtgatccacctgtctcggcctcccaacgtgctgggattacaggtgtgagccactgtgcctggcctagccttttttttttttttttttttgagacagagtcttgctctgttgcccaggctggagtgcagtggcctcatctcggctcactgcaagctccacctcccaggttcccgccattctcctgcctcagcctcctgagtagctgggactacaggtgcccaccaccacgcccgctaattttttgtattctagtagagggggtggggtttcgccatgttgcccaggctggtctcaaactcctaagcttaggctatccaccacctcagcctcccaaagtgctaggattacaggcatgagccaccacgcccagccctgttttatgtatttttttttttttttctgagatgggtctcactcacccaggctggagtgcagtgtcacaatcacagctcaccgcaacctcaaactcccaggctcaagtgatcctcccacctcagcctcccaagcagctgggactataggcatgtgccaccagacctgcctaatttctgtagattttgtagagacaggatttttgccgtgttgcccaggctggtcttgaactcctgagctcaagggattcactcgcctcggcctcccaaagtgctgggatgacaggtgtgagtcactgtgcctggccaaaaactgacctttagaatgtggcctcttacccagcaaagacaaagtcatcctgatcaattgttcctggagcacctactatatgccaggcactgtactggggcgatcacggtgggcaagaccgggtctccaatcccaacgcgtgggctactttggccaacatagttaaaaattgttaaaatgaccaattttatattatgtatatttctttttttctttttcttttttttcttttcttttcttttttttttcttttttttgagacagagtcttgctctgtcgccaaggctggagtgcagtggtgcaatctctgctcactgcaacttccacctcctgggttcaaatgattctcctgcctcagcctcccgagtagctgggattacaggtgcccaccaccacgcctggctaatttttgtattttagtagagacggggtttcgccatgtccaggctggtctctaactcctgacctcaggtgatccgcctacctcggcctcccaaagtgctgggattacaggtatgagccactgcgcccagcctgttatgtgtatttcactacaaatgtaaatgccattaagctaggcaaggtggctcatgcttgtaatcccagtactttgggaggccaaggtgggaggactgcttgagcccaggagttcaagattgggtaacatggcaagaccctgtctgtacaaaaaatttaaaaaattagctggggccaggctgggcacggtggctcatgcctgtaataccagcactttgggagtccaaggtgggcagatcgtgaggtcagaagttcgagaccagcctgaccaacatggtgaaacccggtctctactaaaaatgtaaaaattagccaggcgtggaggcgcgcgcctgtaatcccagttactcgggaggctggggcaggagaatcgctggaacccgggaggcagagggtgcagtaagcagagattgcgccactgcactccagcctgggcaacagggcgagactctgtctcaaaaaaaaaaaaaaattagctggggcccggcatggtggctcacacctgtaatcctagcactttgggaggctgaggtgggtggatcacttgagtctgggagttcgagaccagcctggccagcatggtgaaaccccatctctactaaaaatacagaaattagcaggcatggtggtgtgtggccgtaatctcagctatttgtgaggctgaggtgggagattcgcttgaacccaggaggtggaggctgcagtaagcggagatcgtaccattgcactccagcttgggtgacagagcaagactctgtctcaaaaaaaaaaaaaatagctaggcgtggtggcacattcctgtagtatgagctacttgggaggctgaggtgggaggatcatttgaacctgggaagtcgaggctcaaagctacagtgagccaagattgcacccctgcactctagcctaggggacagatcaagaccctgtatccaaaaaataaataaacacacatagagacataaaatataaatatatataatacacacagagacacatacatatgcaatacacataaagatatatatatacatatatggagagagccacacttacatacagagagatacatatatataacatacacaaacaggctgggcagggtgtctcacacctgtaatcctgacactttgggagactgaagtggcaggattgcttgaaatcagggatttcagaccagcctgggtaacaaagtgagaccccatccctccaaaaaataaaagattagggctgggcgtggcggctcacgcctgtaatcctagcactttgggaggccgaggcaggcggatcacctgaggtcaggagttcaagaccagcctggctgacatggtgaaaccccatttctactgaaaatacaaaaaaaaatcagccgggcatggtggcatctgtaatcccagctacttggggggctgaggcaggagaatcacttgaacccgggaggcagaggttgcagtgagccaagattgtgccattgtattccagcctgggtgacaagagcgaaactccatctcaaaataaataaataaatataaaaataaaaaaataaataaaataaaaaattagccaggtgtggtggtgcctacccgtactcccacacgtactcaaggaggccgatgcaagaggacaacttaagctcaggaggtggaagctgcagtctgctatgatcgtaccattgcactcccatttgggcatcagagtgagactctgtcccaaaaaaaaaaaaaaaaaaaaaagaggtctggcacggtggctcaggcctgtaaactcagctcctcgggaggctgagggaggagaatcgcttgaacctggaaggcagaggtggcagtgagctaagactgcgccattgaactccagcctgggtgacagagcaagactccatctcaaaaaaaaaaaaggccgggcgcgatggctcacgcctgtaatcccagcactttgggaggccgaggcgggtggatcacgaggtcaggagatcgagaccatcctggctaacatggtgaaaccccgtctctactaaaaatacaaaaaattagccaggcgtggtggcaggcacctgtagtcccagctactcaggaggctgaggcaggagaatggcgtgaacccaggaggtggagcttgcagtgagccgagatgaggccactgcactccagcctgggcaacagagcgagactctgtctcaaaaacaaaaaaaacaagaaacaaaacaacaacaacacacacacacgtatacgtaatacataagtgcataagtgcatagatagataaaatacactcacatagagacgtattcttatatatttatataatacactcatgcagggtgagataatacacacttttttgtacatcttctttttctgacccacttaaggatatattgcacacataacgtgtgccttttgccctttactaagaaaaaaaagtgtttatataaccgtggtacagctagcaatttcaggaaatttgaccctgacatagtactgttatctaatctatggtccatattccagtttcatcaattgtgtcaagcatgacctgaacagctgtggtttgtgtttctgtttgttttcctttgttttggagacagggtctcactctgtcattcaggctggagtgcagtggtgcgattatagctcactgcagcctccaactcctgggctcaagtgatcctcctgcctcagcctcctgagcagctgggactacaggcacatgccaccacaccaggctaattttggtattttttggtagagacagggtttagttacattgcccaggctggtctcaaacttgaactcctgaactcaggcgatcctcccaccccggcatcccacagacctgggattacaggcatgagccactgtgcctggccacagctgttttttgttttgttttgtttttttaaaaaaaactgagtctccctcttttgcccaggctggaatgcagtggcatgatctcagctcaccacaacctcagcctcctgggttcaagcaattctcctgcctcagcctcctgagtagctgggaatacaggcacacgccaccatgcccagctaatttttgtatttttagtagagatggggtttcactatgttggtcaggccggtctcgaactctgacctcatgatcctcccggatacactataatgtgctaggattacaggcgtaagccaccgcgcccggcctcacagccatgttttttatgagcaggaccctatccagaatcatccactgcatttcattgtcatatcctgttggtcctttttttttttttttttaatctgagacagggtcgttgttatgttgccgaggctggtctcaaatctggactcaagcaatcttcctgcctcagcctactgagtaactgggaatacaggtgcattcgctataccaggcagggcactggcattttttgagacacggtctcactttgtcaccaaggctggagtgcagcagtgagatcacagctcactgcagcctcaacctcctgggctcaagtgatcctcccacctcagcctcctgagtagctgggacaacaggcataagccactatgcctggccaaacactgatattttcgagatgtacacaccggttttttgtagcacgtcctccattttgcatttgtctgatgcagatgtttcttccccttaaggtgcctgttatgtatttttggcagtgatgttgtgtccttctcagtgtatgatatcaggaggcacatgatatctgtttgctcattggcaccatgaatggtgctaagatttaactacataagttgaatcctagatggtcaatgctgcaatggggtaagcacacaggcctagaagagtatagaaaagatgtcaatcccattaggtaaggattcctggagcaggggtcctaagactgagagatgcttgacagagtcctagacaaagtgtacaggaaatagatgactcaggttcaaggaagagcatgaaaaattctctctggcttgagacatgcaggattcttctcagacaagcccacaaggttgttaggactatgtaatggcacatcgtgtccagtgactggcctctaccgcccccagcaactaaccacagtcttcctgccacactgtactcacatccaggtcaccaagaaaggtcagcccaagagcaggacctcaaacactcagggcagaaaggatgactcagaatctgggctggtgctcagaagggaacggggttgcctttccaccctcccctattagcttttccccataattccttccagtctgggaacttgtacattgcagggcagacagctatgaagtcactaaggaaataataactgtagcagcgtacatttatttagtgccacctttacaccatcagacacttgtgtaatccattttatctcaacctcaagtcggtccctgaaaggagataaattgagcttctgagacctttaggaatttggacaaagtcacacagctcagaagggtcaagatttgaacctaggccaggcgtggtggctcatgtctgtaattccagcaatttgggaggctgaggtgggcagattacctgagatcaggagtttgagaccagccaggccaacctggtgaaaacttctctctactaaaaatacaaaatattagctgggcatggtggtgagtgctacctcccagctacttgggaggcggaggcaggagaatcgctctaacctaggaggcagaggctgcagtgagccaagatcgcacaactgcactccagcctgggtgacaaagccagaatccatctcaaaaaaagagataaaaaaaaagatttgaacctagttctctttagttccaaaccattgaatctctctttctgtcttttaagacggtggcgggggagggcacgtggggtggtggtgggatgtcttgctgtgttgccaaggctggattggaactactgggcccaagaaatcctcccatctcagcctgctcactagctggaattaacggtgcccaaaaccgtgacctcttttattttatttttcatttaattttgttgttgttttgtttttgagacggagtctcactctgtcgcccaggctggagtgcagtggcactatctcggctcactgcaagctccacctcctgggttcatgccattcgcctgcctcagcctcccgagtagctgggattacaggtgcccgccaccaggcccagctaattttttgtatttttagtagagatggggtttcaccgtgttagccaggatggtcttgatctcctgatctcatgatccgcccgcctcggcctcccaaagtgctgggattacaggcgtgagccaccgtacctggcctatttttaaagcttgtcattgttttgtaatttacgatttatttatttatttatttgagacagcgtcttgttctgtcacccaggctggagtgcagtggggcgatctcgacttactactacctatgcctcccagcttcagggggttcttatgcctcagcctcctgagtagctgggattacagctgctggccaccatgcccggctaatttttgtatttctagcagagactgggtttcaccatgttgatcttgaactcctgatctccagtgatccacccgcctcggccttccaaagtgttgggattacaggcgtgagccatcgcgcccagcctatttttatttttgggaaattatttttacaacaataagaaaaagctagagatagattcccccactaccccccaccccgaaaattccttctctgtatatacccggtttgacaaccgcggccccggggggtttaccctagatagcagcgccctctggtggtgaactcgagagcagctgttctggccgctcagacgcgctcctttcccgctgatcccaggcgcctgagaggaagttcaaggcctcctggcggctgcccgcccgctgtgggaggctcgagaagactgagtaaatcaagggggaagtggagatgatgacgacgatgatgatttttgagacagagtctcgctctgtcgcccaggctggagtacagtggcgcgatctcggctcactgcaacctacacctcccgggttcaggggattctcctgccttggcctcccaagtagctgggactacaggcgcacgccaccacacccgactaacttttgtatttgtagtagagatgaggtttcaccatgttggccaggctggtctcaaactcctgacttcaagtgatccacccgcttcagcctcccaaattgctgggattataggcgtgagccactgcaccccggttgagacagtcttgctcttggcccaggctgcagtgcagtggcgtgatcatagcttactgtagcctcaaattcctgggctcaatcaattctgccatctcagcatcctgagtagctgggactacgggaacatgctaccatccccagctaatttttaaaaatgtctgctgggtgcagtggctcatgcctgtaatcccagcactttgggaggtcgaggcgggtggattacgaggtcagcagatggagaccatcctggctaatgcggtgaaaccccatctctactaaaaatacaaaaaattagccaggcatggtggcaggtgcctgtaatcccagctactagggaggctgaggcaggggaattgcttgaaccctggaggcggagcttgcagtgagccgagattgcgccactgcactccagcctgggcgacagagcaagactctgtctcaaaaataaataaataaattttctagagacagggtcttgctttgttgcccaggctggtctcaaactctcagcctcaagcaattctcctgtcttagcctctcgaggcactaggattacaggcatgcacaccacaactggccaatgctgtcttttgaagctcctgactggggccaattagctctcatgtcaggggtgtcaatgttctgagacaggccgggcacaatggctcacgcctgtaatcccagcattttgggaggcagaggtgggcggatcacctgaggtcaggaatttgagaccagcctcgccaacatggtgaaaccctgtctctactaaaaatacaaacaattagctgggctgatagcaggtgcctgtaatcccagctactggagagactgaggctgaagaattgcttgaattcgggaggcggagcttgcagtgagctgagatcgcgccactgtactccagccttggcgacagagcgagactgtctcaaaaaaaaaaaaaaaaaaaaaaaaaaaactgttcagagacaggcgcagtctctctgggcagttaagcattccagatgggggcaggggtgccttggagtttccaggaggcccctaaaatggcaaaggagctgaaagtggctcccaaggggttcaatgtattctggagtgcccgggaacctcctccctctctcttttcttttctgactcaagcctcagcctgggacagggtgggagagagaagggtcacattttctaccatgaacacccagggtattaggaatgtgggggaggagggaagttgtttaagaggtctaagagcatcttcctcacccacgcaagcaaaattccttttctttctttctttctctttccttctttctttctttctctttctttctttctatttccgtccctccctctctctctttctttcttttctcccctctttctctctttcttccttccatccttccctccctccctcctttcttcctttttctttccttctttttctttctttctctttccctccctccctctttttctttcttcttttcccccctttctctcttccttccttccttccctccctccctcctttctttctttctttctttctttctttctttgtctctcttttctttctttcttttttttttgacagagtctcgctctgtcacccaggctggagtgcagtggcgcgatcttcgctcactgaaacctctgcctcagcctcctgagtagctgggattacaggtgcacagcaccatgcccggatacattttttagttttagtacagatggggtttcgccatgttggccaggctggtctccaacgcctgacctcaggtgatccgcccacctcaacctcccaaattgctgggcatgcaggcatgagccaccgtgcccggccccttttctttcttatacctctccccactggctagctaggcaggaatactcttcagaaattcttggtctgcagggagcttgaaatcacctttcaatctttccattcagtgaaaatttattgagtgtctactgtgtgctgagcacctgtggtgggattctgagtagctgggattacaggcgcccaccaccacaggctggagtgcaatactgcactctcagcccattgcaacctctgcctcctgagttcaagtgattctcctgcctcagcctcctgaagagctgggattacaggcgcacgccacaatgcccagctaaattttgttttttttttttgagacggagtctcgctctgtcacctaggctggagtgcagtggtgcgatcttggctcactgcaaactccgcctcccgggttcatgccattctcctgcctcagcctcctgagtagctgggactacaggcacccgccaccacgcccgtctaattttttgtatttttagtagagacggggtttcaccgtgttagccacgatggtttcaatctcctgacctcgtgatccgcctgccttggcctcccaaagtgctgggactacaggcgtgagccaccgcgcctggccaatttttgtattttcagtagagacgagggtttcaacatattggtcaggctggtctcgaactcctgaactcaagtgatccgcctgcctcagcctcacaacattctgggattacaggcatgagccaccactctggccgcaatttccaatctccttttctctctctctgtctctctctctctctctctctctctcacacacacacacacacacacacaaacacacacccctctgcttccatcataacaccttctataactctgaccctcctacctttctcttcttttttattttgagacagagtctctgtctttcaggctgaagtgcagtggtgtgatcttggctcactgcaatctctgcttcctgggttcaagagaagtgattctcatgcctcagcctctggagtagctgggactacaggcatgcaccaccatgcctggctaaattttttgtgtgtttttagtagaggaagggtttcaccatgttagccaggctggtctcgaactcctggcttcaagtgatctgtccgcctcagcctcctaaagtgctgggattacaggcgtgagccactgtgccagccataatgattttatgttatgagacagggtctcactctgttgcccaggctgcagtacagtggctcaatcatggctcactgcaacttcgacctcctgggctcaagcgatcctcctgcctcagcttcccaatgtgctgggattaccggaatgtgtcactgcacctggccaataatcaggtttttatcttgcctttcttctctaaaagtgtcactggaaaaccagatagtacataagaagaagtatcttgcataaaaaaaaaaaaaagaattcaactaacaaataaggacgaaatggccaggcgtggtggcacaagcctgtaatcccagctactagggaggctgaggaaggagaatcacttgaacctgggaggcagaggttgcagtaagctgagattgtgccactgcactccagcctgggtgacagagcgagattccatctcataaaaaaaattaaataagtaaataaagaaggaagaaacacaagagatatgacatcactattttgtaatctctaaggagttaattctcgatggctactggactgaggaaaggaggcacagccaaacatcacaagcctcctagtgaaagaacagaacgccatcagtagtcatgtcaaagtaatcaaatctgagtctgaccccagttctagaagcaaccgccaatttgcagggaataccaaggacagaagaacatcctgaactaactacacaatgagtgtaggatcagcaacatttagaccataggaaacacttcaggacaagcagccaattgtgcgatcctttttttttttttccttccttccttccttccttccttccttccttccttccttccttccttccttccttctttccttcctccttcccttcccctcccttcctcccttcctcccttcctccctttctctctttctctctttctttctttctttcacagggtctcactctgtttcccaggctggagtgcagtgatgtgatcacagctcactgcagccttgatcacctgggctcgagcgatcctcccacctcagcctccccagtagctgggactacaggtgcatgccaccatacccagctaatttttgtagtttttgtagagatggggggtctcactatattgcccaggataatctcgaactcctgggctcaaccgttcctgctgcctcggcctcccaaagtgctgggattacaggtgtgaggcaccatgcccaggcatgcaatgcttctattgtaagggaaagggagggatggagaggaacctgtgaattaaaagaggcttaggccgggcgcggtggctcacacctgtaatcccagcactttgggagtcccaggtgggcagatcacctgagatcgggagttccagaccagcctggccaacatggagaaactccatctctactaaaaatacaaaaattagccggacgtggtggcgcatgcctgtaatcccagctactcaggaggctgaggcaggagaatcgcttgaatctaagaggcagaggttgcagtgagccaagattgcaccactggactccagcctgggcaacaagagtgaaactgcatctcaaaaaaataaaattaaaaataaataaataaataaataaacaggcttaggccgggcgcggtggctcgtgccagtaatcccaacactatgggaggctgaggctggtcgatcacaaggtcaggagatcgagaccatcctgaccaacatggtgaaaccccatctctactaaaatacaaaaaattagctgggcatggtggcttgtgcctgtagtcccagctgctctggaggctgaggcaggggaatcggttgaacctgggagatggaggttgcagtgagccaagatcacgccactgcactctaacctggtaacagagcaagactccgtctcaaaaaaaaaaaaaaaaaaacgggcagggggagcttaaaagacatatcattttctttttgaatgggcaagactaaactccagtgtctacagattcacatttggataataaaactatacatgtgcagtggcgctcacctgtctcccagctactcaggaggctaaggatcatttgagcccaggagttccaggctgcagtgagcattgattgcaccactgcactccagcctgaacaatacagtgagactctgtctcgaaataaataaataagcaaacaaacagaaacctacacagggccgggcgtgttggctcatgcctgtaatcccagcactttgggaggccgaggcaggtggatcacctgaagccaggagctcaagaccagcatggtcaacatggtgaaaccccatctctactaaaaatacaaaaaatctggtcatggtagcgggcacctgtaatctcaactactcaggaggctgaggcaggagaatcatttgaacccaggagactgcagtgagctgagatcatgccactgcactccagcctgggcaacagagcgagattctgtctcaaaaataaataaataaataaacaaacaaataaataaaagtcacaaaacagtggttacttagggagtgaggggcagctgtgactaggacatagtccacggaggcgcttctggggtagctggcaagtgcagttggttggcccgggtggaggcgacgatgaccttcatctcagcactgggtttctgaaacttagcactcttgacattcaggccacataattcttggtccttggggatggcctgtgcattgcagggtggttagctacattcctggcctccgccctctagaggccaaaaacacccgcctcctcattacccaaaagtgctcctggatattgtcaaacattctcccatggggcaaaatcactcctggttgagaactaccccctggaggaactccttaaactatacatttgtggggttttttgttgttgttgttggttttgttttgttttttgtttttgttttttacttttaattgcatttattttaatgctgaatttactcccatgccataagtttttgtttcttcagtttcttctgggatatctttttctttcttttttttttttccgagatggagtttcactcttgttgctcaggctggagtgcgatggtgcgatctcggctcaccgcaacctctgccacccgggttcaaatgattctcctgcctcagcctcctcctgagtagctgggattacatgcatgcgccaccacgctcggctaattttatattttaagtagaaatggggtttctccatgttggtcaggctggtctcgacctcccgacctcaggtgatccacccgcctcggcctcccaaaatgctgggattacaggcgtgagccactgcgcccggccttgggatatctttttcttttgggcaacctcctcctctggcttaggaaaaatctgttccttttcagtaagaatcatctcagtgtggcagggagaactcattcatgggttaatccgaccggagttccgtaggtctggcgacgcatcttaggtactttgttcacttggatatgctcaatgaccagagaatctacatataacccttaagttcagcattactctctgcattttttttttttttgagacggagtctcgctctactgcccaggatggagtgcagtggcacaatctcggctttgcaacctccgcctcccgggttcaagcaattctcctgcctcagcctccctggtagctgggactacaggcacgtgccaccacacccagctaatttttgtatttttagtagagatggggtttcaccgtgttggccaggctggtctcgaactcctgacctcaggtgatccgcccacctcagcctcccaaagtgctgggattacacgtgtgagccaccatgcccggccactctctgcatttttaagcatgtacagcaaaaattcagcactttttctgggccactgactttgtgtccagccccactgcttggcctgggcacacctgccaactccaccattgtaatgttggaatggtacacacagtttctgtaaagtgacatctttcagatacttcgtggattttcatatatacatacccttgatggcctgggcagtttcatgagtgttctccaagtgaacatgaagatttgaacctcttgatttgcatgattttgtggggttctctgggtcaagtaaatagcgaaccattttcccagattacctcaggccacttagggaaagagtatacatttgttttatgtggtttcttgaatctgctgtgtgtgtgcatctatggacgctttattttacaactatatatatatatatatatatatatatatatatatatatatttttttttttttttttttttttttgagacagagtttcactctcgttgcccaggctggaatgcaatggctcactctcggctcactgcaacctctgcctcccaggttcaagtgattctcctgcctcagcctcccaagtagctgtgattacaggcatgcaccactacactgggataattttgtgtttttagtagagacggagtttctccatgttggtcaggctggtctcgaactcccgatatcaggtgatctgcctgccctggcctcccaaagtgctgggattacaggcgtgagccaccgcacccggccacaataaaaatattttagggctgggtgcggtggctcacgcctgtaatcccagcactttgggaggctgaggcaggcagatcacgaggtcaggagatcaagaccatcctggctaacacggtgaaaccccgtctctactaaaaatacaaaaacagccaggtgtggtggtgggtgcctatagtcccagctattcgggaggctgagacaggagaatggcatgaacccgggaggcggatcttgcagtgagtggagatcacaccactgtactccagcctgggtgacagagcaagactccgtctcaaaaaaaaaaaaaaattatatatatatatatatatatatatatatatatatacacacacacacacacacatatattttaaacattccaatggaggccaagtgcagcggctcatgcctgttatgccactatttagggaggctgaggcaggagaatcacttgaacccaggaatttgcgaccagcctgggcaacatagagagaccctgtccttacaaaaataagaaacctgctggacgtggtagcacatgcctgtagtcccagctactcgggaggttgaggtgggaggattgcttgagtctgggagttcaaggctgcagtgagccataggtcttgccacagaactccagcatcggcaacagagtaaactttgtctcaaaggaacaaagaagaaaattccaatggagtttctgtggggaaacgcgacagaattccacagttttaactgaaagaatcaaccaattaaaatagcccaggaattttgtttttttttaaaaagtatcagatgttaaaatacattttaaaatattactatattctggccaggtgctgtggcttatgcctgtgatcccagcactttgtgaggccaaggcaggtggattgcttgagccaaggagttgaagaccagcctgggcaaagtagtaaaagcccgtctctactaaaaataaaaaaaattagctaggcgtagcacacacttgtaatcccagctacttgggaggctgaggcaggaggatctctttaacctgggaggcggagtttgtagtgagctgagatattgtgccacagcactctaccctgggcaacagaatgagaccctgactcaaaaaagaaaaagaaaacattatttcagcaaacatttattaagcatctactgtgtactagggtcgctggataaagcagttatcaaaaccagtttcctgttcccatggtgctgacacttaatttagagacagagtctcactctgttgcccaggctggtcttgagctgctgggctcaaaagatcctcccacctcagcctcaggaggtgctaggattacaggcatgagccaccccacctggccttggtgccgacactttagtgagatggcaagcaggtaaaccaataaataaccagccaggcatggtggctcacgcctgtaatcccagcactttgggaggctgaggtgggcggatcacctgaggtcaggagttcgagaccagcctgggcaacatggtgaaaccctgtctctactaaaaatacaaaaattagctgggcgtggtggtgtgcgcctgtaatcccagctacttagaaggctgaggcaggagaatcgcttgaaccccaggaggcagaggttgcagtgagccaagatcgcaccactgcactccagcctgggacagagcgagactctgtctaaaaaaaaattaaattaaattaaaaaataaaccaaataaataactgagtgtttcgtttttgtctttttgttttgttgttttcttttgttttgagaactaggtcttgctatgttgcccaggctggtctcaactcctggctcaagctatcctcccatctatgcctccctaaatactggatttacaggcgtgagtcactgcgcctgccaataacagagtctgcttttttttttttttccagatagtaaaagtagctattaggttaatacaatagagtgatgagaaaaatactaactggggaggggctatgtcaggaatttagggggcagcaacacaaaagctgaacctcagaaagtagggaaggccgggcgcggtggctcacgcctgtaatcccaacactttgggaggctgaggcgggcggatcacttgaggtcaggagttccagaccagcccggccaacatggtgaaaccccatctctactaaaaatacaaatattagctggacgtggtggtgtgtgtctgtaatcccagctactcgggaggctgaggcaggagaattgcttgaacccaggaggcggaggttgcagtgagtgtcactgcactccagcctgggactccgtctcaaaaaacaaaaacaaaacaaaacaaaaaacagtaggggagcctcaaaaagtacctacgtgtacaggtgcaagggaaagcatttcaggtaggtggaacagcatgtgcagaggccctgcggtggggaagatccgggacctgatacttcacccaggcactgcgaaataagtgccagttatagaaatcccaccgggttactcttctactcatagttctcccatggctccctcgtgcctgtggatcaaatccaagctccttggcccggcgctgggcagagacttgacctctgctggtgcagaaatgccgccagccagcgctcggcgaccgtcactccagggcccgccctcagtcaccacccctacattccaggccccgcctgcctgtcccaccccaccgtcccactgggcggcttggagagcctcgggtgctggttggctggcgtggccgtcagttagggcgaaggccttgataatcagtccccggacttcgagggggcgggctcgggtgcgggcgcggctggggctgcggcttcaggtaaattgccagcttgcggggacacggatgggggacccctgggtgggtggattcggggacgcaccgggacccggcgctgcgctgcgtttccagccccactgagggctctgcccgctgcgacggggcgggcgtcgtgtcctctggccgggacccctcccacattggaagtcccaggtgggtagcgagcagagtggggggctctggaggcgtgggcttgcccccctctcgcccttcgggagctcactgcggggctcgttcgctccctaatgccacaaccggccctgggaccctttcccgggacggcctggggaccccagccagcccctcgcgctgggctgggtgtgggagcgtgtcacggaaatggtgttttggggagggacgcacggcccccggacccgcagacaatgggtagcggatggaaccgcccggcggcgcttcctgtaggaaactgctctgtctctgtgcggctaggacgacctgggggtggacgggtgatgatgactttaacacccaccttcctgccgccaccggtcccccacccacccacctcaagagtctgagagtcccagcagacatcaggggctgccagtactcagggcctcctggaaggcgccctctccccaggactgggatcctcactggcctgccgtggcccccaccactccggtttggtgatcacagctctgcgtcccaaaatagtccctggggcgggagagggggcgtgtggcgtcggctctgacggcctaatgagggggtctcaggcacagaatccggatctagctgtgacagtcagggcagggagcggaggagagggaaggcagctaaacgccccacttagtgaggccccagcccctgaagccgcagaggtggtgggcacctccgcccccaatcagagtctgacacaggtgtaggctgggagggacaagccccctgaggctccttggtggttcatgcctgttatcccagcactttgggaggtcaagtagggctgatctcttgaggtcaggagtttgagaccagactgaccaacatgatgaaacccgtctctactaaaaattcaaaaattagccagctgtggtggcaagtgcctgtaatcccagctactcaggatgctgaggcaggagagtcgcttgaaccctgggctcagaggttgcagtgagccgagatcctgccactgcactccagcctgggtgacagagactccgtctcaaaaataaaaataaaagaaagcattcaagtgtagtggccaaagcaaggactctggaagacctgcctgggtttaaaacctgcctctgcctgtttatgacaggacccaggcaggacactaaactgttctgtgtctcagtttctccatctgtacaataggggaagggacaatgatcataggaaatccaacctcagtggatttagctaggattttaaaaaataagtcaaggtcaggtgcagtagctcatgcttgtaatcccagcactctgggaggctgaactgggaagattgcttgagcccaggagttggaggccagcctgggcaatatagcaagacacctgtatctacaaaaaataaaattaggccgggcacggctcacgcctggtttgagaccagcctggccaacatggtgaaactccgtctctactaaaaatacaaaaattagccaggcatggtggtgcacacctgtaatcccagctgcttgggaggctgaggcaggagaatcacttgaacccgggaggcggagattgcagtgagctgagattgtgccactgcactccagcctgggcgacagagcatgactccatctaaaacaaaaaaccaaaaaatttaaaatattagcctgaattagccaggtgtagaggtccattcctgtagtctcagctatttgtgaggctgaggcggatcacttgagctcaggggttcaaggccacagtgagctatgatcgagccactgactccagcctgggtgacagagtgagcgagacattgcctctaaaaaaaaaaaaaaaaaaagtaaatatccataaattccttagactagaggctggcccatagtaaatatcaaaagcgttgttattatttgacattctggagggatccattcctttcttagcccagcctctggatccaactgcttcagctagtttaggtcttaggaatggcccacagctgtcttctgagatcccagggcctgggatttgggtgtgaccaggtcaccggaggaggacgctgaccccattgcgtcatacggccagctgtgtgagaagtagacccagaccccccaacccttgatctggactttttccacaacccagttcttccctggcaatttcctgaaaacaagtgatgaacggcattggctgtcctctgcgatgacccgctggcctgttgatccaccccttgcagctggtgtgaagggacgggaaacagctgcttggggactggaagaggccccctgcctggccttggagtgggaagggagaggtcagggacctcggccagacagaagtgggaaatggagttacggtttccccagcggtggagtagggtaatgagtcaggagggctggtgggtgctcagtgcttcatagcatcaggcacacaggtggtcccagggattcgagaagccagaaggggtggctgggagtgttgccatgtggttagcacagacgggccgtggcccagggagaggatgaagtgggtttggcagatgcctgtcagtggaggactggacaggtaaagggcagtcagaagctgtggcagggacctgctgacaagggttccgcagatgggcagagcccaatctgagggtgcttcccacaggcaactgatttaattgttctgtgcctcagtttctccatctgtaaaatatgaataataatactactttgcagtatgcaaagtgttgtatgggggctgtgtgtgtgtgtgtgtgtgtgtgtgtgtatatatatatatatatggttttttttttttgagacggagtctggctctgtcccccaggctggagtgcagtggcatgatctcagctcactgcaacctctgcctcccaggttcaagcgattctcctgcctcagcctcctgagtagctgggactacaggcatgcaccattgtgtccagctatggcgatgacatttaatcaggaagggcacaccgtaggcactttcccctccctgaaggttttccatgtgggctttccaaagcccatctttcccactccatgttcctgtgcttttcttttcttttcttttctttttttttttttttttttttgagacaaggtcttgctctgtcaaccaggctggaatgcagtggcatgatcataactcactgcagcctgcatctcctggactcaagagatactcctgcctcagcttcttgagtagctgggactacaggtgcatgccaacacatccagctaatttttgtgttttttgtagagatggggtttcgctattttatttatttatttagagacagagcttcgctcttgttgcccaggctggagagcaatggcttgtgagccactgtgcttggtggtttcactatttaaaaacaaacaaacaaaagagatagtggccaggcaccttggctcatgcctgtaatcccagcactttgggatgccgaggtgggtggatcacctgaggtcaggagttcgagaccagcctggccaacatgatgaaaccctatctctactaaaaatacaaaaaattagccaggtatagtagcagtggctgtaatcccagctactcaggaggctgaggcaggagaatcacttgaacccaggaggcagaggttgcagtgagccaagattgtgccactgcactctagcctgggcaacaagagggaaattctgtctcaaaaaaaaaaaaaaacaaaaagagatagggtctcgctatgttgcgcaggtgggtcttgactcctaggctcaagcgatccttctgctttggcttcccagagtgctgagatttcaccctgtgctttttgaaccaaagttctggattcaatatttgtccttgttaaatatcacattattatatgtggcccaatcttcctcactttcttacagcctccatcatgtcatccaaacagtcactttcccaggcagccccatgaatagtcacagctctgacaacccaggtgttttgtgtttgcattacaaactcttacaagccaaggatcaagcctgtgacactccgctagcgacattccagggagacaagtatccgttgatttgttgatttggatctttggtgcatccagcccgcaattccccatcattcctgcaagagtttcacaactgaccttggtaaaaatttggatgcacaattacatccttttttttttttttttttttttttttgagacggaatctcgctctgttgccaggctgaagtgcagtggcgccacctcagctcactgcaagctccgcctcccgggttcacgccattctcctgcctcagcctcccgagtagctgggactacaggcgcctgccaccacgcccggctacttttttatatttttagtagagatggggtttcaccgtgttaaccaggatggtctcgatctcctgacctcatgatccgccctcctcggcctcccaaagtgctgggattacaggcgtgagccaccgcgcccagcctagatgagtttttaatgatcctgtgaagggcttccaactctggtctttctttcctaaaggctcatagtccactacatagagcgtccatttctgattttccccagagattatcagaaaacccagcaggtctggaatgcctccccaactcccagctacccttgttttcttggtcaccttcttctttttgcttgatgtctttcctgcttcctcctgcccagcaggctgacatctgacacctggggatcattcattccatccaaagtttcaaggtcggctaggcacggtggctcatgcctataatcccagtactttgggaggtcgaggcaggcggataacttgaggtcaggagttcgagaccagcctggccaacatggtgaaacctcatctctaccaaaaatacaaaaattagccaggcgtggtggtgggcacctgtaatcccagccacttgggaggctgaggcaggagattcacttgaacccgggagggggaggctgcaatgagccgagattgtggcattgcactccagcctgggtgacagagcgagactctgtcccaaaaaaaaaaaaaaaaaaaaagtttcaaggtttctttagggaagaggaaggagaggccatgtgtggagggaggtggctgggtggaggagagctcttgggtcctgtttgcttagactcaaaggcaggccccagaggctccagccagagggacagcgcccagccccaccttcaccccttttgcagggtgcctctgacagctgctgcaggaaacatggccaagtttgccctgaatcagaacctgcccggtgagtgtgcaaaaagagagatgtgtgtgtgtgtgcgcatgcacagagaaacgcttgatgcccttgtgtgtggacgcagcctacagccctagagtgcagtcctctccaatgtcatgagcctgctttaaaccacctatggcatcaatcatggccgggtgcggtggctcatgcctgtaatcccagcactttgggaggccacggtgggcggatcacttgagatcaggagtttgagaccagcctgggcaacatggtgaaaccctgtctctactaaaaatacaaaaattagccaggcacggctcggtgtggtgactcatgcctgtaatcccagcactttgggaggccgaggcgggcagatcacaaggtcaggaggtcaagaccatcctggctaacacggtgaaatcccatctctactaaaaatacaaaaaattagccgggcatggtggtgcccctgtagtcccagctactcgggaggctgaggcaggagaatggcttgaacccgggaggcggagcttgcagtgagcagagattgtgccactgcactccagcctgggcgacagagcgagactgcgtctcaaaaaaaaaaaaaaaaaaaaaattagccaggcatggtggcgcgtgcctgtagtcccagctactcaggaggctgaggcaggagaattgctggaacctgggaggcagaggctgcaatgagccaagatcgcactacagcactccagtctgggcaacagagcaagactccgtctcaaaaaaaagaaaaaaacaaaacaaaaaacaccccacctatggcactaatcgcaagtggactataccccctgccaccccaggtagccctcaaaccagggaagtgtggcccttgtgcgtccattcctcttccccctgccttctttactctgctcgggacaccctggtctccatctcgctgtgactccagctgaccctcctccctcctaccccagggtatttccatgggctgttttcttctagaaaccttttcccagctgcttcctcctcatcgtgcagggcttcccctcgccaacctttttttttttttttttgagacagggtctcactctgtcacccagtctggagtgcagtggtgcaatctcggctcactgcaacctctgcctcccaggctcaagtgatcctcccacctcagcctcctgagtagctcaccattatgcacagctatgtatatatatgtatatgtgtatatatatatttttggagatggggtctcactttgttgcccaggtttgtctcgaactcctaagctctagcgatccacccgcctcggcctcccaaagtgttgagatagaggcgtgagccactgcgcccggccagggctacttttttttttttttgagaggttctcttctgtcgcccaggctggagtgcattggtgcgatctcggctcacctcaaactccgcctaccaggatcaagtgattctcctgcctcagcttccggagtagctgggattacaggcgcgcgccactaccgcccagctaattttcgtatttttagcagatactgggtttcaccatgttggccaggctggtctggaactcctgacctcaggtgatccgcctgtgccggcctcccaaaatgctgcgactacaggcgcgaaccacacgccgggccagggctccactccacaggaaagtcccctcacaggaaagcttccctggcaaccaaacgctaaatcgggcctcctccgtttattccctgttattattaccattgccgtaggcatcgtttggaaggatgcttatctgctttctacaggaggacagggatgtttgtcttgctcactgctgtgtcccccgggcctagaaacttgcttagcacagagtaggtgctcattaaacaagcgattgagttaatacttgggtacagataggtgtgaagcgtgggcatgggtgggggacacgctcggtttgtttagtatctcccgggtttccccgttctgatgcgccctccccgtgcccccgtcgtgcctccagacctgggcggcccccgcctgtgcccggtccccgccgccgggggcgcacgcagcccgagctcgccctactcggtggagacgccctacggcttccacctggacctggacttcctcaagtacatagaggagctggagcgtggccccgctgcccgccgcgccccgggacccccgacctcgcgccgtccccgcgcgccccggcccggcctcgcgggcgcacgtagcccaggcgcctggacatccagcgagtccctggccagtgacgacggtggagcaccgggcatactctcccagggcgcgccctcggggctcctgatgcagccgctgtcgccgcgcgcgcccgtgcgcaacccgcgcgtcgagcacacgctccgggagaccagccggcggctggagctggcgcagacacacgagcgcgcgcccagccccggccgcggggtcccgcgcagcccacgcgggtccggccgcagcagccccgcccctaaccttgcccctgcttcgcccggccctgcccaactgcagctggtgcgcgagcagatggccgcggcgctgcggcgcctgcgcgagctcgaggaccaggcgcgaacgctgcccgagctgcaggagcaggtgcgcgcgctgcgcgccgagaaggcgcggctgctggccgggcgcgcgcagcccgagccggacggggaggctgagacgcgcccggacaagctcgcccagctgcggcggctcaccgagcgcctggccacctccgagcgcggcggccgtgccagggccagcccccgggctgacagcccagacggcctggctgcagggcgcagcgagggcgcgctccaggtcctcgacggggaggtcgggagtctcgatgggacgccccagacccgggaggtggccgccgaggccgtgcccgagacccgagaagcgggtgcccaggccgtgccggagacccgggaggccggcgtggaggctgcccccgagaccgtggaggcggacgcgtgggtgaccgaggcgctgctggggctgcctgcggccgccgagcgcgagctagagctgctgcgcgccagtctggagcaccagcgcggggtgagtgagcttctgcggggccggttgcgggagctggaggaagcccgcgaggctgcggaggaggcagcggcgggggcccgggcccagctacgcgaggccaccacccagaccccgtggagctgtgccgaaaaggccgcgcagaccgagtccccggcagaggcgccctccttgactcaggagagctcgcccggatccatggacggagacagggccgtggcgcccgcgggtgagtcccgaccccgtcgctgggccctggcttactcggcgccggactcgaactcagtgccctcatctcatccccgccaggcatcctcaaatccatcatgaagaagagagacggcacacctggtgcccaacccagctccggacccaagagcctgcagtttgttggggtcctcaacggagagtgagcgcctttcccctcctgtggcagcttctgccgggacatagactggggttggaaccccagctctgcccctctactggcagcgtggtctgggcaatcctcagtttcctcatcgttaaatgggaacggccacacccacatcgcaggactccagaacgagcccacaggggaggtttagcagacacctcccaccctgcccccaggtacgagagctcctccagcgaggacgccagcgacagcgatggcgacagcgagaacggtggcgccgagcccccgggtagctcctcgggctccggggatgacagcggcgggggatccgactcgggcacccctggccctcccagcggcggggacatccgggaccctgagcccgaggcggaggcagagcctcagcaggtggcacaggggaggtgagcggcgctcgctagttgtttggagaggaggcggctgccctcctcctggtcggcgctgtccccgatccatcctgagtctctcctggcctcctctgcaggtgcgagctgagcccgcgtctgagggaggcgtgcgtagcgctgcagcggcagctgagccggccccgcggagtagccagcgacggcgtgagtgccccgggagcgcagcaccagggagtggcgtgggagcctccaaggacctctgacgcccacttaggggagcacaccgggttccatcccttcccgccaggcacctcgcctgaccccaggctctccgaagggatctccttcccaggacagcgccgatctttccttggtttccccaaaaaggcccggccccagccccactcccggactccccaagggcaagcgttcattgcctttccccgttccatgttctcccgcaaattcttccctggaaggaaaggacccccttcccccgtgtttgccctccgataggggtgtggccccagccctccatctgggttcgcatggctccccacctggacgaggagtgaccttccttacttgcctggaaacgccaaatgggtctcttcccagtcccgcccctccccagctcccccaccacggcgccgccgtggaccatcgccgatgttatcttggcccctgtcccttgcagggcgcagtgcgcctcgtggcccaggagtggtttcgagtgtccagccagcggcgctctcaggcggagcccgtggccaggatgctggaaggggtgaggcgcctgggacccgaactgctggcgcacgtggtgaacctggcggatggcaacgggaacacggccctgcactacagtgtgtcccacgggaacctggccatcgcaagcctgctcctggatacgggtcagagccaagggagggtgggtgggacaccaggaaatgggtggggggagagggcaggggctgacctaggctcaaagactctggagaggaaagcagagaatggctgtccagcacagggcaccactcctccttgagtttattttattttattttaattttattattttattttattttattttattttattttatttttgagacggagtttcacactgtcaccaggcaggagtgcagtggcgcgatctcggctcactgcaacctccgcctcccaggttcaagcgattctcctgcctcagcctcccgagtagctgggactacagatgtgcgccaccatgcccagctaatttttgtatttttagtggagacggggtttcaccatgttggccaggatggtcttgatctcctgacctcgtgatctgcctgccccggcctcccaaagtgctgggattacaggcctgagccactgcgcccagccaacctccttgggttttaaacctcttcctgtctgggttcccaaaggccttctgccctctgagccaggcatggtggctcatgcctttaaccccagcactttgggaggccgaggtgggcagatcacttgaggtcaggagttcgagaccggcctggccaacatggcaaaaccccatctctactaaaaatacaaaaattagctgggtgtggtggtacatgcctgtaattccagctactcaggaggctgaggcacgagaattgcttgaacctgggaggcagaggttgcagtgagctgagatcgtgctactgcactccagcctgggcgacagagtgaggctcagtctcagaaacaaaaacaaaacaaaacaaaaaagcagaaactagctgggcgtggtggtgggaacctgtaatcccagctattcgggaggctgaggtgcgaggattacttgaacccaggaggcagaggttgcagtaagccaagagtgagcaccactgcactccagcctgggccacaatgcaagactccatctcaaaaaaaaaaaaaaaaaaaaaaaaaaaaagaggccttttggccccaccatacccctagttctgccctgaggctcctcctactttgcagctggagggaatacacagttctggacttaggtaaacctcagtttaggggcattatttaatcttgcttgtgaaatggggttggcaaggcctccctccctgggtacctatgataatacaggtagtacgagatcagtaaatggccagcatgtgctctgtccctgaatctccagctggagcactcaccgagttcctgagccccagtgtccagcctggaggggaggtactcaccaggcagggctctgactcctcctgggatggggcactgtgccccacccacctccagctgcttgccctgataaactgggcacaaagggtctggtgggtggtaaacaaatcgctgtccaccaggagccccctccctccaggtaccctcctgcaggttcagaaacctctgagtcagcctttgggcacctctggtactaactgcaggttgaggcgggtcccactgcctgcccccaaccccctaaacacgcagatccctcccatccctgcaggtctttatgacctaggaaaggatatagctgctctggaagctggggcattgtaggagacaggggacagtgaatgaatctaagtgaattttttgggcatctcatgccttaaagggggctggggctgcggcaaggaagtaggcgtcgttggtcactgcaagaggccccaggctccttggcccctttatctcctacatttgaatcccccccccaccccttttttgttgttgttgttttgatatggagtcttgctctgtcgcccaggctggagtgcagtggcatgatctctctgctcactgcaacctacgcctcccgggttcacgccattctcctgcctcagcctcccgagtagctgggactacaggcgcccgccaccacgcccggctaatttttgtacttttagtaaagacggggtttcaacatgttggccaggctcaaactgcttacctcaactcatctgcctgcctcggcctcccaaagtgctgggattacaagcattagccgctttgcccggccttgtttgttttttcgaacagatcttgctctgttgcccaggctggactgcagtggtgcaatatcagctcactgcaacctccacctcccgggttcaagtgattcttatgtctcagcctcctgagtagctgggattacaggcgcgtgtaccacacccagctaatttttgtatttttgtatttttttttttgagatggagtttcgccctttttgcccaggctacagtgcaatggcacaatctcggctcactgcaacctccgcctcccagattcaagtgattctcctgcctcagcctcccgagtagctgggattataggcatgcaccaccacacccagctaattttgtatttttagtacagacagggtttctccatgttggttaggctggtctcaaactcccgacctcaggtaatccgcctgcctcagcctcccaaagtgctgggattacaggtgtgagccaccgtgcccagacaatttttacatttttagtagagatgggtttcaccatgttggccaggctggtcttgaactcctgacctcaagtgatcctcctgcctaggcctcctaaagtgctggtattataggcgtgagccagtgtgcccagcctctaattcccatttggctccacctctccagaccttcccctggttcttactcatctcccctctgcctgtacttgcttgctgtcacatacactaacgcccctgcattcaggggctgtttcctctttcatcccctggaatccagagtctggaggtacgtgggtgtgcactttgctcttcttctccacttccagacctttcaccctcttccttctcaaaccctaccttggagcatcttgtcactgactaggcccctcctcactctgcctctctggcttctacctctgacctcaagtagctcctcctttcttgaactttagctcctggccagttctccctctctccctccagcctaatccttgctgcaaagcaggtccactgtgcactggttaccccttcagcccattgcacctaggaatgtgcttttcctacctgcctgagtctggtaaggtagaatactcattcacataacaagttacacaaagcaggttccttatttacagataggcagcaagggacagcagaagcctaagattgacagtgagccaatcccccaaggctcaggaaggctgcccaaggtgtatggaatctggtctgcaggtgccccacttgcacggcaggtgagggaccctggaaagcggcccactctaggttttataccctggggaacaggaattgctgggctaatgcattaaaggacaacctgtttctagatggggacaggaacagagcctaggctgttccagtcagttcctccttatctcaagattgcatttccagagcattctatagttagtcttttttttttttttttttttttttttgaggccgagtcttgctctgttgcctggctggagtgcagtggtgtgatctcagatctcagctcactgcaacctctgcctcccgggttcgagtgattctcctgcctcagcctcccgagtagctgggattactggcaagcgccatcatgcccggctaatttttgtattttcagtagagacggggtttcaccatgttggccaggctggtctttaactcctgacctcaggtgatctgcccgcctcagcctcccaaagtattgggattataggagtgagcaaccgcacccagccggcacttgtcaatttcctttttttttttttttttgagatggagtctcgctctgtcacccaggctggagtgcagtggcgccatctcggctcactgcaaggtctgcctcccgggttcatgccattctccttcctcagcctccccagcagctgggactacaggtgtccgccaccacgcccggctaattttttttgtatttttagtagagatggggtttcaccgtgttagccaggatggtctcgatctcctgacctcgtgatccgcccacctcagcctcccaaagtgctgggactacaggcgtgagccaccgcgctcggcccacttgtcaatttcaacatcctcccccatgatccctgcaacctcctggctgctctccttccttgaccttgactctgccccacatcagctttacaggtataacatcagccccagaccttgatgtccctaatagttgtgcccgttacagaatctcacttctcagctccccacttcccgaccctcacctcccagcttctcggctcacaggctcccattccccaactccagtaatccttggaccttgcggggacaattacccactgctccctctccgtttcactgcccccaccccttgtctctttgcctctgtcatcctccttcagcctgttgtggattcttctccatacccctctctcacccgaccctacctgcctgcctgacaaacccacagcaaaccgtcaagtgttgaataaatgcctgctcccacagaactttcaggaatgtgtagttttgagtgtgtgtgtgtgtgtgtgtgtgtgtgtgtgtgtgtgtgtgtgtgtggtgggggtggtgagtgaagagtggagagagacgattatcaagtaaaaacgtgaaataatttcaaatgctagtaagggccgtagcagaagacaaccaggggatgaagtcaacaaagggtgattctttttaaatttttttgtaggcatggggtttcaccatgttgctcaggctgatctccaactcctgggcctaattgatcctccctcctcagtctcccaagtagcggggattacaggcgttctccaccacacccggctaatttttgtatttttagtagagatgaggtctcgctctgttgtccaggctgttctcgaactccagagctcaagtgatcctcctgccttggcctccagtgttctggaattataggcgtaagccactgtgcctagccagggtgattctttagttaagcaaggtcaaggtagctgcaagagaaaagggagagggagcaggaagataggtgggtccttggctagcctgcaaggaccccactctggttatttctgggtgctcctccctgaccacctgacgccttacacggtgtcttagtggaaggcatggacacccacacagcatgccacccaaacagggaacgtccccccaacccctttttacagacagctttgttccaggctggggtgtagtggcgtgatgcagcctcaacctcccaggctcaagcgatccttccacctcagcctcctgagtatttgggaccacaggcatgaaccaccacactcagctaattttttttttggcggggagcagagtgtcgctctgtcaccaggctggagtgcagtggtgtgatattggctcactgcaacctctgtctcccatgttcaagtgattctcctgcctcagcctctcaagtagctgggactacaggcgcacaccaccacgcctggctaattttttgtatttttggtagagacggtgtttcaccatgttggccaggatggtcttgatctcttgaccttgtgatctgcctgccttggcctcccaaagtgctgggattacagacgtgagccaccgtgtccggccaaattttttaagagatgggggggtcttcctatgttgctcaggctggcctcagactcctggcctcaagtgatcctcctgccttggcctccctaagcatttgggtgtacaggcgttagtcaccatgcctggcctccatttttgctgtcatttgacttaaccctttactcctcagtccctcatctcagctctccttcctcactaggttatccatctcatgaccccgaccccgctcctttccccaagcttctcattcatttccttaaactacctcaatcctcagagccttcagaatggcaggagacagggattaaaacagccactccaggaaatatcatccaaacaggcactgtgaggaacagggaccaggatggtaacagaactgatcccagaggaaactgagctcacgtttgtgtttcattcaggataggcagtgttgaccaggctgttttgcttcctagggctgccatcaaagtatcactgtgagctgcttcaaacaacaggtggccagacttctgaaatcaaggtgttggcaggtttttttttttttttctgagagatggagtctagctgtgtcacccaggctggagtgcagtggcgcaatctcggctcactgcaagctccgtcccccgggttcatgccattcttctgcctcagcctcctgagtagctgggactacaggcacccaccaccacacccgactaattttttttttttttttgtatttttagtagagacggggtttcactgagttagccaggatgatctcaatctcctgacctcatgatccgcccgcctcagcctcccaaagtgctgggattaaaggcgtgagccactgcacctggctttttttttttttttttttttttttacaacaggtggccagaagtctgaaatcaaggtgttggcaggtgtttttgtttgtttgtttgagacagggtctcactgtgttacccaggctggagtgcagtggcgtgatcttggctcactgcagctcccaggttcaagtgattatcctgcctcagcctcctgagtagctgagattacaggtgcctgccaccacgcctggctattttttgtgtttttagtagagatggggttcaccacattggccaggctggtctcgaactcctgacctcaagtgatcaaccacctcggcctctcaaagtgctgggattacagacgtgagccagtgtcctggcaaccaaattcattttgaattgttgctcttggccaggcgcggtggctcacacctgtaatcccagcactttgggaagctgaggcaagcgaatcatgaggtcggagttcgagaccagcctgaccaacatggtgaaaccgtctctactaaaaatacaaaaattagctgggcgtggtggtgcatgcctgtaatcccagctactcaagtggccaaggcagaagaatcgcttaaacctgggaggcagaggttgcagtgagctgagatcgtgccactgcactccagcctgggcgacagaatgagactccatctctaaataaataaatagttgctcctggctgctgtgtggaacctggagtggattcagagagaagggtggaggctggcactgttctttaggggagcaatgatggtggcttggcgggtggtggccatgaaaataaacatatccttttattattcagtcaacaaatgtttaactgagcatctactatgtgccaagtattgttctaagtactgagggatacagaagcaaacaaaaccaagtccctgcctgatttgaaacagggacttgatttgaaatagccactgggccagtggctcatgcctctaattccagcactttgggaggctacggtgggtggatcacttgaggtcaggagttcgagactagcctggccaacatggtgaaaccctgtctctactaaataatacaaaaattagctgggtgtgatggcacatgctgtagttccagctactccggaggtggagattgcagtgagctgagatcgcaccactgcactccagcctgggtgacagagcgagactatgtctcaaaaaaaaaaaaaaaaaaaaaaaaaagatgaaacaggaaggtccttcactgagcagatggtatttgagcaacaccttagtgagggaggaaccaggtagctattgtggggagaacgttgagaccaccccatatgcaggtgctgtgcccgaggcttgcagggaggtgagtggatcaagtcgggccgcggtgttggcatctccgtggacggcccccttttctctcccaggggcctgcgaggtcaaccgccagaaccgagccggctactcggccctcatgctggctgcactcacctctgtgaggcaggaagaggaggacatggctgtggtccagagactcttctgcatgggtgatgtcaatgccaaggccagtcaggtgcgtgggcgcccccactgtggctctcagccaggagtcacttccactttgggagtcaacctgtgacctcccttccctgagcctaccccagcctgttccctcttcctccccactccccagacggggcagacagccctcatgctggccatcagccatggccgacaggacatggtggcaaccctactggcgtgtggggctgatgtgaatgcgcaggatgcggatggggccacagcgctgatgtgtgccagtgagtatgggcgcctggacaccgtgcggctgctgctcacccagccaggctgtgaccctgccatcctggacaatgtaagaccccacaatggggctggcatcttggggggtgcccatggcttggctcagggatctgactgtccctaacgttccacaggagggcaccagtgccctggccatcgccctggaggctgagcaggatgaggtggccgctctgctacatgcccacctgagctcgggccagcccgacacccaggtgagcacagctctggaagaaacaaactttcccagctgcaaattcagtttgcagaggatagtaaatatgccctgagcctccctttctgctccccaaaggtggcaccaggggtgcagaaccagtgtctggattctcctatgtggctgcttttcttttttgggagacagggtctcactctgtaacccgggttggggtgtagtggtgtgatcagagctcactgcagccacaaactcctgagctcaagggatccttctgcctcagcatcctcaagtgctgggattacaggtgtgaaaccagagcgcctggcaggggctgggatttgatgtgaaagcagcaaaaccccagtgaggttgacactaccccaggtcatgagactgagtcctcaaggggggaagtaacctaaggtcacagagacctagctaagacctttcatgcatgcccctgggctcctgttacctactgccagggaggctcttatcaaaggaaaaaggagccctttggcatcaggcagggtggggaagggggtccagagcttcagaactggagactgggtgagtttgcagaacacattaacccccaacaccactatactctgatggccaagtgccaggatgttttagcactttcataatccaagttatctaatcagcccactcatcctgtacaggttgaccccaatttaccatggctccacttaccattttttatttatttttgagatggagtcttcctctgtcaccgaggctagagtgcagtggggcgactgcagctcactgcaacctccacctctggggttcaagcgattcttctgcctcagcctctcaagtagttgggactacaggcacgtgctaccatgcccagctaatttttttttttcatttgaagacaagagtctcgttctgtcacccaggctggagtgcagcggcacaatctcagttcactgcaacctccacctcccaggttcaagaaattctcctgcctcagcctcccaagtagctgggattacaacagctgtgagccatcgcgcctggcacaacttacaattttttgacttcatgatagcataaaagcaatgtgtgcttagtaaaaaccacacttcagcagagtattcaataaattacataagacattcaatactttattaaaacaggcttcgtgttagacgagtttccccaactacaggctaaggcgttctgaacaagcttaagatggaccatgctaagctgtgatgtttgggagattaggtgtattaaacacatttcaacttgcaatactttcaacctatgatgtactcaccggaatgtaacccattgtaaactgaggaacacctgtactcaccccactggaagggatgtgggaggaaggtcaagcgcctcttccaggtcagaaggggcagaggttggatacaaaccaggcagcctgggtccatggtaaaagaacctccactaagtgaggctggggctgaatcccacgtttcctgcctcaaggagattgcagcaggcccccctcttttcccctctctccagagcgagtcaccccctggctcccagacagccacacctggtgaaggagaatgcggtgacaatggagagaacccccaggttcagtaagctgcctcgtctggctcactacacctagctgtggggagatctcctcgtcagtcacctcagcctttggcgcacagaagggtccagggtcccctgctcagaggctaacactggccgaagagaaaggcaatttcagttggggtgactgtggcaggaaggggctcactctggccccaccaaggtgaggtggggaccaagtgatagagccctgatccacccactctctgaaacttctttgctaataaaacattcctactacgcttgtgttttgtttggggtagagggtgcaatcgacaaacacgaccccccgcctcaaaaaggaaaagcttcgtttggcaagaccgcacggccaggatttccagagtgcggaggatcggtgaccgcctgggagccactcaagaaacctggagaaaccctagtcgtataacccagacaagaacctgagttaacttgaaacacaaacgctttatttaaaggagcatctcagttacgtgtggcggacaaaaaaaaggagcagactgtgacagaccattcccatcggccaagtggtcgaacccgacatccaagaccctgtaaacagacccaaacatgagatgttgacaggccccgcagcaattggcaaactcccgcctccctcttgtcagtctctgtatgtagactctgcctcccaaaccctctcaccctgggcttaacgaagcctccctaccaccaaccaaaggtctatcaaaggggtgtcctctttgcacccaccagcgagcagccaagctcagcgcaacctccgggcttctcgctctgactccaaaagggtgagcacgtcgccctcgcgcacggggccttttacattgcggatgatggatcggctcgtgtcgtccatgaattccacgcgcacctacgggtccccaccggagtggaggaagaagtaagggcgggccgcggaaaggcaccgcggagtgggaagcagatatgaattcagagaacgtgtcggggccagaatacagatcgttaaagggaaccatcagaaccccgtgatgaaatgagaatcggctcccggattccggctggcaggggttagggcagggtagaggtcacatcagggtttaggtcgccggcagtcggccaaatgcccccacccgattacctgcgtgcactgtccctgagaaccggtcctgcccaggaccttggtgacctggaggaaagaagctgggttcagacccggcccgtttggctcctctaatccctccccctgcccccaaattcgggcccccacctcaccctggccagcttgataggctgcacacggctggtgtccatgatggcggcgcggcggcggtctggcggagaggagtcacgtgcttcggggagagcctttataggacgttctagcaccgcccactcccgtctcgcgataccacgccgcgtctttcccagcagccccagcggtggagacgtcaccggctgcgcccttcagtatcgcggacggaagatggcgtccgccacccgtctcatccagcggctgcggaactgggcgtccggggtgcgcggggcggacagggctgcaccatggggggcttcgggctccgtgtgtccgggacccgctcctgctcctcacctccctcctaagccgggacccttcgctctccccgaatctccctgggaacccccagctagtcaccccttcagcccgggaccctctcctggcctgggaaccactcaggcctgggatttccccagtccccgaccttcttagccttggatctgtgggcccggactctggctttgctcttcacctgcaggacccacatccgtttccccgagtgttcatcccctgccttcccttaaaatgcgcatccccggaccatccctggtcccttgccctctcctttcctctctcctggggtgccttgcaggccgacctctcctctcctcttcccacagcatgacctgcaggggaagctgcagctacgctaccaggagatctccaagcggtgagcaggccccgctcgctgcccagcctctggctctgtcctttctccaccaaaaacgaaatctgtgttcctttagacccctgaaacggagggctgacatcctgccaccagtcccctgccaggctgtggaggcagaggtttgcctttaaccttgctgaactccggaggacagccctcctgaaacagcgaggccgggcgtgcattctgactggcaatcaggctagatttgcagtgctcagcgtggccatgttagtcagtgttatccccaagctacagatgaaaaaagaggtccagagaggcgaaatcatttgcctcaagtcactcagaagctaaaaagtggcagcggggacttgaacccagaagtgtcctgatttcagactcatttatattaaaatattagttgatatttacaagcccccgtcatgtatgacctcagccttgggtttaactttgtgaaccaggaaagttcttatccacattctttcatggacgccacattctagggagaagcatagtagggaaacaaacacagcaggtagtattgttctggaatgctttgaagacaaaacaaaataagtggaagctggagggtggctacgtaaagtcagatgattgggaaagatctttctttggaaattgacagttgagtcccctgaatgatgggaaggacccattcaaagaataattattgaaaaaacattctgaccgggcgcggtggctcacgcttgtgatcccagcacttggggaggctgaggcaggcggatcacgaggtcaggagtttgagaccagcctggccaacacagtgaaacacagtaaaaccccctctctactagaaatacaaaaattagccgggcgtggtggcgcgcgcgggtagtcccagctactcgggaggttgaggcaggagaatcgcttgaacacaggaggtggatattgcagtgagctgagatcgcaccactgcactccagcctgggtgacagaacaacactctgtctcaaaaaaataaaaaagaaaaaacattctgagcagagggaacaggaagggctaagagtgtcaggctggacagagcctgagtggaaggaggccagtatggatggaacccattgagggaaagggataatggtataatctatgaagtcaaagggtaggcagaggtaaggcagtcattgaggattataatgaaaggaagaaaaatagcattaaaataatgaaatttatgtaaatgcctatatgttgtgactaattccaaatattagaagtatcaaactttgttttcaacttttttttttttttttttttgagacggagttttgctcttattgcccaggctggagtgcaatggcacaatctcagctcactgcaatctccatctcccgggttcaagcgattctcctgcctcagcctcccaagtagctgggattacaggcatgtgccaccacgcctgactaattttttgtatttttagtagaaacggggtttcaccatgttggccagtctggtctcgaactcctgacttcataatccgcctgcctcggcctcccaaagtgctgggattacaggtgtgagccactgcgcccggcttgttttcaactttaacgttaagttctggggtacatttgcagttttgttacaaaggtaaacgtgccatggtagtttgctgcaaagatcaaagatcaacctatcacttaggtattaagcccagcatccattagctattcttcctgatgctctctcccccccaacccccgacccccctagttggctttctatcagggtagttgtgggccagttgaggaaatggctttgtgaaagttttgacttttttaggatgacggcaccctctagtgattcatctggatgttttattggtctttttttttttttcttttttgagacagagtctcactctgtcgccaagctggagtgcagtggcggatctgagatcactgcaatctccgcctcccgggttcaagtgattctcctgcctcagcctcccgagtagctggggctacaggcgtgcaccaccacacccagctaatttttgtatttttagtagtgacggggtttcaccatgtttgccaggatggtctgatctcttgacctcgtgatctgcccgcctcggcctcccaaagtgctgggattacaggtgtgagccaccgcgcctggccttttttttttttttttttttttttttttgtaagactgggtttctgtgacccaggctggagtgcagtggcacaatcatagctcactgcagcctcgaacttccaggcctaagtgatcctcctggtccagcgtaccaagtagctgggattacaggcacatgttaccgtgcctggctaatttttaaatttttgtatagagacaaggtcttaccatgttgcccaagctggtcttaaactcctggcctctgactgggcatggtggctcatgcctgtaatcccagcactttgggaggccgaggcaggcggatcacaaggtcagaagtttgagaccagcctggccaacatagtgaaaacccatctctactaaaaatacaaaaattagccagcatggtggcacacgcctgtattcccagctacctgggaggctgatgcaggaaaatcgcttgaacctgggaggcggaggttgcagtgagccgagatcgcaccacagcactctagcctgggcgacagagcgagactccatctcaaaaaaaaacaaacaaaaaaaacactcctggcctcaagcaatccttccaccttggcctcccaaggtatgagccaccacatccagcctccttaagcaaagtctttcacataatatattgcttttaatattaaacattttttactttatgtttcttatttttaaaaaatacagtgactaacacttgttttaagaaaaaggccaggagtggtggctcacgcctgtaatcccagcactttgggaggccaaggtgagaggataacttaaggccaggaattcgacatcaacctgggcaacatagcaagacccccgactccacaaaaacaatagaaaaattgtttttagccagatgtggtagtgtgcgcctgtagttccagctacttgagaggctgaggcgggagcattgcttgagcccaggaggttgaggctgcagtgagctatgatcacacctcaagcgatcatatgattgcatatatcatccaggctgcagtgcatatgatcactgcctcagaaaaaaattaaattccgggaaacagttcccagacaaaaaagtgacttagaaacatggctaagtggaaacagatcaatttacggtttttgctgtcttctctcctccctctctctggaaagcccgtcttttgttttgagctttttttgttttttgagatggagtctcgctctgtcgcccaggctggagtgtagtggcgtgatctcagctcactgcaacctctgcctcccaccaccatgcttggctaatttttgtattttagtagagatggggtttgcagtgttggccaggctggtttcgaacacctgacctcaagtgatccacccacctcggcctcccaaagtgctgggattacaggcatgagccaccctgcccatccttgttttgagcatttcttttaaggcctcaggcttccaggtaaatccagcccagggtttagttcaagccaagaccgagctctgttcacccctctctgggctccagagaggagttgcctggccacatggtggcaggaaatgcagagatcttgacaggctccaaggctaaggtgttcttgaataatgggccttgatcctagcagggttctccagagacttcctgagataacaggaaacgcagggcgtccagagcctggctttaggggaaaaagccactcagagtggacaaagtcaagtgaggctggctgccaagctcagccgtggggtggggggcatggggacatgtcccgggccttgggagcctcagaaagggtcctctgtaccctccacatttgggacaggtggggtccctgggggtggcatcttcacatccagagcagggtccaccatctgcttctggccccaggacccctccccaggcatatgtccctgccagtgtaccaagggacacccccagcctgtggcttatcccagtggctggctgtagatcccacattttgtgactgaggtgacaggggcccacagcggggccatgacagtgactgtctctttgcttcagtgctcatcttttttcccctcagaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagaggtgaggatctccagcgctgctcaccacagcccccatgccccctcctgcaacccactctgtctcccaacttgtggaaagggtgcttgtcaagatcctacttagtaagcatcagttgcgcaggaactgtgctgctgggagctttttgtccgagagctcatttactcgtttttagagacagagtcttgctctgttgcccaggatgaagtgcaatggcgcaatcatcactcactgcagccttgaacgcctaggctgaagtgatcctcccctccttccttggcctccccagtaattggtgttacagattagtgccaccatgctgggtcaattttttttttttttttttttttgagacggagtctcactctgtcacccaggctggagtgcagtggtgtgatctcggctcactgcaatctccacctcccgggttcaagcgattctctgcctcagcctctcaagtagctggggttacaagtgcccaccactacacccagctaatttttgtattttcagtagaggcggggtttcaccatcttggccaggctggtcttgaactgaccttgtgatccacccgactcggcctcccaaagtgctaggattacaggcgtgacccaccgtgcctggcctgttttgtttttgtttttgtttttgttttgagatggagtctccctgcgtcgcccaggctgaaggggtgggttgcccctccacacctgtgggtgttcctcgttaggtggaatgagagacttggaaaagaaagagacacagacaaagtatagagaaagaaatcgggtgaccaggggaccagcgctcagcatacggaggatccacccggcctctgagttcccttagtatttattcatcattattgggtgtgatgtgtgagagggggatgtggcaggatcataggataatagtggagagaaggtcagcaggtaaacacgtgaacaaaagtctctgcatcataaacaatgtaaagaattaagtgctgtgctttagatacatatacacgtaaacatctcaatgccttaaggagcagtattgctgcccgcatgtcccaccttcaggcctaaggcggttttcccctatctcagtagatggaatatacaatcgggttttacaccgagacattccattgcccagggaagggcaggagacagatgccttcctcttgtctcaactgcaacagggcattccttcctcttttactaatcctcctcatcacagaccctttaccggtgtcgggctgggggacggtcaggtctttcctttcccacgaggccacatctcaggctatcacatggggagaaaccttggacaatgcctggctttcctaggcagggaaccctgtggccttctgtggtgttttgtgtccctgggtacttgagattagggagtggtgacgactcttaaggagcatgctgccttccagcttctgtttaacaaagcacatcctgcactgcccttaatccatttaactctgagttgacatagcacatgtctcagggagcacagggttgggggtaagattacagattaaaatggagtctcttatgtctactttctacacagacacattaacaatctgatttctctttcttatccccacaccaggctggagtgcagtggtgtgatctcggctcactgcaagctctgcctcccaggggttcacgccattctcctgcctcagcctgcctagtggctaggactacaagtgcccaccactacacctggctaagtttttgtatttttagtagagacggggtttcaccgtgttagccaggatggtcttgatctcctgatctcatgatctgcccgcgttggcctcccaaagtgctgggattacaggcgtgagccaccatgcccggcctccatgctgggttaatttttaaatgtttcgtagagatggggtcttgctttgttgcccaggccgttctcaaactcctgggctcaagcgatcctcctgccttggcctcccgagtagctgggactacaagtgagagtcaccatgctcagcaagagctcatttagtccaacccaggggagggtagaagttagcgcctcagccaggactctgcatcctacaaaacagatgaagtccggggtccctccaagggtcctgtgagaaactgagacattactgttgatataattatgaattcttattttatttatttattttgagacagtctcactcttattgcacaggctggagtgcagtggcgcgatttcggctcactgcaacctccacctcctaggatcaagtgattctcctgcctcagcctcccaagtagctgggattacaggcgcatgccaccatgccaggctaattttgtatttttagtagagatggggtttcaccatgttggtcaggccggtcttgaactcctgacctcatgtgatcctctggcctcggcctcccaaagtgctggaattacaggtgtgagccaccatgcccagccatgtattcttctcagagacagaagtgtataaaccttgggctcctctcaaaaagcagtttggtccctggtttcaggtgtcttctcttaattaaatggggactctaatagcatctacttcagaaagctgttacgagggttagtcctcataattaatatttgtaaactcttggagcctggcacagagtcagtgtcctgcctacctcctaataactccaccagttagatggtgatgacccctcttgcagaagaggaaatcgaggctcacagaagccaagtgactggcctgggccacacaggcagcagtaagcagaagcaggatttcaaaccagttttcctggactcctgttggggtctgggctctacagccaactcacggtgtgggcagtccctcagccttcttgagccttggtttcttcacatataaaatagggatgctagacttgcagtgtgctgagatctgggaggtgatgaggtcaggcagggcctgctctgtacttaaaactctgtgaggtctgggcgcggtggctcacgcctgtaatcccagcactttgggaggccggggagggcggatcaccaggtcaggagatcgagaccatcgtggctaacatgttgaaaccctgtctgtactaaaaatacaaaaaattagccaggtgtggtggtgggcgcctgtagtcccagctattcgggaggctgaggcaggagagtggtgtgaacccgggaggcggagcttgcagctcactgagatcgcgccactgcactccagcctgggtgacagagtgagactctgtctcaaaaaaaaaaaaaagaactctgtgaataggccaggcgcagtggtgtgtgcctgtaatcccagtgactcgggaagctgaggtgtgaggattgcttgagttctagacttgtttgagtaacacagcgagaccccgtctctattagaaattttttaggctgggcatggtagctcacgcctgtaatcccagcactttgggaggccgaggtgagaggatcactaggggtcaggagatcgacaccagcctggccaacagggcgaaaccctgcctctactgaaatacaaaagttaggggcgctgtggctctcgcctgtaatctcagcactttgggaggccgaggcgggtggatcgcttgagcccagaagttcaagaccagcctgagcagcatggggaaaccccatctctacaaaaaatacaaaaattagccgggtgtggtggtgtgcacccgtaggcccagctacttgaagggctgaggcagaaggatctcttgaacctgggaggtcgaggaagcttcactgagctgagattgcgccactgcactccagcctgggtgacaaagtgagaccctgtctcataaataataaacaagaaagaaaatacaaaaattagccgggagtgatggtgcacacctgtaatcccagttacttgggaggctgaggcaagagaatcactcaagcctgggaggcggacgttgcagtgaactgagattgtgccactgcacaccagcctgggtgacagagcaagagtctgtctcaaaaagaaggaactcagtggagtggtccttgttgtcaccttctgattcactggagtccagcaccagagtgtggcaagataccttgttcccacacagccccttgccatgcccccagagatgtgtgcatttcccagggaggccacttctgccttttccatttccttgaggctcctgggaggtcctgtgcctccacccctggggcgcctcctccatcaccccaccctcctgcttcctttcttgcttaggctgtgaagtgtgtgagctccacaggctcaggtgggtggggtgagaggggagggtgctcgtcctggacttgccggcacagggtctcctgggggctccctcttggccagctctgggccagagatgcgttttgcagttgccatttgcgcatggattctcagccccaccagcctgagtcttcctgagggcggtgccccatcttcctggctctgcgcccacacagtagcgcctgccatgcagttcttgcccagtctgaggcaggaatagctggaggccattgtcacctgatcgcttggcccttttgccagcatcctgttttgaggggcagcaggaatgggggtgggggccttgtgtacgctggagaccaaaagtgggaagggaggagcccagctctccacagtgggttctgggcctgggggccacagcagggggttcatacagggctcaggggagagaggaggcttgctagctcccacctggcgttggctgatcctctgaggggctgcgttggaggggttggcattctggaacaccctgctgtctgtcctgcaggtccagaaagtccctgtgggtgtgtttgtcccggggcaggtgtgggctccctcagatctttccacactgttctttggaaaccctcactgaagtctttccctcctccagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcaggtatcacttctagttttactttaaaaaataaaaaaatagagacagagtctcaccatgtttcccaggctgatcttgaactcctggcctcaagcgatcctcctgccttgacctcccaaagtgctgggattacaggcatgagccaccacacctggcctgattttatttttattttttagaccttcccactgaggcctctgcttgaccttggtcaccctgtagctcaacggggaaggcaaaggacagtgagggctgcttacagggaaggcagacctagggcagatcaggaaaggcctccctgagccagaaaccattatgctggggctgtgggatgagaatgagttagctccagaaggaaggcagctggttcctggggaggagatagaaatctggctgcaggagccagagttttcgcgcttgtcacccaggctggaacgcaacggcacgatctcaggtcactgcaacctctgcctcctgggctcaagcaattctgcctcagcctcccgagtagctgggactacgggtgtgcaccaccatacccgctaatttttttttttttttgtagagatggccaggctggtctcaaattcctgacctcaggtgatccgcccgccttggcctcccaaagtgttgggattacaggtgtgagccaccacgcctggcccctgattttaagcaatacccagcttacttggattttggggtgaagtcagtgctgagtctcccaactctgttggcactccaggggtgggacagacactgtccctgggtgcagaggccctggagacagcactgccctttcccccaaaggccaggctctgaccttgagagtggtgggagtgggtgatccttctgggaggttggactcccaggaccgctggctgttggggagcattgattgtgaagaccagtcaggtggggtaaggggtgtatgtgcggacactcagtaggccagccacagacttctcacttcttttttttttttgagacagagtttcgctcttgttgcccaggctagagtacaatggcgcgatcacggctcactataacctctgcctcctgggttcaagtgattctcttgcctcagcctcccgagtagctgggattacaggcgcctgccacaagcccagctaatttttgtatttttagtagagacggggtttcgccatgttggccaggctggtctcaaactcctgacctcaagtgatccgcccacctctgcctcccgaagtgttgggattacaggcgtgagccaccgcgcctggcctaacttccatctcttgagggctcccacagccacttctcacatgaaccttcctcagcaccttcccactgaggctcctgcttgaccatggtcaccctgcagctcaacggggaaggcagaggacagtaagggctgctcacagggaaggcaaacctagggcagatcaggaaaggcctccctgagccagatcccattatgctggggctgtgggataagaatgaattcgccccagaaggaaggcagctggttcctggggaggagacagaaatctgcaaagggagggtgtccaagtctggctgcaggagccacccagtgaccctacgcaggggagtgtcatggcttccccagggcacagccccagacccttcagcagctaaaaaagatcagctgtggaccaagagggtgctgagaccgccctgccctctggaaggggaaaggccacggctacaggcagcaggtaccagtgtcccagagtgggtcctacaaaggctaacaccttcctggagaaggtgggattctgcttggggcaaaaggatgaatcagattcagaaaggtcaggagggaaggaaagactaggcagggtgtgcagaggccacaaggagggcaagaccctaggcaaggcatgccgctgacggcatctgaaccaagttttatgaccacaacttttttttttttttgagacagagtctcactctgtcacccaggctggagttcaatgatgtggtctcggcgcactgcaacctccgcctcccgggttcaagcgattctcccatctcagcctccctagtagctgggactacaggagcatgttaccacacccggctaatttttgtatttttggtagagacgggagttttactatgttggccaggctggtttagaactcctgacctcgtgatccgcctgcctcggcctcccaaagtgctggggttaacaggcgtgagccagcgcgccggccaacttttctaacaaatggggtctcactgtcacccacgctggagtgcagccccaagtgattctcccacctcagcctcctgagtagctgggactacaaattagagccaccatgcccagctaattttcttttttcttgaggcgggcggggacttgctgtgttgcccaggctgatctcgaactcctgggctcaagcgatctgcccgcctctgcttcccaaaatgctgggatcacacacgtgacccaccgcgcccggcctttattattaaatttaattaattaattgatttcctttcctttttcccccccaagcaacccgactccgagaatggacgtttcatttattcatttactcaccaaatgtttactaagagcctactatgagtcaagcactatgtgtcagatcctgagaataaagcagtgagcaacagaagatccctgccctccagtagctagcattctatggggactcggacaacaaaccagaataagtaaataaaataaattacctgtcggcgccacaaaagcagtgggatgagggaggaaatgcggagtgcctgaggggcgtggctgccatattaaagaagatcacgaggcagtaacatttgcagcagtcctcatttggaacgggaaataatgcaaatgaacaccaacaaattccttcccatccccagaagtttctaacttcaagcgggctccatacctttcaactgatctggtcactggggaaagtggggacgggcctctaattctcttttccctgctattctgacatttacggtacgcgtagccgcgggcgccgcagaactcaggggcttgggccccgccccaaccccgcgcgtgcgcgtgcgcagggataagagagcggtctggacagcgcgtggccggcgccgctgtggggacagcatgagcggcggttggatggcgcaggttggagcgtggcgaacaggggctctgggcctggcgctgctgctgctgctcggcctcggactaggcctggaggccgccgcgagcccgctttccaccccgacctctgcccaggccgcaggtgagtgacgccccgcagcgcgggctcccacccctcgcgaggcttcgccccgccgccgcgcaccgacaacgcctagtcactggctgcaccgcacgtcagttcatgacactcccccagcacgtggacttggacttcatcgcttgtgggaaggcgcgcactggtgctaggaagaccccatgctgggggaggggaggagggtgtctccacctgcctttaacggttttgctccggccctgcacaccgtctccacacctgctgtgccctgtcgtcccccattgtcacctccaagccgcccttcataccagcgtggtcaggaaagctcttagcaggctcagattgtccgaccgctaatcacgcaggacgggtcacctggtgcctctcgcacctttgccttccaaaccctcgcgcccaggccttgtgaccgttccgcaaccgtccctgccctcccagtctctcctcctttgtcctccatccttagagaacgcgaggtctctcccccccatgctactgcaggctctcgcagagactggggtcacaagttgaatatacccccgtggacgtgttcgccctggcctaagaggtattggtggccagtggggacgggctccctctctgatacccctagaggcagctggagggttggagtggcctccctgtgcactcaggcactcccaacttgcagccctgggctcaggctcacacactttcccagctcctttgtgcattccgcacttctaggtccctggactcatcccaaagtccctgacattcacgttaaatgttcctgggtttttttttgtttgtttttttttaaggaggcagcgttcacgttaaccaagtacaaaagtttttgtttttttttttttgagtctccctctgtcgccctggctggagtgcagtgcaatgttggctcactgcaccctccgcctcccgggtttaagcaattctcatgcctcagcctcccgagtagcttgggactacaggcaccgtcaccatgcccggctaatttttgtatttttagtagagatggggtttcaccatgttggccagactggtctcgaactcctgacctcaagtgttctgtccgcctcagcctcccaaagtgctgggattacaggacaaaactctatacacagtctcttttttctcaggatgttgaggtagggattcccagcataccccgtttacaggtgaggaaactgaggccaggagagaaagtcactggtcactgtaactcctgtcaggcttacaccctatgaggcggggactgctgtgctctactgtccactttgcagagggatacacactcccgcagtccagcgaagggaggtcagaggtgtcagggctgtggaagtctgcgcctgggtggagagccacacctggaggctgccagatctcccgggggcggggaaggaagcaggcaccggtttgtccacagctcttctgggatccatagagctcagggaccctgtggcaagtaggtgcaattaggcctgaaggccgaggaggggctggcagtggggagtggggggttggaggctcatggctggtgggtaaaggtggaagaggttaaaggccttggcagagtgaagctaagccagggtggcggatttgccacctcccctggccgcacccaggaggaagccgtaaaggccactcccttcctctgtcccttggcccaggttgcgggcccctccgtgcccctccaggtcggcaagcagctgagcttccctgctcagaatctaggacagccgggatcttctctggacccagcttggacccttatgtgacctgtgtccacttataatcaggcactgccctgggtttaggcggccaggtcacagccctgacctccacagaatgtccagtctgtgggtggacaggcatgaccagggctttaaggacagttgttagacatgggaggcagtgcttcctaggtctccaagagggacatgagaaccctcccaggaaatcagctgagatctgaaaattgaggggaaaacacagggtgtagggaggagagagggaaaggcaagtctctggtgtcctaatggaccttggggcctggggcctggggctctggtgaggagctgacacatttaggatggggagagtgataggtctgggaggaattcaggaggcggggcaacaggacttggtgactgagcagattttctacccagtgcctcagtttcccacccactgcctcagtttcccttttgctacgcagaggagatagaccctccctgctgacctgagcccgggagcctgacccagggcatgtggaaaaatggcccgtccctcagtctctttaaccactgagtttggaggtctccctggcagatcatctcgctatgaggagcctggtgaagactctgggatcagcgagacctgagttcgaagcccaactccgctaccagctcttttttttttcttttttgtggtgacggagtctcgttctgtcgcccaggctggagtgcagcagtatgatttcggttcattgcaacctccatctcccaggtttaagcgattctcatgcttcagcctcccgagtagctggcattacaggcgtgcactaccacgcccggctaatttttgtatttttaacagagacggggtttccatgtaggccaggctggtctcgaactcgtgacctcaagtgatccacctgcctcggcctgccaaagtgctgagattacaggcgtgagccactgcacccagcctctgccaccagctgtatggcctcctcttggttcctttctctgtaacctggggagtgcagtagcacctgcccagtggggctcttgagcccaggaactgctacactctgaaccccactcgtactaggggctcagtaacaagcagccgccagtgtggttcctatatcccgggacttcgcctgtctcctgcggatcacagccagtgactactgtgctcttggagaaaggtccagcctccagcttcccaggcttcatttgcatccatctcgcaggccccagctcaggctcgtgcccacccaccaagttccagtgccgcaccagtggcttatgcgtgcccctcacctggcgctgcgacagggacttggactgcagcgatggcagcgatgaggaggagtgcagtgagtggccacgccccttggcggggcttacagggggcggggcctgagggtggtttgtcaggggccaggcacgcggaggtggagcttgtgggaaaggcagggccgcagggatgggtgcgacttgggtctgtgggtcataagaagcggggtctaagatgggcttgggctgggcgcagtggctcacgcctgcaatcccagcactttgggaggctagggtgggaggatcgatcacttgatcctgggaggttgccgctgcagtgagctaggattgtgccagtgcactccagcctgggcaacagagtaagactgtctcaggaaaaaaaaagaaaaagaaaaaaaaaagaaaaatgaaagaaaggaaagaaaggaaggaaagagagagggagggagccaggtacggtggctcacacatgtaatcccagcactttgggaggccaaggcaggcggatcacttgaggtcaggcgttcgagaccagcctggccaacacagtgaaaccccatctctactaaaaatacaaaagttagctggatgtggcggcaggcccctgtaatcccagctagtcaggaggctaaggcaggagaatcacttgaccctgggaggcagaggtttcagtgagtcgagattgcgccactgcactgcagcctgggcagcaaagggagaccccgtctcaaaagaaaaaataaagaaagaaacaaacaaacaaatagaataaagtgggcttgtaggaaggtagagctagtggggtctcaggggaagagcttgcagggaggcctgtccttagaaagtggagttaacagttgcagggggcggagccttaggaagggagcatttttttgggctcagctgttcttagagggtggggcttgcaggggatggggtttcagggagtacctgggccttcttgggtgggcatttgggacctgaccaaccctgtgccccagggattgagccatgtacccagaaagggcaatgcccaccgccccctggcctcccctgcccctgcaccggcgtcagtgactgctctgggggaactgacaagaaactgcgcaactgcagccgcctggcctgcctagcaggcgagctccgttgcacgctgagcgatgactgcattccactcacgtggcgctgcgacggccacccagactgtcccgactccagcgacgagctcggctgtggtatgcacctgcggggctggggtggactcgtgggtagatggggacacccactgcctgctggggcgtggccaggctgggggcgtggacacatgcctttgcccgtgcctgcatccctgtgggggaatcaagacatcattaggggccgggcccggtggctcacgcctgtaatcccagcactttgggaggctgaggtgggcggatcatctgaggtcaggatttcgagacctgcctggcaaacactgcgaaaccccgtctctactaaaagtacaaaaaaatttgctgggcatggtggcacacacctgtaatccgagctactcaggaggctgagtcaggagaaccgcttgaacctgggaggcagaggttgcagtgagctgagattgggccactgcacaccagtctgggtgacagcaaaactctgtctcaaaaaaatttaaaaaaggccgggcacggtggctaacgcctgtaatcctagcactttgggaggccgaggcaggcagatcacctgaggtgaggtgttcgagaccagtctggccaacatggcgaaatcctgtctctactaaaaatacaaaagttagctaggcgtggtggcgtgcacctgtaatcccagctactcgggaggctaagacaggataattgtttgaactcaggaggcagaggtttcactgagccaatattgcgccactgcactccagcctgggtggcagagccagactccctctccaaaaaaaaaaaaaaaaaaagacataattacgggcagtcagcttcacccagcctggttggttgaggataaaccccaagggctcccctgggcatctggccccctcacgccttcagtgctctctcctcaactactgaacgcctgggcttattgcaggaaccaatgagatcctcccggaaggggatgccacaaccatggggccccctgtgaccctggagagtgtcacctctctcaggaatgccacaaccatggggccccctgtgaccctggagagtgtcccctctgtcgggaatgccacatcctcctctgccggagaccagtctggaagcccaactgcctatggggttattgcagctgctggtaagagggacttaccctcccatgctgggggcttagagctccggggattcaggggaggtgggtggggagggatgagctgcagaactcccatccccatgtgtatggagcttggtgggtgtgggggctcttgccttccccctccttactcctctgtccatctgttccccacagcggtgctcagtgcaagcctggtcaccgccaccctcctccttttgtcctggctccgagcccaggagcgcctccgcccactggggttactggtggccatgaaggagtccctgctgctgtcagaacagaagacctcgctgccctgaggacaagcacttgccaccaccgtcactcagccctgggcgtagccggacaggaggagagcagtgatgcggatgggtacccgggcacaccagccctcagagacctgagctcttctggccacgtggaacctcgaacccgagctcctgcagaagtggccctggagattgagggtccctggacactccctatggagatccggggagctaggatggggaacctgccacagccagaactgaggggctggccccaggcagctcccagggggtagaacggccctgtgcttaagacactcctgctgccccgtctgagggtggcaattaaagttgcttcacatcctccgcctgcctctgggtctctgtctcccttggcctgggcagcctggggtcgctgctgcagcccctcctccatgagagcccagcccatagaaggtgggacatggacacccagccctgtgtgcagctactgtgctgcttgctttttgggagcaggggcagcagggctggggtggggagtctgcgttaacatcaggattcttggaagaagagcagagcttgggcagtgccttcccattcccaggtctggggacccccacccactgtggcttcctcctcagtgcagtggaagccaggtttcctgggatggtctcagactcaccctgttttaattattttttaattatgtttttagagactgcgttttggccgggcacagtggctcacacctgtaatcccagcactttgggaggccgagaggtgggcggatcacctgaggtcaggagttcgagaccagcctggccaatatggtgaaaccctgtctctaccaaaaatacaaaaaattggttgggtgtggtggcaggcgtctgtaatcccagctactcgggaggctgagacaggagaatcccttgaacctgggaggtggaaattgcagtgagctgagatcacgccattgtactgcagcctgggtgacagagtgagactctgtctcaaaaaagaaaaaaaaggttttattatttatcctgggcatcatagggatctctgcaaatttttttttttttttttttttttgagacagagtttcgttcttgttgctgggattacaggcatgtgccaccccacctggctaattttgtatttttagtagataaggggtttctccatgttggtcaggctggtcttgaactcccgacctcaggtgatccgcccgcctcggcctcctaaagtgctgggattacaggcgtgaaccactgtgcctggcctatacatttttttttaactagctgtgggtggtggtgtgcacttgtagtctcagctacttgggaggctgaagtaggaggattgcttgagcctgggaggtccaggctgcagtgagccgtgatcaggccactgcattccagcctgcgtgtcacagcaagactgtctcaaaaaacaaacaaaaacaagtaatgtacttgaatcatcctgaaaccatccccacccctggtccgtggaaaaattgtcttccatgaaaccagtccctgctgccaaaaaggttggtgaccggtaaagttaattcacaccctgacttctgggtgacagggcaaagttcctcccttatcctcagcttctgaatctctgaatgggatgttgggggccacagtagcctccttgcaggggagtgacctccctgggaccgttagagatggactcagatggacctgttgcccaggttggagtgcagtagtgtgatcacagctcactgcagccttgaactgggatcaagagatctgcctgggctgggcacggtggctcatgcctgtaatcccagcactttgggaggccaaggtgggcggatcacctgaggtgaggagttcgagaccagcctggccaacatggtgaaaccacatctctactaaaaatagaaatattagccgggtgtggtggcaggcgcctgtaatcccagctacttgggaggctgaggcaagagaattgcttgaacctgggaggcagaggttgcagagagccaagatcctgccattgcactccagcctgggtgacaagagcaagactccatctcaaaaaaaagaaaaatcctcctgcctcagtctcccgagttttgggattacagtcacatgtatcacacccagctaattttttatttttgtaaagtcagggttggtctatgttgcccaggctggcctccaacacctgatctcaaggaattctcccacctcggccccccacagcgttgggattacaggtgtgagccactgcatccagccaggttttttctctaacgttttctctgtcacgagtcagcctcggcggacaacagggtatgtcagggatatgtgtgcccggctgtgaggctggtgtgggtgccacatgccacctaagtggacctctaggctctggaccgtcctgactgtcatgcattcttgttctcagtggagcaaaccgccccatgcccactggctccaaacacctgttgtcgcatcctctctcctggctctgggctgaccaggctcactgggggttcatttgttccatgtgacagtggctgccatcatctgggggccaggctggctggatgtcccatccagaaggtctgtcatgtctgggatagctgacctctccatgtggcctctccacgtggactcctgagcaaggtggccacactcctgccacggtgacttggggttccccaacacacaaagcagagagactgctgggtcaatgttgccgatgctgtattctgtggattcagtggagtccaggtcagcccagatcctgtgtgtgtgtgtgtgtgtgtgtgtgtgtgtgtgtgtgtgtgtgtgagtggggggaacacataagggcctgaacacccttttgagactatctcaaaaacattatttatttatttatttatttatttatttatttttgagacggagccttgctctgtctacctggctggagtgcagtggtgcaatctcggctcactgcaacctctgcctcccgggttcaagcgattctcccgtctcagcctcctgagtacctgggactacaggcctgcactaacacatcaggcgaatttgttttctatttgtagtagacacggggtttcaccatgttggccagactggtctcgaactcctgacctcaggcaatccgctcacctcggccttccaaagtactgggattacaggcgtgagccacagtgcctggccaaaaaaaactttttttatttttctttttttaaagtctccctcctccccctcgcctttttttttttttttttttttttttttttttttttttggtggagtttccctcttgttgcccaggctggagtgcaatggctccatctcggcaaactttgcctcctgggttcaagtgattctcctgcctcagcctcccgagtagctgggattataggcatgtgccatcatgcctggctaattttttgtatttttagtagagatggggcttctccatgttggtcaggctggtctcaaactcccgacctcaggtgatttgcctgccttggcctcccaaagtgcaggggttacaggcgtgaaacaccacgcccgcccccctcccctctgcctttttttttttttttttttttttttagagatgaggtctttctacgttgcccaggctggtctcttaactcctcagctcaagtgatcctcccaccctagcctcccaaagcactgggatcacaggtgtgagccatggtgtccgctgttacccactcttaaggggattgtttgagactaatgagtcctttctctgcgggttgccatttgcaccaacagaacaagaccaggttcagtaaagcaagatagaaactttattcgtcaatcaatgaatggagaaagggaggaactcctgctcaaagtgcctactccctgcaggtgtgatgaggggagttttaaagtttcctagggcatgtagatgcagactgggggtggggattcctggaaagaggtggggctttctagggggcactgaagtgttcagcctttcttttcttttgtacctggcattatatgtgcttagcaaagtgcacctctccccactgaagactttttttttttggtttttctgtttttgagacagagtctcgatcagtcacccaggctggagtgcagtggggcgatctcagctcactgccacctccgcctcccaggttcaagcaattctcctgccttagcctcctgagtagctgggattataggtgtgacccaccgcacccagctttttttttttttttttgaaacagcacctcactctgttgctcaggctgaagtacagtggtgcgatcgtagctcactgcagcctcgaccttctgagctcaagcaatcctcctgcctcagcttcccaagtaggtgggactacaggcatgcatcaccacgcccggctaatttttacattattttttgtagagagagggtctttttttttttttttctgagactgagtctcgctgtgtcgctcaggctggagtgcagtggcacaatctcagctcactgcaacttctgactctcgggttcaagcaattctcctgcctcagcctcctgagtagtacaggcgcgtgccaccacacccggctaattttttttttttttgtatttttagtagagacagggtttcaccatgttggccagggtggtctcaaactcctgacctcgtgatctgcccaccttggcctcctgaagtgctgggattacaggccaagagagggtcttaccatgttgcccagggtggtcttgaactctctgacttaagcaatcctccctcctcacactcccaaaatgctgggatgacagcttggagccattgtgccctggctgtggagattttactctgcccatggagtgaggattcaggcagatggagcactgctgaggtcagctctcatcttgtggctcagttgtggttaatggcatccggccttcatgcctgtaaactagcacagctgtgagcaggggttaatttctttttttttgagacagagtctcgccctgttgcccaggctggagtgcaatggtgtgatctcggctcactgcaacctctgcctcccaggttcaagcatttctcctgcctcagcctcctaaatagctaggattacaggcacacaccaccatgcctggctacttttttgtatctttagtagacaccaggtttcaccatgttggccaggctggtctcgatgtcctgacctcgtgatccacccgcctcagcctcccaaagtgctgggattacaggtgtgagccaccatgcccggccagagcagagattaatttcacaggttctggggctccctaaaagaatggatgttatagtccgggtgtggtggcttacgcctgtaatctcagcactttgggaggctgaggtgtgggggatcacttgaagtcaggagtttgagaccagccgcctttctcaccctcccaaagtgcttggatgacagctgggagccagtgcaccctggctgtggagattttattatgccagtggagtgaggaatcaggcctatggagcactgctgaggtcagctctcatcttgtggctcatttgtggttattggcacttggcctttgttcctgtaagctagcacagctgtgagcagcggttaatttctttttttttttttttgagacagagtcttgctctgccaccaggctggagtacagtggcgcgatctcggctcactgcaacctccgcctcccgggttcaagtcattttcctgcctcagcctcccaagtagctgggattacaggcgctcaccaccacgcccagctaatttttgtatttttagtagagacagagtttcactatgttggccaggctagtctcgaactcttgacctcaggtgatccacccaccttggcctcccaaagtgctgggattacaggcgtgagccaccatgccaggccggatacagggtctttaaaggggtgattaaggccaggtgtggtggctcacacttgtcatcccagaacttcaggaggctgaggtgggtggattgcacaaggccagcagtttgaaaccagcctgggcaacatagggagagcctgcctctactaaaaatacaaaaaattagctcggtgtggtggtgcacacttgaatcccagctactcaggaggctgaggcacgagaaatacttgagaacaggaggcagaggttgtagtgagccaaagatcccaccactgcactccagcctgggcaaaagagtgagagtctgtttcaaaaaaaaaaaaaaaaagcctaagtgtggtggctcacgcctgtaatcccagcactttgggaggctgaggcaggtggatcacctgaggtcgggagttcaagaccagcttgaccaacatagtgaaacccgtctctactaaaaatacaaaattaggtgggcatggtgacacatgcctgtaatcccagctacttgggaggctgaggcaggagacttgcttgaatctgagaggcggaggttgcagtgagccgagattgtaccattgcactccagcctgggcaacaagagggaaactccgtctcaaaaagaagaaaagaaaaaaaatttttttaattagcaggacttggtggtgtgcacccgtggtcccagctactcaggaggctgaggtgggaagattgcttgattccaggaggctgcactgagctgttagcgccactacactccagcctgggagacaaagcaaggccctgtctcaaaaaaaaaaaaaaaaaaaaaaaaaaagcagctgctgagaggtgacagcgtgctggcagccctcgcttgctctcggtgcctcctgggcctccgcgtccactctggccgcgcttgaggagctcttcagcccaccaccgcactgtgggagtccctctctgggctggccgaggctggagccagctccttctgcttgctaaaggtgtggagggagaggcgcgggcgggaacccgggctgtgcgcaaggggctcgtgggacagcgcgagttccgggtgggcgtgggcccccgcactcagagcggacagccggtgccaccggccccaggcagttgaggggcttagcacccgggccagcagctgtggagggtgtgccgggtcccccagcagtgccggcccgccagcgctgcactcgaattctcgcggggcttcagctgcctcccggctgggcagggctcaggacctgcagccccccatgcctgaggcttccccctgccctgggctcctgctccgcccgagcctccctcatgagcgccacccactgctccacgacgcctggtcccatcgactgcccaagccaagagggctgaggagtccaggcgtgtggcaagggactggtgggcagctctacctctgaccccctgcgggttccactgcctgaagccagctgggctcctgagtctagtggggacttggagagcctttatgtctagctgagggattgtaaatgcatcaatcagcaccctgtgtctagctcagggtttgtaattgcaccaatcagcactctgtatctagctaatctggtggggacttggagaacctttatgtctggctaagggattgtaaatacaccaatcagcactctgtgtctagctcaaggtttgtaaatacaccagtcagcaccctgtgtctagctcaaggtttgtaaatgcaccaatcagtgctctgtggggacttggagaacttttgtgtctagctcggggattgtaaacacaccaatcagcaccctgtcaaaatgggccaatcagctctctgtaaaacagaccggtcagctctctgtaaaatggaccaatcagcaggatgtgggtggggccagataagggaataaaagcaggttgccccagctagcagtggcaacttgggttgtctttcatgctgtggttgctttgttctttttctctttgcaataagtcttactgctgctcgctgtttgggtccacactgcctttatgagctgtaacactcactgcaaaaggtctgtagctacactcctgagccggaaagaccacgaacccaccagaaggaggaaactacgaacacatccgaacatcagaaggaacaaactgtggacacgctgcctttaagaactgtaacattcaccgcgagggtctgtggcttcattcttgaagtcagtgagaccaagaccccaccaattctggatacactgctacatcgggtcctcatccaatctgcctggtgtccctacaagaagaagaaatatggacactaagaaatacgaagggtgcatgcagagaagagagcatgtgagggcacacaggaggcggccgcggctctgtaagacaaagcaagggggctcagtagaaaccagctctgggccgggtgcggtggctcacgcatgtaatcccaggcgtgatcatttgaggtcaggatttagagaccatcccggaaatacggcaaaaccccatctctactaaaaatagaaaaattagccgggcgtggtggtgggcgcctgtaatcccagctactcgagaagctgagggacgagaattgcttgaacctggggctactctggaagctgaggcacgagaattgcttgaatctgggaggtggaggttgcagtgcaaccaagatggtgccactgcactccagcctaggtagcagagcaagactccgtttcaaaaatgaaaagcagaaaccaaccctgatgacatcttaatcttggacgtcagcctccagaaatgtaagtttctgtttttaacctacccaagctgtggtattttgttatggccaccctagcaaactgaagctagtatgatagctcagaaactctttttttcatttttttcttccttagagacagggtcttgctttggctcccaagctggagtacggtggtgcagttatagaattatagctcactgtagcctcaacctcccaggcttaagagatcttcccgcctcagcctcctgattagctgggactacaggtctgcgccactgtgcccagctaatttaaaacaaaacaaaaaaatgtttcatacagattggtcaacatggccagaccccgactggtaaaagctggttaaaaaagatacttgttgatggtcaggtgcagcggctcacacttgttatccaagcactctgggaggctgaggcatgaggactgtttgaacccaggtgttggagatcagcctgggcaatatagtgagatctcatttatactaaaaaacaaacaaaaaaaatagctgggcatggtggcacatacctgaagtttctgtagttgcagctacttaggaggctgaggtgggaggattgcttgagcctgggagatggaggctacagtgagctatgatcacccattgcactccagcctgggcaatggagcaagatcctgtctctagaaaacaacaataaaatatatctgttgaatgctactatgtatcagtgctgttcctggttctaaccatgaacaaaatagccctgaaaaaatagggctgagcccggtggctcacatttgtaatctcaggactttgggagatcaaggcaggtggatcgcctgaggactggagttcgagaccagcctggacaacatggcaaaaccccatctctactaaaataaattagcagctgggtgcactggttcatgcctgtagtcccagcactttgggaggctgaggtgggcagatcacctgaggtcaggagttctagaccatcctggccaacatggtgaaaccctgtctctcctaaaaatacaaaaattagctgggtgtggtggcaggcgcctgtaatcccagctacttgggagactgatgctagagaactgcttgaacccaggaggcagaggttgcagtgagccgagatcttgtcattgtactccagcctgggtaacaagagggaaactgtctttaaaaaaaaaaaaaaaaaaaattagctggatgtggtgtagtgcatgcctgtaatcctagctactcaggaggctgaggcagaagaattgcttgaacctgggaggcagaggctgcagtgagccgaaatccgccaatgcactccagcctgggtgacagcaagttcctgtctcaaaaaaaaaaaaaaaaaaaaaaaaaagctggtgcggagattcactcctgtaatcccagcactttgagaggtcgagaccagcctggccaacatggtcgaacccggtctactaaaagtacaaaactagccaggcatggtggtgcatgcctgtaattccagctactcaggaggctgaggcaggagaatcgcttgaacctgggaggcaagaggctgcagtgagccgaggtcatgccattgtactccagccagggcgacagagcgagactctgtctcaaaagaaaacgaaagagctgggcgtggtggttcacgcctgtaattccagcactttgggaggctgaggtgggtgggtcacctgaggtcaggagttcgagaccagcctgaccaacatagtgaaaccccgtctttactaaaaatacaaaaaattagccgggcgtggtggcagacacctgtaatcccagttactagggaggctgaggcaggagaatcgcttgaacccgggaggcggaggttgcagtgagccaagattgcaccattgcactccagcctgggcaacaagagcaaaactctgtctcaaaaaaaaaaaaaaaaaaaaaaagagaaggtgtttctggttgcagtggggagaacagaacctgcagggagaccagggaggggacaactgcactgatccccagaagtcaggaaggggctggacctagctggcaagtgcaggtggtcagtgataactggcttctaggtctgttttgaaggaaaaggcgatgggggctgtaggattggcagacacattggatgcaggtgggaggaggcgtggatgcctcagaactgtcagagcagagcctgggaagatggtgctaactgagagggagaggacgctcggacaaggcttgggtgggaaacccctaggagtccagattgggacctgcaacactggagcggcctgcgaggaccccttgtggcagaggctgagaaggcactggaccctagggtttgggctagaatgatgaatttgggaattggcccagttgggcgtctgtgggctggagaggagtgaatgcagccaaaccttagatgttttggagctaaggaagaatcagaaaacagatgaaaagttgggtgcggtggctcacgcctgtaatcccaacactttgggaggttgaagcgggcagatcccttgaggtcaggagttcaagaccaccctggccaacatggtgaaacccggtctcttgtaaaaatgaaaaatttagccgggtgtggtggcgggtgcctgtaatcccagctacacgggtggctgaggcaggagaatcgcttgaacctgggagaaggttgcagtgagcagagatcatgccactgcactccaacctgggcaacagagcaatattctgtacaaaaaacaaaacaaaatgaaaaagagatggaagcggggcatggtggctcacatgtttaatcctagctagttgggaggctgagatgggaggattgcttgagtcccggaggtcaaggctggagtgagctattattgtaccactgtgctccagccagggcaacagagtgagaccctgctgtatcttaaaaaggaaaaagggttgggcgtgatggttcacgcctgtaatcccagcactttgagacgccaaggtgggtggatgacttcagcccgaaaatttgagaccagcctgggaacatagtgagacctcatctctacaagaaatacaaaaattatttgggtgtggtggtgcctgcctgtagtcccagctactcaggaggctgaactaggtggaatgcttgaggccagaaggttgaggctgcagtgagccctgatcttgccactgcactccaacctgggcagcagagcaagatactaactcgagaaaaaaaaaaaaactcatagattaaagttcatagcagcaggtccggcagcaaaaattcacctctgttctcttaggatccctctaggcctgagaattattaagttgacataaaatgggttaacaggcagggcgtggtggctcacgcctgtaattccagcacttttggaggccaaggcagctggatcacctgaggtcgggagttcgagaccagcctgaccaacatggtgaaaccctgtctctactaaaaatacaaaaattagccaggtgtcatggtgggcacctgtaatctcagctacttgggaggctgaggcaggaaattgcttgaacccaggaagcggaggttgtggtgagccaagattgtaccactgtactccagcctgggcaacaagaggaaactccatctccccctaccaaaaaaaaaaaaatagggccaggcatggcacagtggctcacgcctgtaatcccagcactttgggaggccgaggcgggcaaatcacgaggtcgacaaatcacgaggtcaggagtttgagaccagcctggccaacatggtgaaaccccatctctactaaaaatacaaaaaattagctgggcgtgctggctggtgcctgttatcccagctactcgggaggctgaggcaggagaattgcttgaaccctggaggcggaggtcgcagtgagctgagattgtgccactgtgttctagcccgggtgacagagcaagactgtctcagaaaacaaaacaaacaaaaacaggttaacaggagaggatacagatttacttaatagaagttttgcatggaatagaagccctcagaagaaaatgaatttgagaggtcaaggcaggaggatcccttgaggccaggagttcaagaccagcctaggcaacatagaaagaccctttctgtacaaaaaatacaaaaattagcagggtatggtggcgtgtgcctgtagtcccagctactcaggaggctgaggcgggcggtggaggttgtggtaagctgagatctagtcactacactccagcctgggtgacaaagactctgtctgtctgtgtctctctctctctctcaaaaaaagaagggtctgggcatggtggctcatacctgtaatcccagcactttgggaagctgaagcagatggatcacttgaggtcaggagtttgagaccagcctggccaacatagcaaaaccctgtctctactaaaaatacaataattggccaggtgtcgtggcacgagcctgtggtcccagctacttgagaggctgaggcaggagaatcgcttgaacctgggaggcagaggttgcagtgagccgagatcgcgccactgcactccagcctgggcaatacagcgagactcagtctcaaaaaaaaaaaaaggaaaaaaaacaaaggttaattttatgccgtgtgagtttcaccttaataataaaaacaaaggagggaaaaatgcatcaacctatttgtgtgctgataggaatgctccaggggtgcggggaggttgttgaggtaggtgcttgtctaggcccatgaaggggtggaggagttggtggagaagggggcgtggttttgctgcatccagggcaaattgattctcacagggcaagaggaagagccactgcgtctgggtcctgatgcaggtctgcaggttgatggagggcagtggctctggaaggtctctcctgctgatttctgttttctcagagatgccacctggtctgtgacaaagattggtaaacaggaggatgatgtcagtattaagaggaaataacaggccgggtgcggtggctgacgtctgtaatcccagcactttgggaggccaaggctgtcggatcacttgaggtcaggagctcgagaccagcctgaccaacgtggcgaaatcccgtctttactaaaaatacaaacattagccaggcatggtggcctgtgcctataatcccagcttctcaggaggctgagacaggaggatcgcttggacccgggaagcgggtgttgcagtgagccgagatcgcccattgcactccggcttaggagacagagtaagactctgtctcgggcggggtggcgggggaaacagggaataacagtaggggaagttcctagtaatgcatgtttttccaagtcccagaaagaacatagcggcagatggcaagttgcccctaggtggtggtcgttccccatgtccaacacccagtcagcctcgggctaatccagggtcactgaccatgtgcttatctggcagttctccctggttttcatgcattttacttttgctttaaccttttctgtttccgatcgagtgaccatcattttttttctactgttaaatatacatatcaatacataatagaaaaaaatacaaaaagtacgtaagtattatacctaaaaataacataaaattgaccactttaacaattttaaggtgggcttcaaaggtattcagtatttttacaatgttgtgcactcatcaccaccacccatctctagaactgttgtttgtttttgttcttgttttttgtttttgagacagagtctcgctctgttgcctaggctggagtgcagtggtgctgtgatctcagctcactgcaacttctgcctcctgggttagagtgattctcctgccttagcctcccgagtagctggcattacaggcacgtgccaccacgcccagctaattttttgtatctttagtagagatggggttttcactatgtttgctaggctggtcttgaactcctgaccttgtgatccacctgcctcagactctcaaagtgctggggttacaggcgtcagccaccattcctggccaagaaatcttttttgtttgtgagatggggtctcattatgttgcccaggctggtctcaagctcctagcctcaagtcatccacctgccttggcctcccaaagggctgggatgatagaatttagccacagtgcctggcttcctctttttttttttttttttttttttttttttttttttttttgagatggagtcgtgctcggtcatccaacctggagtgctggagtgcagtggtgtgatcttggctcactgcaacctccacctcccaggttcaagcaattcttctgtctcagcctcctgtagctgggacaacaggtgcatgctaccatgcctggctaatttttgtatttttagtagagattcgagatggggtttcaccatattggttaggctggtctggaactcctgacctcaggtgatcgactggccttggcctctcaagtgctgggattacaggcatgagccattgtgcccggccacatctgtttttatcaaagtgaaattcatataacataaaattaaccattgtgaagtgaatgattcagtggcatttggtacattcacagtgcagtgcaaccatatctatctactgccagaatattttcatgaccccaaaaggaagccctgtactcattttggtgactcacacatgtaatcctagtgcttgggaggccgaggtgggaggatggtttgaggctaggagattcagatcatcctggacaacatagcaaggcctaatctctaccaaaaataaaaaaattagctgggtgtggttgtgtgcacctgtcatcctagctactgggaagcctgaggcaggaggattgcttgagcccaagtgttggaagctgcagtgatctgtgatcacaccactgcattccagcctgggcaacagagcaaaaccctgtctctaaaataaaaaatttaaaaataaaagaaattggatattctccccctttccctcttttttttccctcccccccagcctggccaatatggtgaaaccctgtctctaccaaaaatacaaaaaattggttgggtgtggtggcaggcgtctgtaatcccagctactcgggaggctgagacaggagaatcgcttgaacctgggaggtggaaattgcagtgagctgagatcacgccattgtactgcagcctgggtgacagagtgagactctgtctcaaaaaagaaaaaaaaggttttattatttatcctgggcatcatagggatctctgcaaattttttttttttttttttttttgagacagagtttcgttcttgttgctgggattacaggcatgtgccaccccacctggctaattttgtatttttagtagataaggggtttctccatgttggtcaggctggtcttgaactcccgacctcaggtgatccgcccgcctcggcctcctaaagtgctgggattacaggcgtgaaccactgtgcctggcctatacatttttttttaactagctgtgggtggtggtgtgcacttgtagtctcagctacttgggaggctgaagtaggaggattgcttgagcctgggaggtccaggctgcagtgagccgtgatcaggccactgcattccagcctgcgtgtcacagcaagactgtctcaaaaaacaaacaaaaacaagtaatgtacttgaatcatcctgaaaccatccccacccctggtccgtggaaaaattgtcttccatgaaaccagtccctgctgccaaaaaggttggtgaccggtaaagttaattcacaccctgacttctgggtgacagggcaaagttcctcccttatcctcagcttctaaatctctgaatgggatgttgggggccacagtagcctccttgcaggggagtgacctccctgggaccgttagagatggactcagatggacctgttgcccaggttggagtgcagtagtgtgatcacagctcactgcagccttgaactgggatcaagagatctgcctgggctgggcacggtggctcatgcctgtaatcccagcactttgggaggccaaggtgggcggatcacctgaggtgaggagttcgagaccagcctggccaacatggtgaaaccacatctctactaaaaatagaaatattagccgggtgtggtggcaggcgcctgtaatcccagctacttgggaggctgaggcaagagaattgcttgaacctgggaggcagaggttgcagagagccaagatcctgccattgcactccagcctgggtgacaagagcaagactccatctcaaaaaaaagaaaaatcctcctgcctcagtctcccgagttttgggattacagtcacatgtatcacacccagctaattttttatttttgtaaagtcagggttggtctatgttgcccaggctggcctccaacacctgatctcaaggaattctcccacctcggccccccacagcgttgggattacaggtgtgagccactgcatccagccaggttttttctctaacgttttctctgtcacgagtcagcctcgacggacaacagggtatgtcagggatatgtgtgcccggctgtgaggctggtgtgggtgccacatgccacctaagtggacctctaggctctggaccgtcctgactgtcatgcattcttgttctcagtggagcaaaccgccccatgcccactggctccaaacacctgttgtcgcatcctctctcctggctctgggctgaccaggctcactgggggttcatttgttccatgtgacagtggctgccatcatctgggggccgggctggctggatgtcccatccagaaggtctgtcatgtctgggatagctgacctctccatgtggcctctccacgtggactcctgagcaaggtggccacactcctgccacggtgacttggggttccccaacacacaaagcagagagactgctgggtcaatgttgccgatgctgtattctgtggattcagtggagtccaggtcagcccagatcctgtgtgtgtgtgtgtgtgtgtgtgtgtgtgtgtgtgtgtgtgtgagtggggggaacacataagggcctgaacacccttttgagactatctcaaaaacattatttatttatttatttatttatttatttatttttgagacggagccttgctctgtctacctggctggagtgcagtggtgcaatctcggctcactgcaacctctgcctcccgggttcaagcgattctcccgtctcagcctcctgagtacctgggactacaggcctgcactaacacatcaggcgaatttgttttctatttgtagtagacacggggtttcaccatgttggccagactggtctcgaactcctgacctcaggcaatccgctcacctcggccttccaaagtactgggattacaggcgtgagccacagtgcctggccaaaaaaaactttttttatttttctttttttaaagtctccctcctccccctcgccttttttttttttttttttttttttttttttttttttttggtggagtttccctcttgttgcccaggctggagtgcaatggctccatctcggcaaactttgcctcctgggttcaagtgattctcctgcctcagcctcccgagtagctgggattataggcatgtgccatcatgcctggctaattttttgtatttttagtagagacggggcttctccatgttggtcaggctggtctcaaactcccgacctcaggtgatttgcctgccttggcctcccaaagtgcaggggttacaggcgtgagacaccacgcccgcccccctcccctctgccttttttttttttttttttttttttttagagatgaggtctttctacgttgcccaggctggtctcttaactcctcagctcaagtgatcctcccaccctagcctcccaaagcactgggatcacaggtgtgagccatggtgtccgctgttacccactcttaaggggattgtttgagactaatgagtcctttctctgcgggttgccatttgcaccaacagaacaagaccaggttcagtaaagcaagatagaaactttattcgtcaatcaatgaatggagaaagggaggaactcctgctcaaagtgcctactccctgcaggtgtgatgaggggagttttaaagtttcctagggcatgtagatgcagactgggggtggggattcctggaaagaggtggggctttctagggggcactgaagtgttcagcctttcttttcttttgtacctggcattatatgtgcttagcaaagtgcacctctccccactgaagactttttttttttggtttttctttttttgagacagagtctcgatcagtcacccaggctggagtgcagtggggcgatctcagctcactgccacctccgcctcccaggttcaagcaattctcctgccttagcctcctgagtagctgggattataggtgtgacccatataatcccagcttttttttttttttttttttgaaacagcacctcactctgttgctcaggctgaagtacagtggtgcgatcgtagctcactgcagcctcgaccttctgagctcaagcaatcctcctgcctcagcttcccaagtaggtgggactacaggcatgcatcaccacgcccggctaatttttacattattttttgtagagagagggtcttttttttttttttctgagactgagtctcgctgtgtcgctcaggctggagtgcagtggcacaatctcagctcactgcaacttctgactctcgggttcaagcaattctcctgcctcagcctcctgagtagtaacaggcgcgtgccaccacacccggctaattttttttttttttgtatttttagtagagacagggtttcaccatgttggccagggtggtctcaaactcctgacctcgtgatctgcccaccttggcctcctgaagtgctgggattacaggccaagagagggtcttaccatgttgcccagggtggtcttgaactctctgacttaagcaatcctccctcctcacactcccaaaatgctgggatgacagcttggagccattgtgccctggctgtggagattttactctgcccatggagtgaggattcaggcagatggagcactgctgaggtcagctctcatcttgtggctcagttgtggttaatggcatccggccttcatgcctgtaaactagcacagctgtgagcaggggttaatttctttttttttgagacagagtgtcgccctgttgcccaggctggagtgcaatggtgtgatctcggctcactgcaacctctgcctcccaggttcaagcatttctcctgcctcagcctcctaaatagctaggattacaggcacacaccaccatgcctggctacttttttgtatctttagtagacaccaggtttcaccatgttggccaggctggtctcgatgtcctgacctcgtgatccacccgcctcagcctcccaaagtgctgggattacaggtgtgagccaccatgcccggccagagcagagattaatttcacaggttctggggctccctaaaagaatggatgttatagtccgggtgtggtggcttacgcctgtaatctcagcactttgggaggctgaggtgtgggtgatcacttgaagtcaggagtttgagaccagccgcctttctcaccctcccaaagtgcttggatgacagctgggagccagtgcaccctggctgtggagattttattatgccagtggagtgaggaatcaggcctatggagcactgctgaggtcagctctcatcttgtggctcatttgtggttattggcacttggcctttgttcctgtaagctagcacagctgtgagcagcggttaatttctttttttttttttttgagacagagtcttgctctgccaccaggctggagtacagtggcgcgatctcggctcactgcaacctccgcctcccgggttcaagtcattttcctgcctcagcctcccaagtagctgggattacaggcgctcaccaccacgcccagctaatttttgtatttttagtagagacagagtttcactatgttggccaggctagtctcgaactcttgacctcaggtgatccacccaccttggcctcccaaagtgctgggattacaggcgtgagccaccatgccaggccggatacagggtctttaaaggggtgattaaggccaggtgtggtggctcacacttgtcatcccagaacttcaggaggctgaggtgggtggattgcacaaggccagcagtttgaaaccagcctgggcaacatagggagagcctgcctctactaaaaatacaaaaaattagctcggtgtggtggtgcacacttgaatcccagctactcaggaggctgaggcacgagaaatacttgagaacaggaggcagaggttgtagtgagccaaagatcccaccactgcactccagcctgggcaaaagagtgagagtctgtttcaaaaaaaaaaaaaaaaaaagcctaagtgtggtggctcacgcctgtaatcccagcactttgggaggctgaggcaggtggatcacctgaggtcgggagttcaagaccagcttgaccaacatagtgaaacccgtctctactaaaaatacaaaattaggtgggcatggtgacacatgcctgtaatcccagctacttgggaggctgaggcaggagacttgcttgaatctgagaggcggaggttgcagtgagccgagattgtaccattgcactccagcctgggcaacaagagggaaactccgtctcaaaaagaagaaaagaaaaaaaatttttttaattagcaggacttggtggtgtgcacccgtggtcccagctactcaggaggctgaggtgggaagattgcttgattccaggaggctgcactgagctgttagcgccactacactccagcctgggagacaaagcaaggccctgtctcaaaaaaaaaagaagctgctgagaggtgacagcgtgctggcagccctcgcttgctctcggtgcctcctgggcctccgcgtccactctggccgcgcttgaggagctcttcagcccaccaccgcactgtgggagtccctctctgggctggccgaggctggagccagctccttctgcttgctaaaggtgtggagggagaggcgcgggcgggaacccgggctgtgcgcaaggggctcgtgggacagcgcgagttccgggtgggcgtgggcccccgcactcagagcggacagccggtgccaccggccccaggcagttgaggggcttagcacccgggccagcagctgtggagggtgtgccgggtcccccagcagtgccggcccgccagcgctgcactcgaattctcgcggggcttcagctgcctcccggctgggcagggctcaggacctgcagccccccatgcctgaggcttccccctgccctgggctcctgctccgcccgagcctccctcatgagcgccacccactgctccacgacgcctggtcccatcgactgcccaagccaagagggctgaggagtccaggcgtgtggcaagggactggtgggcagctctacctctgaccccctgcgggttccactgcctgaagccagctgggctcctgagtctagtggggacttggagagcctttatgtctagctgagggattgtaaatgcatcaatcagcaccctgtgtctagctcagggtttgtaattgcaccaatcagcactctgtatctagctaatctggtggggacttggagaacctttatgtctggctaagggattgtaaatacaccaatcagcactctgtgtctagctcaaggtttgtaaatacaccagtcagcaccctgtgtctagctcaaggtttgtaaatgcaccaatcagtgctctgtggggacttggagaacttttgtgtctagctcggggattgtaaacacaccaatcagcaccctgtcaaaatgggccaatcagctctctgtaaaacagacctgtcagctctctgtaaaatggaccaatcagcaggatgtgggtggggccagataagggaataaaagcaggttgccccagctagcagtggcaacttgggttgtctttcatgctgtggttgctttgttctttttctctttgcaataagtcttactgctgctcgctgtttgggtccacactgcctttatgagctgtaacactcactgcaaaaggtctgtagctacactcctgagccggaaagaccacgaacccaccagaaggaggaaactacgaacacatccgaacatcagaaggaacaaactgtggacacgctgcctttaagaactgtaacattcaccacgagggtctgtggcttcattcttgaagtcagtgagaccaagaccccaccaattctggatacactgctacatcgggtcctcatccaatctgcctggtgtccctacaagaagaagaaatatggacactaagaaatacgaagggtgcatgcagagaagagagcatgtgagggcacgcaggaggcggccgcggctctgtaagacaaagcaagggggctcagtagaaaccagctctgggccgggtgcggtggctcacgcatgtaatcccaggcgtgatcatttgaggtcaggatttagagaccatcccggaaatacggcaaaaccccatctctactaaaaatagaaaaattagccgggcgtggtggtgggcgcctgtaatcccagctactcgagaagctgagggacgagaattgcttgaacctggggctactctggaagctgaggcacgagaattgcttgaatctgggaggtggaggttgcagtgcaaccaagatggtgccactgcactccagcctaggtagcagagcaagactccgtttcaaaaatgaaaagcagaaaccaaccctgatgacatcttaatcttggacgtcagcctccagaaatgtaagtttctgtttttaacctacccaagctgtggtattttgttatggccaccctagcaaactgaagctagtatgatagctcagaaactctttttttcatttttttcttccttagagacagggtcttgctttggctcccaagctggagtacggtggtgcagttatagaattatagctcactgtagcctcaacctcccaggctcaagagatcttcccgcctcagcctcctgattagctgggactacaggtctgcgccactgtgcccagctaatttaaaacaaaacaaaaaaatgtttcatacagattggtcaacatggccagaccccgactggtaaaagctggttaaaaaagatacttgttgatggtcaggtgcagcggctcacacttgttatccaagcactctgggaggctgaggcatgaggactgtttgaacccaggtgttggagatcagcctgggcaatatagtgagatctcatttatactaaaaaacaaaaaaaatagctgggcatggtggcacatacctgaagtttctgtagttgcagctacttaggaggctgaggtgggaggattgcttgagcctgggagatggaggctacagtgagctatgatcacccattgcactccagcctgggcaatggagcaagatcctgtctctagaaaacaacaataaaatatatctgttgaatgctactatgtatcagtgctgttcctggttctaaccatgaacaaaatagccctgaaaaaatagggctgagcccggtggctcacatttgtaatctcaggactttgggagatcaaggcaggtggatcgcctgaggactggagttcgagaccagcctggacaacatggcaaaaccccatctctactaaaataaattagtagctgggtgcactggttcatgcctgtagtcccagcactttgggaggctgaggtgggcagatcacctgaggtcaggagttctagaccatcctggccaacatggtgaaaccctgtctctcctaaaaatacaaaaattagctgggtgtggtggcaggcgcctgtaatcccagctacttgggagactgatgctagagaactgcttgaacccaggaggcagaggttgcagtgagccgagatcttgtcattgtactccagcctgggtaacaagagggaaactgtctttaaaaaaaaaaaaaaaaaaattagctggatgtggtgtagtgcatgcctgtaatcctagctactcaggaggctgaggcagaagaattgcttgaacctgggaggcagaggctgcagtgagccgaaatccgccaatgcactccagcctgggtgacagcaagttcctgtctcaaaaaaaaaaaaaaaaaaaaaaaaagctggtgcggagattcactcctgtaatcccagcactttgagaggtcgagaccagcctggccaacatggtcgaacccggtctactaaaagtacaaaactagccaggcatggtggtgcatgcctgtaattccagctactcaggaggctgaggcaggagaatcgcttgaacctgggaggcaagaggctgcagtgagccgaggtcatgccattgtactccagccagggcgacagagcgagactctgtctcaaaagaaaacgaaagagctgggcgtggtggttcacgcctgtaattccagcactttgggaggctgaggtgggtgggtcacctgaggtcaggagttcgagaccagcctgaccaacatagtgaaaccccgtctttactaaaaatacaaaaaattagccgggcgtggtggcagacacctgtaatcccagttactagggaggctgaggcaggagaatcgcttgaacccgggaggcggaggttgcagtgagccaagattgcaccattgcactccagcctgggcaacaagagcaaaactctgtctcaaaaaaaaaaaaaaaaaaagagaaggtgtttctggttgcagtggggagaacagaacctgcagggagaccagggaggggacaactgcactgatccccagaagtcaggaaggggctggacctagctggcaagtgcaggtggtcagtgataactggcttctaggtctgttttgaaggaaaaggcgatgggggctgtaggattggcagacacattggatgcaggtgggaggaggcgtggatgcctcagaactgtcagagcagagcctgggaagatggtgctaactgagagggagaggacgctcggacaaggcttgggtgggaaacccctaggagtccagattgggacctgcaacactggagcggcctgcgaggaccccttgtggcagaggctgagaaggcactggaccctagggtttgggctagaatgatgaatttgggaattggcccagttgggcgtctgtgggctggagaggagtgaatgcagccaaaccttagatgttttggagctaaggaagaatcagaaaacagatgaaaagttgggtgcggtggctcacgcctgtaatcccaacactttgggaggttgaagcgggcagatcccttgaggtcaggagttcaagaccaccctggccaacatggtgaaacccggtctcttgtaaaaatgaaaaatttagccgggtgtggtggcgggtgcctgtaatcccagctacacgggtggctgaggcaggagaatcgcttgaacctgggagaaggttgcagtgagcagagatcatgccactgcactccaacctgggcaacagagcaatattctgtacaaaaaaaaaaacaagacaaaatgaaaaagagatggaagcggggcatggtggctcacatgtttaatcctagctagttgggaggctgagatgggaggattgcttgagtcccggtggtcaaggctggagtgagctattattgtaccactgtgctccagccagggcaacagagtgagaccctgctgtatcttaaaaaggaaaaagggttgggcgtgatggttcacgcctgtaatcccagcactttgagacgccaaggtgggtggatgacttcagcccgaaaatttgagaccagcctgggaacatagtgagacctcatctctacaagaaatacaaaaattatttgggtgtggtggtgcctgcctgtagtcccagctactcaggaggctgaactaggtggaatgcttgaggccagaaggttgaggctgcagtgagccctgatcttgccactgcactccaacctgggcagcagagcaagatactaactcgagaaaaaaaaaaaaactcatagattaaagttcatagcagcaggtccggcagcaaaaattcacctctgttctcttaggatccctctaggcctgagaattattaagttgacataaaatgggttaacaggcagggcgtggtggctcacgcctgtaattccagcacttttggaggccaaggcagctggatcacctgaggtcgggagttcgagaccagcctgaccaacatggtgaaaccctgtctctactaaaaatacaaaaattagccaggtgtcgtggtgggcacctgtaatctcagctacttgggaggctgaggcaggaaattgcttgaacccaggaagcggaggttgtggtgagccaagattgtaccactgtactccagcctgggcaacaagaggaaactccatctccccctaccaaaaaaaaaaaaaaaaaaaaaaaaaaaaaaaaaaaaaaaaatagggccaggcatggcacagtggctcacgcctgtaatcccagcactttgggaggccgaggcaggcaaatcacgaggtcgacaaatcacgaggtcaggagtttgagaccagcctggccaacatggtgaaaccccatctctactaaaaatacaaaaaattagctgggcgtgctggctggtgcctgttatcccagctactcgggaggctgaggcaggagaattgcttgaaccctggaggcggaggtcgcagtgagctgagattgtgccactgtgttctagcccgggtgacagagcaagactgtctcagaaaacaaaacaaacaaaaacaggttaacaggagaggatacagatttacttaatagaagttttgcatggaatagaagccctcagaagaaaatgaatttgagaggtcaaggcaggaggatcccttgaggccaggagttcaagaccagcctaggcaacatagcaagaccctttctgtacaaaaaatacaaaaattagcagggtatggtggcgtgtgcctgtagtcccagctactcaggaggctgaggcgggcggtggaggttgtggtgagctgagatcgagtcactacactccagcctgggtgacaaagactctgtctgtctgtgtctctctctctctctctcaaaaaaagaaggggctgggcatggtggctcatacctgtaatcccagcactttgggaagctgaagcaggtggatcacttgaggtcaggagtttgagaccagcctggccaacatagcaaaaccctgtctctactaaaaatacaataattggccaggtgtcgtggcacgagcctgtggtcccagctacttgagaggctgaggcaggagaatcgcttgaacctgggaggcagaggttgcagtgagccgagatcgcgccactgcactccagcctgggcaatacagcgagactcagtctcaaaaaaaaaaaaaggaaaaaaaacaaaggttaattttatgccgtgtgagtttcaccttaataataaaaacaaaggagggaaaaatgcatcaacctatttgtgtgctgataggaatgctccaggggtgcggggaggttgttgaggtaggtgcttgtctaggcccatgaaggggtggaggagttggtggagaagggggcgtggttttgctgcatccagggcaaattgattctcacagggcaagaggaagagccactgcgtctgggtcctgatgcaggtctgcaggttgatggagggcagtggctctggaaggtctctcctgctgatttctgttttctcagagatgccacctggtctgtgacaaagattggtaaacaggaggatgatgtcagtattaagaggaaataacaggccgggtgcggtggctgacgtctgtaatcccagcactttgggaggccaaggctgtcggatcacttgaggtcaggagctcgagaccagcctgaccaacgtggcgaaatcccgtctttactaaaaatacaaacattagccaggcatggtggcctgtgcctataatcccagcttctcaggaggctgagacaggaggatcgcttggacccgggaagcgggtgttgcagtgagccgagatcggccattgcactccggcttaggagacagagtaagactctgtctcgggcggggtggcgggggaaacagggaataacagtaggggaagttcctagtaatgcatgtttttccaagtcccagaaagaacatagcggcagatggcaagttgcccctaggtggtggtcgttccccatgtccaacacccagtcagcctcgggctaatccagggtcactgaccatgtgcttatctggcagttctccctggttttcatgcattttacttttgctttaaccttttctgtttccgatcgagtgaccatcattttttttctactgttaaatatacatatcaatacataatagaaaaaaatacaaaaagtacgtaagtattatacctaaaaataacataaaattgaccactttaacaattttaaagtgggcttcaaaggtattcagtatttttacaatgttgtgcactcatcaccaccacccatctctagaactgttgtttgtttttgttcttgttttttgtttttgagacagagtctcgctctgttgcctaggctggagtgcagtggtgctgtgatctcagctcactgcaacttctgcctcctgagttagagtgattctcctgccttagcctcccgagtagctggcattacaggcacgtgccaccacgcccagctaattttttgtatctttagtagagatggggttttcactatgtttgctaggctggtcttgaactcctgaccttgtgatccacctgcctcagactctcaaaagtgctggggttacaggcgtcagccaccattcctggccaagaaatcttttttgtttgtgagatggggtctcattatgttgcccaggctggtctcaagctcctagcctcaagtcatccacctgccttggcctcccaaagggctgggatgatagaatttagccacagtgcctggcctcctctttttttttttttttttttttttttttttttgagatggagttgtgctcggtcatccaacctggagtgctggagtgcagtggtgtgatcttggctcactgcaacctccacctcccaggttcaagcaattcttctgtctcagcctcctgtagctgggacaacaggtgcatgctaccatgcctggctaatttttgtatttttagtagagattcgagatggggtttcaccatattggttaggctggtctcgaactcctgacctcaggtgatcgactggccttggcctctcaagtgctgggattacaggcatgagccattgtgcccggccacatctgtttttatcaaagtgaaattcatataacataaaattaaccattgtgaagtgaatgattcagtggcatttggtacattcacagtgcagtgcaaccatatctatctactgccagaatattttcatgaccccaaaaggaagccctgtactcattttggtgactcacacatgtaatcctagtgcttgggaggccgaggtgggaggatggtttgaggctaggagattcagatcatcctggacaacatagcaaggcctaatctctaccaaaaataaaaaaattagctgggtgtggttgtgtgcacctgtcatcctagctactgggaagactgaggcaggaggattgcttgagcccaagtgttggaagctgcagtgatctgtgatcacaccactgcattccagcctgggcaacagagcaaaaccctgtctccaaaataaaaaatttaaaaataaaagaaattggatattctccccctttccctcttttttttccctccccctcttcttggtatcagcctgaattagatgagaaataactgttacttgaaatgttgataaaacttgattggggccgggcacggtggctcacgcctgtaatcccagcactttgggaggccgaggcgggcagatcacgaggtcaggagatcgagaccatcctggctaacatggtgaaaccccatttctactaaaaatagaaaaaaattagccaggcgtggtggcggacgcctgtagtcgcagcttctcgggaggctgaggcaggagaatggcgtgaacctgggaggcggagcttgcagtgagcagagatcgcgccgctgcactccagcctgggcgacggagcgagacgctgtctcaaaaaaaaaaaaagcaagactccgtctaaaaaaaaaaaaaaaaaaaaaaaccccaaaaactttggttgaaaaatcctctgggttttgtcctttagcggaaggtagtttgtttcttcccttccccttcccttcctctctttctctcatttttttctttcaacagggtctccctctgtcaaccaggctggagtgcagtggcaccatcatgactcactatagccttgacctcctgggttcaagcgatccttcagcctcagcctctcgagtagtggggactacaggcacacaccaccatatccagctaatttttatttatttttattttttaaattttagatggagtcttcctctgtcgccaaggctggagtgcagtagcgcaatctcggctcactgcaagctccgcctcccgggttcaggccattctcctgcctcagcctcccgagtagctgggactacaggtgcccgccaccacgcccaactaattttttgtatttttagtagagacagggtttcaccatgttagccaggatggtctcgatctcttgaccttgtgatccacccacctcggcctcccaaagtggtgggattacaggtgtgagccaccgcgcccggcctaatttttaaattgttttgtagagaccaggtttcgctatgttgaccagatgggtcttaaacacctgggttcaagtgatctgtctaccttagcctcccaaaatgttgggatcacaggcatgaaccatattgtctgccccctcccccaagttatttccatttcattaatatttatggatttagtaaagttttttggtacctcttggtgcaagttttgcattttatatttttccataaaggtattcttttcatcttcatcttttcttttagttttgagacggagtttcgctcatgttgcccagactggagtgcaatggcgtgatcacagcttactgcaacctccgcctcctgggttccagtgatttttctgcctcagcctcccaagtaggtgggactacaggcgggcaccagcaggcctggctaattttttcagatggagtctcactctgtcgctcaggctggagtgcagtggcacgatcttggctcactgcaagctccacctcctgggttcacaccattctcctgcctcagcgtcctgagtagctgggactacaggtgcccaccatcaggcctggctaattttttgtattttttagtatacacggggtttcactgcattagccagggtggtctcgatctcttgagcttgtgatctgtcctcctcaacctcccaaagtgctggaattacaggcatgagccaccctgccccgccagtttttgtatttttagcagagatggggtcttgacatgttggccaggctggtcttgaactcctgggctgaagcgatccacctgccttagcctcccaaagtgctgagattactggcgtgagccactgtgcctggcatatacccacttttaatcgcatgcagattaaggggcagtttatgtagaaacttttagggaagggggtactaatcattggggcattgcctggaaaggggcagtaattccttgatgttagcatggtaatgtgaaattgacacggcacactggcaggcatgtctcatcgaaagctgcttccccctcccttttccttcacctgttttagctagtcctcaatatggtctggtgtctgagccccacctctgaagtcaaatcttatcttctacctcactaggacttgcctaggagttgcactgatagcctagactgactttcaaatttacttagagacccagagcactttagcccatggtgggtcgcaaagtttgcaggaactcaaattccactgggatccataatttccctcttgttagggctggtttaaatgccccctctatagggaccagccctacagggcctgtgggtttttctcctcgtgtgtggagatgagagatcgtagaaataaagacacaaggcaaagagaaggaaagacagctggggcctggaggaccactaccaccaagacgcagagaccggtagtggccctgaatgcctggctgcactgttattttttggatataaggcaagggggcagggtaaggagtgttgagccatctccagtgataggtaaggtcacgtgagtcatgtgtctactggacagggggcccttccctgtttggtagccgaggcagagagaggggacagcttatgtcattatttcttggagaggtcaacggcttaatactttcacttaattctgctactgttttctagaaggcagagccaggtgtacagggtggaacatgaaagtgaaacaggagcgtgaccgctgaagcacagcatgacagaggctagactgttaggcctctggatggctgttggcaggtggggatggtgggggcttgactgatgtcaggccttccacaagaggtggtggagcagagtcttctctaactcccccaaggaaagggagactccctttcccggtctgctaagtaacgggtgccttcccaggcgccggcattaccgctagaccatggagccctctagtggccctgtccgggcataacagagggctcgcactcttgtcttctggtgtaactatttttattttatatatattttttattttactggaacaacttgtgccctcagtctcttgcctcggcacctgggtggcttgccgcccacaccctctatgggtgggcatcagctgagtgtggtcgggtttttctttctgctctaaaaggacagcgctgggttccatgcctcacaattgctgccccctccctctccccaacacacaaaggcactctccacaccatgctgccaggggtggcggagaggtggtgtcagagattcaggactttcagtgtgtttcttcagtgtgtctttcagtgatataaagttaaaaccgggtactgtgagtgctcacctgatttttggttcttctttttttttttttttttttttttttttttttttttttttttttttttttttttcggagacagagtcttgctctgtcgcccaggctggagtgcagtggcgcgatctcggctcactgcaacctctgcctcccgggttcaagtgattctcctgcctcagcctcctgagtagctggaactacaggcatgagccactgctcccggctgggatttttggttcttgggaaagtgcttttttgtgtgtagctgttaaattggtgtccttgttggagggatggttggtggagccttctattctgttatcttgtgctgccttctacatcctgggtttttgatatagatatgtcatagactaataatgggcagttttattctctttatttctcctactgatatctttttttgttttacggtttttttttttttaattggcggaatttcactcttgttgcctgggctggaatgcaatggcgtgacctcgcctcactgcaacctccgccacccaggttcaagtgattctcctgcctcagcctcccaagtagctgggattacaggcatgcgccaccacacccggctaatttttttgtatttttagtagagatggggtgtctccatgttggtcaggctggtctcgaactcccgacctcaggtgatctgcctgcctcggcctcccaaagtgctgggattaacaggcgtgagccaccgcgcccggccttttttgatttattgttaactagaactcccagaataattttgaataagggtggcgatagcagctattgtcttatttcttaccttaagggttatgtacccaacaattaaatatgacattaaatataacatttgacatgtatgatgctttatttttgttttttagtgttggggccttccactattcctcaggttggagtgcagtggcaagatcacggctcactgcagccttgaactcctggttcaagtggtcctcctgccttgagctcctgagtagctgggactacaggcacataccaccatgcctgatttttaaattttgtgcagagatgggggtcttgccatgttgccaggctgatcttgaactcctgggctcaagtgatcctctcccttggtctccagaagtgctgggattacaggtatgagccaccgcacctggcctgtctctatatttttttctgtgacttcttttatttttctttattaatcttgccagatgttcgtctgttagtcattcaaataactaacttttaggtttgatgatcctaattttaacacttatcctgttttttcttttattgagcttattttactgttctttaaaatcttcttaaatgcttagctaattatttttgagctttttcttttttttttttttttttttttttttttgagtctcaccctgttgcccaggctggagtacaatggcacaatcttggctcattgaaacttctgcctcctgggttcaagcgattctcctgcctcagcctcctgagtagctgggattacaggcacgtgccaccactgctggctaatttttttttttttttttgtatctttagtagagacggggtttcaccatgttggtcagactgatctcaaactcctgacctcatgatccaccccccttggcctcccagagtgctgggattacaggtgtgagccaccacgccaggctgcttttttttttttttcgtttctaatataagcctgttaggctgcaaacttcctccaaaggattgcttaagctacactccacaaacattgacatgtaatatttttatatttttgctattcatctttttttttttttttttttttttggagacaaaatctcactctgttgccaggctggagtgctggcatgtctcagcctcccgagtagctgggattacaggcatgtgccaccacacccagctaatttttgtatttttagtagagacggggtttcaccatgttggccaggatggtctcgatctcctgacctcgtgatccgcccaccttgacttcccaaagtgctgggattacaggcgtgagccactgtgcccggcctttgctattcatctataggagtgtattttctaatcttcattatgggctctctttcaacccatgaggttcctattatttgtttttttggaggaaatgggaattattggatagggaaacaccaggtaaatggaataattataatctttgcttcatgagacactgtagttgatacatacaaatccctttcttcatgcatttattaagatgaaatttacataacgaaccatcttaaagtgaacagttcagtggcatcgagtgcatttgcaatgttgtagaaccacgactttagttccaaaacatttccaccgctgcaagataaaactccgtacccattaaacagtttcttcctatgccttcaccctgaagcccccggcagctataaatatacattttatttttataggtttacctcttctggatatttcatataggtggaatcataaaatgtgtgaccttttatgtctgggttcttacactgagcataatgcttccagggttcattcacatgcagcatatgtgagtgctgtattccttttcatggctgagtagtagtccattgtatggatggactacaatttgttattggacatttgggttgtttctatggtgtttttttctccccccacccctccagacagggtctctctgttgcgcaggctggagtatagtggcatgatcatagctcacagcagtcttgtactcctgggctcaggcaatcctctcactcaacttcctgagtagctgggagtatacgtgcatgccaccacaccctgctgatttttctatttttttgcagagaccatgtctcactatgttgtccaggctggtcttgaactcctgtgctcaagcaatcctcccacttcgacctcccaaagtgttgggattacaggagtgaaccattgtgatcagctgtttctacctttattgtgactagtgctgctatgaacattcatgtgtaaatatttgagtacctgcttccaattcttttgggtctattcctaggagtggaattgctggatcatatagtaattctatttaatttcttgaggaaccaccaaacgattttccacagtgatcattttacatttccaccagcagtgaatacagttgtttcattttttccacatccttgccaacactttttttttttaagacagagtttcgctcttgttacccaggctggagtgtagtggcatgatcttggctccctgcaacctctgcctcccaggttcaagtgattctcctgcctcagtctcccaagtacctgggattacagacatgtaccaccatgcccggctaattttgtatttttaggagagaggggtttctccatgttggtcaggctggtctcgaagtctcgacctcaggtgatccacctgcctcagcctcccaaagtttggggattacaggcatgaggggattacactgcacctggccaacacttcttttattatacccactcttgtggatgtaaagtggtttctcattgtgtttttgatttgcattttcctaatgactaacaatgttgaatatcttttcatgtgcttattggccatttctttttgggaattttttttttctttttctttttcctttagatggagtcttgctcttgttgcccaggctgaagtgcagtggcgcgctctcagctcactgcaacctctgcctcccgggttcaagcgattctcctgcctcagcctcccgagtagctgggattacatgcacgtgtcaccatgcccggctaatttttgtatttttagtagagatgggtttcaccatgttggccaggctggtttcgaactcctgaccgcaggtgatccacctgccttagcctcccaaagtgctgggattacaggtgtgagccaccacactcagtcgagaaatttctattcaagtcctttgcctatttttttctttttttgtggagaagggagtcttgctatatttcccaggctggtcttgaattcctggactcaactgatcctcttgcctaagcccccaaagtgctgggattataggggtgagccaccacacctggtctctttgcccccccccccttttttttttttttttttgagatggagtctggctctgttgccctggctggagtgcagtggcatgatctcggcttactgcaacctgcacctcccaggttcaagtgattctcctgcctcagcctcccgagtagctggaattacaggcaccccctaccacgcctggctaatgtttgcatttttagtagagatggggtttcactatgttggccagtctggtctctaactcttgacctcaggtgacctgcctgccttggcctcccaaagtgctaggattacaggcatgagctaccgtgcccagtcacccattttttaaattagggtttttgttgttattgagttgtaagagttatatatcttggatgctagaacctcttcagatatatcatatgcaaatattttcttccattttgtagcttgtcatatccctttaaaaattgtatttaatgagtgtgtcacttcacttcaaaaacttcacctctctcacgcctgtaattccagcactttgggaggctgaggcgggtggatcatttgaggtcaggcgttcgagaccagcttgaccaacgtgacaaaaccacctctctactaaaaatacaaaaattacccgggtgtggtggcacgtgcctatagtcccagctactcgggaggctgaggcaggagaatcacttgaacctgggaggcagaggttgcagtgagccaagatggcaccagtgcattctagcctgggtgacagaaagagactccatctcaaaaaacaaaaaaaacttcacctcacttcaaaaactagaacagtgatagtaattgatatctatctgaatcccattcccttaccttcccagatcaaaggtaatttactaatttgaattttgtgtttatattttattacagttctactagctaggtattcatgcctatatattatctcatttgggttgcttttgagctttataaaaggtcaactattatacacaatgctgaatggtttttccagtgttggtaacaatttatattcccccgataatgtgagattattgaccccccacattctctccaatactttgttgtccaatttcttgtttatctgagacagtcttgctctgtcaaccaggctggagtgcagtggcgcgagatcttggctcactgcaagctccgccttctgagttcacgccattctcctgcctcagcctcccgagtagatgggactacaggcgcccaccaccacgcctgggtaattttttgtatttttagtagaggtgaggtttcaccatgttagccaggatggtctagatctcctgacctcacgatccgcccgcttcggcctcccaaagtgctgggattacaggcgcgagccaccacgcctggcttttgttttgttttgagatggagtcttgctctgttgaccaggctggagtgcagtggcgtgatcttggctcactgcagcctccacctcccgggttcaagcgattctcctgcctcagcctcccaggtgactgcgattacaggtgtgggtcaccctgccctgctagtttttgtatttttagtagagatggggttttaccatgttgccaagtctggtcttgacctcctgacctcaagtgatccccctgcctcagcctccaaaagtgctgggattccaggtgtgagccaccaggcctggcctctgtttatttttggagctcttgaagagacagtgacctccccaggctaacccttgggaagtctgtgggatttcagcccactccctccactgtcccaaggaaggatccagggaccacaaaggtgggcaatctaccggacttaagaaaggactgcagagacaggcctggtctgtgacctacctgtgagcttgggcaaaggacttgacctttcagagctagtctgcaagggggtctttgagaggctgacccaagggtaccctaagggtggagggaggggcttgtttgagtcactggctggcgagtcaggggctcatctgggaacagcgtggggagcgggtggtctctgagctctgttgctgtctggggcccctggggccctgcatccttgggtggcagtgagtatcccgtaggtggggtatgtaagcagaggcctggctccctcgggggtctctggggatgaagaaggaactttgatagggacccaagttctcaggcagaaaatttggctccatttgttttaattggacccttttcagcctggggctccccccagcccccaggccacagcctggaggtgtctctggccagccacagcatccagctgctggctcccagatctgtccagttgcccagagggaagaagggtgggtgggcagaaggaaggggctggagacagatcatcagccttcccacccaccccgggtggggccctccctgtctccagaaaggtggcccaggggcgccagtccagtcaccccagaaatatccaaggcactggcgggggggcaaccccttacagccagccccgcccggctatgtggctgttgtgtgcctgttggtcagacgcccggccacccggctccgagggccatcagtgggggctggcctgggccctccagctgccccgttctttagctgcagaggttcctgggccgccgccgcctcctcactggagtctgattcttctacatcactacgaatgtccttctccatctggggaacagagagagggatggagctcagagcagggaggaaggaggagcttagggctggggcccccggggaggtccagccatacctggcccttcttcatgaagctatagagcatgcgcagaatgaggcaagaccagaacacgtgcagcagctgcagcaacatcagaagcccgttgaagaagtagtagccgaagaaggggcccctgttgctgatggactcgtagtatgtggtgtagaggatcctacagccagggggagaggaggaggctggggtttgaccagccgctgtagcccccagtcctaagaatttctaactggcatggccttccctgctccataaccacctatggctccctagtgccccccaccccatgatacctaacactcttgagctgggcacgcgaggccccctctcgcttgtactaaatgagcagaacacacacacgagctccctgactggccattcatgactatgaaccccacccaagcgggtacttatgaactcagctgctttcctgggtggcactctggcagcttctctctactcctcagacccccatcacctccccttcatcagcaggcgactgcctactcacctcataggggaggggcttcatgtcaggaaggcaggcggtggggcctcatctcccaggaagacacagggagcagggctccatctcccagagtttaagaggggcggggcctcatctcccaaggagtaaaaaaggggtggggcctcatctcccgggtagccggacagaggtggggctttgtctcccacggaggctgggaggggcggggcttcattttcactgtgcaacccaagccagttggaaagaatgttccccagcactgctccttccctcgaactcctccttgcttgttgcctgggacactgtcctggagcccagctcccaccacatcctcttctcaaactcagctgtggttcttgtttttttttttttttttttttttttttgagatggagtcttgctctgtcacccaggctggagtgcaatggcgtgatctcggctcactgcaacctctgcttcccaggttccagcgattctcctgcctcagcctcccaagtagctgggattataggcccctgccaccacgcccagctaatttttgtatttttagtagagaggtggtttttgccatgttggccaggctggtctggaactcctgacctcaagtgatctgttcacctcagcctcccaaagtgctgggattacaggcgtgagccgccgcacccagccttcctgctggttctttatcatcaactccaatcccactgttatttcacacaagaaagaaaaaaacaaaaagctcactctttactctgcccctctgggcaccaacttatttcttttccctgtaggcttttttttttccttggaactccttgaaagtactggctgggctgggcacagtggctcacgcctgtaatcccagcactttgggaggtggaggcgggtggatcacgaggtcagaagttcgagtccagcctggccaacatggtgaaacccccatctctactaaaaaaaaaaaaaaaaatacaaaaattagccaggtgtggtggtgtgtgcctataattccagctactcaggaggctgaggcaggagaattgcttgaacccgggaggcggaggttgtggtgggctgagatcacgccattgcactccagtctaggtgacagagcaagactccatctcaaaaagtactggctgtagctgctgtgtttctcctaccccccaatcagctgtagggtgaccagcgacctcgccttcctcactccacagtgctcagccctgcagccccaccagctggcacaacaggttgccagcagccctccctcctccctgggccccttccctctctggctccccgcaccccaccatctccccatctcacagccacttctgcctaatctcctcaggccttgaaaccaagacaggtgggagccatggaggatggcagccagaggagggatgtaatctgactctcatgctccatgggccctgttcttcctctctcgacctgcaaacatcaggaagcccgaggactgagactctctgtccatacctggtccctaggtgatgccatccaggctgctggctgcaaataccagccatggactgacaactcctacattacctctttccccagaagcccagactggcatgcccactgccttctccatgtctcctctgaggccacagacccctcaaacccagcagggctgagctcctgctgcctcgagcagttccttctgtgcttgttcccacctcctgatcccagaggcatccccttaagtctgcccacttctctcgcctaccctgggtcccctcactcctgcccacacttcccatgatgtttcccctgcagctgccaaagggcacccagaacacctaggtcagattgaatccctctgcttataacctccatggctcccatctcccccggggtcaaagccaaagtcctgcccacagccctcaaggacctgcacggcctactccatctcctgcctaccctccccctcacccactctgctccagccacacaggcctccttgctcttcctctaacatgccgggcatggtcttgcctcaggccctttgcacatgctattctctgcctggaacacacttcccctctgatcaacgtggttctgtccctcacctccctcccatctctcggtacaaacgctgccagcgaggcattacctgccattctaattccaactacccacctctcccatacttcctgctcccttcctgacttttttttatttagagacagagtcttgctctgtcgcccaggctggagtgcagtggtgtgatctcagctcactgcaacctctgcctcctgggttcaagtgattctcctgccttagcctcccgagtagctgggattacgggcgtgtgccaccatgcccagctaattattgtgttttcagtagagacagggtttctctgtgttggccaaagtggtctcgatctcctgacctcaggtgatccagccaccttggcctcccaaagtgctgggatgacaggcgtgagccatcacacctggccaatttgatttaagacaaagtctccctctgtcacccaggctggagtgcagtggtacaatcttgattcgctgtagcctctgccttctgggtttaagtgatcctcctgcctcagcctcccgagtagctgggattacaggtatgcaccatcacgtccggctaatttttaatttttaatagagacaaggtttcaccatgttggccaggctggtgtcaaactcctgacctcgtgatcttcctgcctcagcctcacaaagtgttgggattacaggggtgagccactgtggccagcctaacttttgtatttttagtagagatggggtttcactatgttggccaggctggtctggaactcctgacctcaagtgacccgcccgcctcagcctcccaaagtgctgggattacaggcatgagctaccacgcccggcccgtcaaatttattttcttgttagtaaatctctccttcgcatgctgtgcagttcacgtggctgcctcacttaccatctgctcccacccatgcaatgtctgctcacaagggccgggatctttgaactgtggcctctgctgtgttaccagcacactcaagaggcccccacaaatatttactgggcagactttggtgcgctggcagccctgacccttcctcccactgcatggtccaggcacgctgagtaataataattctctgtctcacctctgcgcctttgcatatgccgtgccctgtgcctggcacacccttccctgcctcctcctggaactctcccagccaagatccccagctccttggggcagggtaccaatggtgaggcagtcctggaatctcagacacgccctcccacctccctgacccccatgggagggctgactcactgggtgggaaagaggaccagtcgggtgtagaagaagacaaaggagaagatgaggaagagagcgtcgcacacttgctgatactgcatgtagttgaccatcttacaggcctggaaagggcagcagggagaaatgggctcaggaccagggccctggtctcaaagagaaggtgctataggatgggaccaggtgagttggggtggggccttgtttccaggaactacctaccttttcaggaaaggtaaagagtgtgaatataggctgggcatggtggctcacgcctgtaatcccagcactttgggaggctgaggcaggcagatcacctgaggtcaggagttcgagaccagcctggccaacatggtgaaactccatctctactacaaatacaaaagttagctggcatggtggcaagtgcctgtaatcccagcttcttgggaagctgaggcaggagattacttgaacctgggaggcagaggttgcagtgagcagtgtgtgccattgcactctagcctgggcaagagagtgagactccgtctcaaaaaaaaaaatgtgaatacatgcgtgtgtgcacatgtgtgtagctttatcctccaaggagggagctgagaggggcagggctttatctcccaggaagatggggggcagggcctcatctcccaaggaagctgagaaggcgggggcctctgcccaaggaagccaagaagggtggggcttcatcacccaggaagacagagggggtggggccttatcagcctggaagacagagggggcagggcctcatcacccgagaaagacaggaggggtggggctccatctcccaggaaggttgggaggaatgggacctcatctctggggcacctgggagggctgggtacagcagctgggaagggtcaggcaggggtcgggcccacctccagcaggtagtcagaggaatcgtgtaacagcagcaccagagagccaatgcgcagcaggttggcactgtaggagaaggtcatcaggatgaccgccacgaagtggtgtatcacctgctccttgaaatcctgcagtagacggtgggtcatagtggggacgaggcttgatgctggaaggtcccccaccctatgggccaagaagtgggtcctttcagggggttggtgtggcctctgggcccatggcctctatatctcctgcaggaggcaccagggagctctcaaggtgcggttgtaaggctgccctaccccccagcaccccagcatcccggccagagactgggtcttccagactcttatttggcctcaccttgcgcttgacatcaaagggcagcctgattagcagtgagaggtagaaacccagctccaagaggtaccaccagtacagggatggcttcagagtctgcagcaggacaggacaaggttagctgtggggagcgaaggctccaatcgggcaggggtatggctccgggcccactccgtttgctcaaaaccaggatacttgaatcccaatgagtgagctccccatccctggaggtaatcaagggcagtggtttggtggaagctcctgcttggttttctggcccctctctattccccagaggaatcaaagagcgtgggactcagtggggaatgacagtgtagtgtcagggttcgggtcccatgcccatggctgcagcaactgtgatcatcgccctcaccctccaagcattcacacacactctgccactcacctggtttgggtacctgtcccagcacattactggtgcccacagccatgactcctgcagggaaatgggtgtcaggctgtgcagaggtgagaatccaacctcccaccctgggtctgcggtctctttggttctccttccacagtcacatagatgctaccttcacccagccctgctttttcctgcttctcactctcgactggggggctcattcactgcagaaccccaacttttggtgcatagtaaatccaaatacctgttgagtgaacattcaccaccatcttgcaaagctcgctctctcctcagctgcatgttttcctctctggctgcaccactccacacccccactcctgccagatctaggccaggtggatggggcaggtgagcagtcagctatactctggtatactcacgtggtacaggaccgagaggccgcccacgaaggaggacaggtagaagagaaacctccagctgtggatggggagggagctgtgaaaatagcagacacccgccccgccccaccccggcccgcttccctgcaccccagaagccccatcctgggcttacctggcctcacagaacttcttggtcagctggggtcgatcctggttccggcgtctccggaaccatcgctgggtctgctgcagcgtgaggccacactgggcggccaggagagacagctggggctggggagggggtgatgaggacaagggtcacagaggccctgtggtggcttcccccatgtccccagacaggacttggctctgccctctccactgcaggcccacatcttgcctacagggtgaccatgtctatatggaggggcagtgttgggggtcccagcgtggggccctgcagaacacttgggccctaagagaagcaaatcctgttcatagggcaggcaggtcgctgacggggatgggattaagagagatgctggcgtgcagcatcccctacccccggataggcttccctgcgtccctccagaacggtcagttctcacctccaacctagacaggcagttgagaccttgccccagccccaagccctacctgaagagggaaattgacaagtaaagggggagtcacgtctagctctgcggaagctgccctgtcgcctctagggtatgtggtcttcaccattccccaccccactcaggacgcagccacgcctccacagcacagaccctgtccagcgggcagccacaccagagacgggaatggagggagggtcacagggctgcttctgttactccattccctatcagctcagaccttccattcctccccaggataggagagcaagcaactactctcactctcctagaatctgtccattgtgcaactgtgcccactaaggctcagggaggctgggaggggaggggccccatctcccaaggaggctgggaaggggggggtcctcatctcccagggaggctggaagggtggggctccatgtcccagggatgctgggaggggtggggcgtcgtttcccagggaggctggggggtagagccctttcccagggaattgaggatgaagagtggaaagtaggggcattgcaggggtgcctgcagccaccttggcttctcctgccccaacaaatgggccacacaccatccccacgccccacccccagggcagtagtgcgggtcggagggcatggggggctctcacctccttgggcctgtgcccttccgtgaggaagtgtttctccagcgtggcgttgggcttcacttgcctcctggtctgatccctcacacccagccaccggctcaggggcaggccaatgaatctgggtgcaaaggagacagagcctatcagcccaggtgaagagatgggactgcctgtgtgtgggggcagacatgctgccggtgggataaccaagtctcggaggggcaaagttacaggctcagagagcacagctggcacatggcagggtgtgtaagacttttttttttttttttttttgagacagagtattgcactgtcacccaggctggagtgcagtggcgcgatcttggctcactgcaagctccgcctcccgggttcacgccattctcctgcctcagcctcccgagtagctgggactgcaggcgcccgccactacgcccggctaattttttgtattttttagtagagacggggtttcactgtgttagccaggatggtctcgatctcctgacctcgtgatctgcccacctcggcctcccagagggctgggattaccagcggtgagccaccgcgcccggcctaagacttggtctttcttttccatctgatcagagggtttggaggcccagagtcagaaaggctcgtggggcaggactcgattttccacttattcctggcctcatcccctggggccctggaggggtggcctggctgctgcgttagaccaaacataagaaaggcagctgactcatgcctgttatcccagaactttggggctgaggtgggcggatcacgtgaggtcagaagttcgagaccagcctgaccaatatggtgaaacactgtctctactgaaaatacaaaatcatctgggtgtggtggcgtgcacctgtaatcccagctactcgggaggttgaggcaggtgaattgcttgaacctggaggtggaggttgcagtgagccaggattgcatctactgaaaatacaaaaaattagccgggcgaggtggcgggcccctgtagccccagctatttgggaggctgagctgaggcaggagaatggtgtgaacccaggaggcggagctggcagtgagtcgagatcgcaccactgcactcaagcctgggtgacagagcaacaagactctgtctccccaaaaaaaaaaaaaaaaaaaaaaggcagctggacctttgtctgtagggtgagggtgtgcagaccaactcttggggtacccaggtacctttgcccaatcccaaaccagggacaagagtctcttcactgcctgtctcactgtggcctgggtcctggtctgaccccccgccagtctaggggctccccatgggcaggggctggggctgttcccgctccaagcccctcctcccagcatcccccattccggggtagaggcttggagatcagggaccctggtcaatggccacgttgcccacaagagggcgcgccaacaccacaggtggggaccgaattttatatccaccatccctcctaacatcctgcctcatttggtgaaaggctcagagcagcctagcaaggaactcattgcagaataaatcatgatgcggagagaatgagcgcttattatctgctaagcatggggccaagtccatgtgatacattggctcgtctaaccctaactcagttcctattgtcctaatgggtaaactgaggctcagagacatgcccaaggtgacactgtgagcaggtgaaagacctgaaatttgaactcaggattctggtttttgttcctgcctcctgcctcttaaagtctcattttggaggtggagggcgggaggattgcttgaactcaggagttcaagaccaacctgggcaacatggtgagaccttgtctctactaaaaatacaaaatttagctgggttgtggtgtcacttgcctgtaatcccagcactttgggaggccaaggtgggtggatcacctgacgtcaggagtttgagactagtctggccaacatggcaaaaccccgtttctattaaaaatacaaaaattagtcaggtgtggtggcacatgcctgtaatcccagttacttgtgaggctgagataggagagtcgcttgaacctgggaggcagaggttgtagtgaactgagattgtgccactgtactccagccaaggtgaaagagcaagactctgtctcaaaaaaaaaaaaaagttagccagccatggtggcatgcctacagtcccagctactggtggggatgaggcttttgttctttttttttttagatggagttttgctcttgttgcccaggctggagtgcactggcatgatctcagctcactgcaacctctgtctcctgggttcaagcaattctcctgcctcaacctcctgagtagctgggactacaggcatgtgccaccacacccaactaattttttgtacttttagtagagacagggtttcaccacgtttgtcgggctggtcttgaactcctgacatcatgatccgcccaccttggcctcccaaagtgctgggattacaggcatgagccactgcacccagcctaatttttgtatttttttttttttaatagagatgaggtttcaccatgttgcgcagtctggtctcgaactcctggactcaagtgatccacccacctcagcctcccaaattgctgacattacaggaatcagctaccacgtctggcctagattcaaaaaaaaattttttttaagggctaaaacccctgcgtttgaaactggaaaaccctccgcccaccccactgtccttcacagaggccctgggatgcctttgggatgggataacaccccagctcacatttttttttttttatggagtcttgctctgttgccgaggctggagtgcagcggcacaatcttggctcactgcaacctccacctcccaggttcaggcgattctcctgcctcagcctcctgagtagttgggattacaggtttgcgcccagctaatttttgtatttttagcagagacagggtttcaccatgttggccaggctggtctcgaactcttgacctcaagtgatccacccgcctcagcctctcaaagtgctgggattacaggcgtgagccaccgtgcccggcctcccatccctgttttatgaagatgctggcatacccagctgcaggctgcaggcagtgcagtgttcctataaaccagctgcagtcagtgttcctataaaccagccatcagaggccagaagtgtgggtggtggcggctgggggcaggctggagccagggaacgcgctttggtgcaaagccagcttctactcgggacatgctgcaatggcaaattgcacacagggcacgagcacatactggagcgactgcgggggcaatggattgcggcagggcagacactcacctctcaaaggcaaggcgcatggccaggaggaccagcgccaggggcagggctgccaacaagtcctgggggtgggggtagacacggccatcccggtcttctagctctgtccacgtgacattgggtggtaaccagaacctgtcctgccaaaaccactcgttgaaactggacagcattctgtggacacaggttccagttagctgggaggtctgcaagcagaatgggtggggcaagtggggcctgagaggctggagcctcagaactcctactcgggcccctatcagcgcagttgacaaccaggaggcaggactggaagatggaactccccttgcctgggactttggaactgtcctctggtcccagaagagccaccacttcattctcatcactcccactccattgcctggtcagtgttaaaaggcagagttgggctgtgtgtcctcaggcaaatgacttgacctctctgaacctcaagttcatctgtaaaacagagtagtaggccgggcgcagttgctcacgcctgtaatcccagcactttagaaggccaaggtgggtggatcacgaggccaggagttcaagagcagcctgaccaacatggtgaaaccctgtctctactaaaaatacaaaaatgagctgggcgtggtggcacatgcctgtaatcccagctactcaggagtctgaggcaggagaatcacttgaacctgggaggcggaggttgcagtgagccgagatcgtgccactgcactgcagcctgggtgacagaacaagactccatctcaaaaacaaaacaaaacaaaacaaaaaaacagagacagtaatacccaggcttctcaacctaaagtgcttggccgattgatctttaacaagagtaataataacacagcccaaaatagtagttattactctgcacttaactgatgccaagatggtagccagaagtcaagggagtggctgcttggggtcagaaacttgagtcgtggccgggcaccatggctcatgcctgtaatcccaacactgtgggaggctgaggtgggcagatcacttcaggtcaggagtttgagaccagcctggccaacatggcaaaactccatctttactaaaaatacaaaaattagccgggcgtggtggcaggcgcctataatcccacctgctcaggaggctgaggcaggagaatcgcttgaacccgggaggaggaggttgcagtgagccgagatcatgccactgcactccagcctgggcaacagagaaaaactgtctcaaaaaaaagaacttgagtcctcaaacgtccaggaaggtttctttccactgcaggaagctgcctctgaagcagcccccaaagatgaaggatttaaagaaatccagaggccgggctcagtggctcactgcctgtaatcccagcactttgggaggccgaggcaggtggatcacgaggtcaggaattcaagaccagcctggccaacatggtgaaaccctgtctctactaaaaatacaaaaattagccaggcatggtggtgtgcgcctgtaatcccagctactcgggaggctgaggcagagaattgcttgaacccgggaggcggaggttgcagtgagcagagatcaggccactgcactgcagcctgggtgacagagcaagactctgtctcaaaaaaaaaaaaaaaaaaaaaatccagagttcctttcctggccatctatggaaggtaggctcctctctaggtgggaatttcaggggggtctcttgctatcccagagcccacaaagcaagagggtaagagagcctactgcataactgagcttgcctgataatggagtggcggtcgaggtggggcagctccggccagcgtgtcccagcctgcttgaggagcccaaagagctgctcccttccctgagatcttgagccaagggtccagcctaccacagtggttcccactcagaaagtttgttcgttcattcgtctgtccacgcatccccctgtccatctatctaccgatccatccctctatccacccatccaaacatctgtccacccacccatcatccatccacccatcgtccatccacccatccaaacatctgtccacccacccatcatccatccacccatccaaacatctgtccacccactcatcatccatctacccatcatccatctgttcgcccatcaaaacatctgtctatccacccattattcatcatccacctatccactcatctacccatcatccatccatccacccatccaaacatctgtccatccacccatcattcatctgttaattcatcaaaacatctgtccatccacccattatccatcatccacctatccactcatccatctacccatcatccatatgtccacccatccaaacatctgcccacccaccatccatccacccacccatccaaagatctgtccacccacccatcatccatcaacccatacaaacatcatctatccacctacccattcatccatccacccatcatccatccatccatccaaacacctgtccatccacctatcgtccatctgtcatccatctacccacccattcatccatctccccatccattcatccatccatctgtccacccacccatcatccatccactcatccaaacatctgtccacctgcccatcatccatccacctacccattcacccatccatccatcatccatctgtccacccatctaaacatctgtccacccagccatcatccatccactgatccaaaaatctgtccatctacccatcatccatccattcatcatccatctgtccacccatctaaacatctatccgctcatcatccatcactcacttgtgtgtccttccacccacccatccttctgtccatcttttcttccatctatccatttccccttccatccatccatttatccatctgtcgttgcatctatccgtctgtctgtccatccatccatccaggcaagagatattctccaattgacttgtacatgtcaggtcagggctgggccttggcgacacagcaggggaataaagccaacacattcctgcccagctcacagaccaacagagaaggcagccaataaacaagtaaacagattcataaatgaatgagatgccaaagtataacgggccgggtagataacagagtggcgtgattttaaatgtgatcaaggagaggctctctaaggaggcgccacctgagctgggacttaaagatgaggtcgtcaggccaggtgcggtggctcacacctgtaatcccagcactttgggaggctgaagcgggtggatcatctgaggtcaggagttcaagaccagcctggcccacatggtgaaacctcatctctactaaaaatacaaaaatcagccaggtgtggtggcatgtgcctgtaaccccagctacttgagaggctgaggcaggagaatcacttgaacctgggaggcagaggttgcagtgagttgaaatcatgccactgcactcaagactgggcaacagagcaagactccatcttaaaaaaaaaaaaaaaaaaagatgcggaggtcaggccaggcaaagtggttcatgcctgtaatcccaacactttgggaggccgaggcaggtggatcacttgagctcaggagttcaagaccagcctgggcaacatagcaagaccctgtctctacaaaaaatttaaaaagtagtcaggtgtgctggcacgtatctgtagttctagctattcaggaagctgatgtgggagtacgacttgagcccaggagtttgaggctgcagggagctacgatcacaccactatactccagcctgagggacagagcaagaccctatgagaaaaaaaaagatgagaaggttgtgggtttttcacacaagaaggtggggctgggggaggggctttctagataaatacgcagcaggtgcaaaggccctgaggcaggaccatgcctgggatgttggagcaacagtgaggaggtccgtgtggctggtgcagtgagcaagggggagagagggaggaggggagggcagggaggtgatgaggggcagcacagagcctgcaaggcatgggggccgcagggaagaatctggattatttcccccaacattttgagatggagtctcactctgccgcccagcctggagtaccgtggcacgatctcagctcactgcaacctccaccttgagggttcaagcaattctcgtgcctcagtctcccgagtagctgggattacaggcatgcgccaccatgcctggctaatttttatatttttagtagagatggggttttgttatgttggccaggctggtctcaaactcctgacctcaagtgatctgcccgcctcagcctcccaaagtgctgggattataggcatgagccaccgcgcccggccttcccccaatgttttataataaacatttcaaacctacacaaaagttgaaagaattttacagtgaatacctgtattcccaccactagattctcccctttgcattccattctgtttattccatcacccatctgcctctgcccatccatccctctatccaccatcagtctatctgcttgttcccgatgcatttcaaagtaggcagctgacctcaggccacatcgcccctacacatgtcagcacacagatcattaactagggttcaatatttgcttatgggtttttcctttcaaggtaaaatttacccaagtgaaatgcagactttttgtttttttagacagggtctcactctgtcacccaggctggaatgcagcgatcatggctccctgcagccttgacctcccgggctcgggtggtcttttcatgtcagcccccgcagagccaggaccataggcacacaccaccatgactggctaatgttttaaatttttgtgtagagagagggtctccctatgttatccaggctggtctcaaacccctggctcaagcgatcctcccgccttggcctcccgaagtgttgggattacaggcatgagccactgcgcctggcccgcacacatctttaagggtacagtcactgagtttggacaaaactatgtacctgactaatccagtctcctatcacaaatatttcctctagaaacttccctcatacctcttcccagtcaacctccacccctgtcctgtcatccaaaagtaacaaccattccagtttttttgtttttttgttgttgttgttgtttagacagggtctcactctgtggcccaggctggagtgcagtggtgccatcatacctcactgcacacttgacctcctgggctcaagcaatcctccccactcagcctcccaaattgctgggattataggcatgagccaccttgccctgccccccaccagctttttttttttttttttttttttttgtcatcaaagcttagttttgtcagttcttcatgataaccttgccatgttacaaaataaaaataggccgggcatggtggctcaagcctgtaatcccagcactttgggaggccaaggtgagtggatcacttgcgatcaggagtttgagaccagcctggccaacacggtgaaaccccgtctctactaaaaatacaaaaattagccaggggtggtggtgggcacctgtaatcccagctactcaggaggctgaggcaggagaattgcttgaacccgggaggcggaggctgcagtgagccaagattgtgccactgcactccagcctgggtgagagagcgagacttcatctcaaaaataaataaaataaataaaaataaaaataccataaccccagtgtttaggaggctgaggcaggaggattgcttgaacccaggggtttgagaccagcctggacaacatagcgaaactgtctctacaaaaaatacaaaaattagccgggcaaggtggcatgtggccataatcctagctactcgtgaggcagaggcaggaggattgcttaagcccaagagtttggggctgcaatgagctgtgatcatgccaccacacttcagcctaaatgacagagtgatacctgtctccaaaaacagagtaaatcaataaaaaataaaaatatataaataaaataaaaaatagacccaggtgcagtggctcatgcctgtaattccagcacgttgggagactgaggcaggagaattgcttgaagccaagagtgttttttttttttttttttttttttgagatggagtctcgctcggtcgcccagcctggagtgcagtggcacgatctcagctcactgcaagctcagcctcccgagtagctgggactacaggtgcccgccactacgcccggctaattttttgtatttttagtagagacagggtttcaccatgttagccaggatggtctagatctcctgacctcgtgatccacctgtcttggcctccgaaagtgctgggattacaggtgagagccaccgcgcctggccaaagccaagagttcaagaccagcctagggggcagccgggggtggtggctcacccctgtaatcccagcactttgggaggccaaggtgggcaaactgctttccaaggcaggactgcaccatcttacactcccagcaggagaatgtgagggttccgttgcccttggttctattttgaataatgcagggattctcaggtgttggttgccatgcagggcgtagcattttggaggccagaagagggtgctctggcatgtccagttgagataaggtagagataaggggattccagagacattttagaggtggggccccccaagagccaaatgctttccaaagtggagccagaaaagagaagggttgggagaggaaattggcaagatattggtcaaaggatatgacatttcagttagcagcagtagtaagtccaagagatctgtacatcatgatgattttagttaataatatagtatatactggaaaattgctaagagactacattttctgcagggaggcaatctctcactctgtcttccaggctggaatgcagcggtgcaatcatagctcactgcagcctcgatctcctgggctcaagccatcttcctgcctcagcctcccgagtagctgggactacaggctccagccaccacacccagccatttcctgccttttctggctttagaggctgcctgcaccctccagctcctggtcccttcctccatcttcagagccagcagtggctagttgggtctttctcccaccttgtcattctgacagtgtctctcctgcctccgtcttcttcattttaagacccttgtgatgacactgggttcacccagatgatctcccatctcaagctcagctgattaacaaccttaattccatcttcagcctcaccccacttggccactgaagctgtcagccttccagtctgaagaactggatgaaccagaatggatgagctgatttcaggacaggagtcaggctaagtgtcagacaacacaaattgtgggtgtgggggagggcagctaaaatgttcccgtgggcgtgtggaggaggcaggagctactcaggtttggggcacaggcttggggtgggtggggcctgggtaggacttgtcagtgagtggctgctgttgaaatccatgaagatggatggaatcctctatctatcagcaaggggtcaacaagaccctgttttgggggaaaaaaaaaaaaaaggaagagactgcacatgaaggggcaggctaagtaccatgctatggggcaactgacatttaggcatcagtgaagtattagaagctgttgctagcattggatactctggttggggaggggcactagaagtcagtgacccaacaagcagtcaagggtgtgggatagcagctagtctagacctacaacgaggcccaggcatcccagacagagtagacacatgaacagctgggtggatgtggggacttcagcccaggtggttgatttctcaagaaaaagaaatcatcttcactagcagacaaggttggcttgatcccgtgtgcccgtgggggctcaaggacacatggccagcttggcactcttggtcccaactgtactcagctctcacagccaaagccatgaccactgcagggtatctgcaatcccctatttttttttttttttttttttttttttttagagacagggtctcactttgtcacccagactggagtgcactggcctgatcatagctcactgcagcctcaaactcctgggttcaagccatcctcccacctcagccttctgagtcactggtgcagctttctcagagaccctgctacctttctgacagaccccaaggtgcagatggaaggggactaggtgtcctaggaaggcccaggcatccagacccccagctccatgttttcccctcacccaagggtcttggatgcatccttgcacaccttggtacattcaagtcatgatgagtgtaggggatgagggagaaccacaggagcaatggcttctcacaatctcaagccttgcctctgctgatgtgcccagcttcaatgcccaccagtttactgactgatactctgctcccaccagaccatatcgtttcacacatcctagcctttacaaatactggcctctgcctagaatgctcatttagtatttgggtgctgaagacacaaaatggtggggaaaacaagcaacatctctgccctgaagagcttaaacgctttctttctctgtttggcaaactcctatgcatccttcaaaacccagctcagttgtcacctcctcctgaaagcagcccaattgccctgctttggatcctgttaaagcaccctcccgcaaccctgtcttactgtgatgtcaggagctggccagtgtttttgcagggagggttggagaaggaagcataaccagttctaaactctcctctcctctgctgaatcatgcccattgcttcctgagtggcacagaaaggggaacagatgcactttctaaaccagggagctctccaaggaggcttcagactgatatgccctgattgcagaggtctggccccagaggtcctactctctcactaacctcaccaacctgtctctgtctcgtcccttccctcttctccctcttaaagcataaataaaagatgctgtggtttgagaaaagaacagggtctggagcccagcagactggctggagtcctagctgcaatgcttcaaagccctgggagcctcaatttcgtcacctgttggtgggacaggtgccctccctgaagggtggttaagcagctcagagaccttgcacctggggcattgaggcagagtctggcatatgggaggggctcaggcatggctataaccaggcacctcaggccagcaaggctcaacttctcctgagggaagggaggaaatgaggctgagggatgtgttcctcaatttctagcttttctcttttggatccagttcttctgtttgttccctgtcatcctctgtcttcctgggcctcagttgtcccatctgaaaaatgggtacagctagattccctccttgttctaccaggctattgtgaggctcagggcaggcgggcagtttataaacactccatgctgatatcacaacggatctgattcctgattcctgcctcacccgtttaccaggcatggaacgtggcctatctgtgcctcagttttatctgtaaaatggaacaaacaatagcccctcttccacatggagtggttcggaatggcacctgaggtggagtgagcacctagtaaaatttagaggaccgagtgcagtggctcacacccagcactttgagaggccgaagtgggaggattgcttaaggtcaggagttcgagaccagccagggcaacatagcaagacaaaaaaatttaaaaattaggtgggcatagtgacacacacctgtaatcccggctactcaggaggctgaggtgagaggactggttgagcccaggagtttgaggctgcagtgagctgtgatcacaccactgcactccagcctgggtgacggagcagatcctgtttcggaaaaaaaccccccaaaaaacagcttagactgtgatagttactgctagacaggaggtgggggcaggatggggagtggtctggaaagaaggggtgctggcctatggaggcttctagatggttcttccaagcccttaggacggtttccagcatctgaggtgcctaaggctgctggaagctttccttgcccctgccaccttcccttaaagctgcagctgaagtgtttgggctgggctggacgacagcagcttcagggtcatctgcagagccaccgcgtgggtggcagggccagtgtgaccagcctcttctcccctcaccccacccgcccccaagcctggctgctgtttgaagcctccctggccccactcccagcttggcccctgccacctgggaaccaaactgataatccttcttagtggctaaaaatagccccagattgggggaaagagagagaatggggctttgtactgacacgggaggtgggttagggggcatgagtagaggatccctgcccctcttcaggggtctgagtgagaaggactggttcccacggcttccccgaacccccaaggaccctggcactgctcagcagatcagagctatgcacataggtttgttttgttttgctttcaatctagctggaaatacaggacttgtccatggttgtgaaaaaggcaattaattcagaccccagatgtctgggcctcccagagatgaaaacacacacacacacacacacacacacacacttgcatacattgactcactcacccgcccctgcagcctggcccgctgcctggggtcacctgattcctgcggccagaggctcaggcgggagcacgtgacatgctggaaggaagggggctgtttgcagataaccacagcctgcctctgcaccgggtcctggctgtcccttccagacggacctgtctcttccactctgagcctctctgagcagaggtcccacagggtgttagtgaccagagatgctgccggttgaggtaccactccccccaaagaccccaaggtggaccccaagttcaaggttccgccttacctgagccccttatttctgcacacattcctgccctctacattctggccctgctgcctccccacctctgcctccccagcttaatccatagcaactgctgcttgctgggcttccaactcaccaagctcacttgtaccatgtttgcaccccagacagtcacatacatgtctgactgtgttatcattcttatttcagctcaaatgtcacctcctccaagaagacttctcagactaccaccaaagaggccaccatattattctgtctcctgatcctgtgtagttccttcaaccctcttgtcccagttgatctgtttcattggggtgtcttcttcaccccaaggcataagtttcatgaaagaaaagaatgttgtttgagtcactgctgtatcctcagagcctcagacagggctggacacattagatgccacataaatgtttgctacatggatgaatgagtagaatagacagatggacaggtgggagggtgcaaggatgttagctcaggtggtcaaactctctagaaaaataacccacccttaacaggcatggttggcttgatctccataaacattcccataaaggaaacgtgggaactgggaagcccaaggctcaaagcaagaaatgactagagacagatcacaggtcactcagtcagcaagggggacagtcaaggatagaagcttccttgggtgaggagggggctgctctgctcccacagtgggctcagggttcatacggtcctgcggaggcctccccaggcctacctctgctgattaaagtttccccaaaaagcaagctcctccttctacttgccctctaagctttcggggtactagaagctaatcatgcaatttttcttttttctttttcttttttttttttgagacggagttttgctcttgttgcccaggctggagtacagtggcgcgatctcggctcactgcaacctctgcctcccgggttcaagcaattcttttgcctcacccacctgaataactaggatgacaggtgtttgccatcatgcccgggtaatttttattttagtagagacggagtttcaccatgctggccaggctggtttcgaactcttgacctcaggtgatccacctgcctcagcctcccaaagtgctgggattacaggtgtgagccaccacacctggccacaatttttctttcttaaagagatggggtctcattctgttgcccagactggagtgcagtggcaccattgcagctcactacagccttgaactcttggacttaagtgatcctcccgcctcagccttccaagcagctgggactacaggagcatgccaccacacccagctaatttttgttatttttttgtagagatagggtcttggtatgttgcccaggctggtcttgcactcctggtcttgagccattctcccactatggcttcccaaagtgctaggattaccgacacaagccaccacactcgggctcagcgtgcaatttcttaatgtctatgcccctggaagctcaggagcctccgtaagctgggccatgtcccctgggtatccccagcctcctcccctattgcatcttcttggaaccattccctggcaaccacctctcctgtcagccccctcaaaacctacaaccaatactggaccatgaggatcccccagcaggtgcccacccaactctggcctggtgcctgctgtgggaaggaagtaaagaggggcctccacctccttacccttctggaatcatctgtctcttctgcagttctattcaagctctggttacctcagccccatgccatccagatggtatgattcccaagaccagccccaagcctccaggcctctgcatcagtgccctttttccaacatgcctccgccctcttccctgggccagttcccacttgcctttcaagtcctggatcagattaaaatccctatttaagaggcctcccctgctcttcctatgctaggcagagtcccctccccagccaatacccctccctgcccctagacctttcttctgagccagccctggctccctggaggttggagtattcaagtctgcctctaagtctctccccagttagtgatggtcaggccagggtgagatctccaggggcccccagcatcccagagtaaagtggggaggtccgtgagggaggagagaggatctggtctctggggggttggagggaaaaaatgagcagtccccagccccagaggtggagtagtggagcagggattgtggggggggattaccatctgattgttactcgcacagagacaggattaagtatacacgtgggagtgtgagggggcccacttgggctattaatggtaaaaaaataaaaataaaaacagcattacggaggtataatcaacaggcaagaagctgtacgtgtttaaagtgtgagatccaacacttttttttgttttgttttgacacggagtctcgctctgtcgcccaggctggtgtgcagtggcgcaatctcggctcactgcaagctccacctcccgggttcacgccattctcctgcctcagcctcctgagtagctgggactacaggcgcccaccaccacgcccggctaatttttttgtatttttagtagagttggggtttcaccatgttagccaggatggtctcaatctcctgaccttgtgatccacccacctcagcctcccaaagtgctgggattacaggcataagccaccatgcctggcctacttttttctgtttttttgagatgcagtctctatgcccaggctggagtgcagtggaatgatcttggctcactgcaacctctacttcctgggttcaagtgatcctcttgccgcagcctcccaagtagctgggatcacaggcatccaccaccatgcgtggctaactttttttgtgtttttagtggaaatggggtttcacaatgttggccaggctggtcttgaaatcctgacctcaggtggtctgcccgcctccgcctcccaaagtgctgagagtacaggcatgagccacggcacccagcagttccaacacattttgacatatgtacacacccatgaaatcaccccctcaatcaagataatgaacagaaagctggaggctgagtgagctacacctagtccagcagcctttaccaggtccaaggtaacaggatctttatctataatcgtctctgtgttcctggggcagataactgtgagagaactaacagcaaggtgacttgcaagctaagaaataaacagatttctttcttttctccttttcgtttttttttttttttttttttttttgagacagagtctcgctctgttgcccaggctggagtgcagtggcctgatctcagttcactgcaacctctacctctctggttcaagcgattctactgcctcagccacactgagtagctggaattataggtccatgccacgatgcctggctaatttttgtatttttagtagagatggggtttcgccatgttggccaggctggtctcaaactcctggcctcaagtgatccatctgccttagcctcccaaagtgctgggattacaggcatgagccaccacgcccagccctgttttttctttctttctttttttttttttttttttttagaagacagggcctggttctgttgctcaggctagagtgccgtggcgagatcacggctcattgctacctctgcgtcttgggcctaagtgatcctcccacctcagcatcccaagtagctaggactacaggcgggtgccaccacacccagctaatttttgtacttttttgtagagatgggatttcaccatgttgcccaggctgggctcaagcgttcctcttgccttggcctcccaaagtgctgggattgcaggcatgaaccaccacgcccagccataagcagaaatttgacccaaactcttgggaaagtttaagaaacacctagcatatacagagttccccctccaaagaaaaccttactaacgcatatgtcatgttaggaaacgtctttctcgatttgaactaacaaaactctggtacaccaaatgacaagtcatgaaataggacatgtaaaaccttttcaactagaaggcatttttttgtttgttttgagacagagtctcactctgtcacccaggccggagtgcagtggcgcgatctcggctcactgcaagctccgcctcccggtttaccccattctcctgcctcagcccccggagtagctgggactacaggtgcccgccaccatgcccagctaatttttttgtatttttggtagagacggggtttcaccgtgttagccaggatggtcttgatctcctgacctcgtgatctgcccgcctcggcttcccaaagtgctgggattacaggcgtgagccaccgcgcccggcctgttttgtttttgttttgggatagggtcttgctcttgttacccaggctggactacagtggcacgatcacagctcattgcagcctcaacccacctggggctcaggtgatcctcccacctcagcctcctgagtagctggaaccacagacacatgccaccagcctgcctaattttaaaattctttatagagattggggggagggtctcactatgttgcctgggctagtctcaaactcctaggttcaagcaatcctcccacctcggcatcccaaagtgctgggattataggcatgagccaccacacccagcctgaactagaagttgtattttttatttattttttgacagggtttccctatgatggccaggctggtctcgaactcctgacctcaggagatccacctccctcggcctcccaaagtgctgggattataggcattagccaccatgcccggcctgaactagaagttttaaaacagcaaatggggaaaaaaaagcaaaaagatggccctgtaatcccagcacattggaaggccgaggcaggtggatcacctgaggtcaggagtttgagactagcctgaccaacatagtgaaacctcgtccctattatgccaggtgcggtcgttcacgcctgtaatcccagcactttgggaggctgaggggggcagatcacgaggtcaggagatcaagaccatcttggccaacatggtgaaaccccgtttctactaaaaatacaaaaattagccaggcatggtggtgtgtgcctgtaatcccagctactcgggaggctgagtcaggagaattgcttgaacccaggaggcagaggttgcagtgagccgagatcctgccattgcactccagtctgggcaacaagagtgaaactctgtctgaaaaaaaaaaaaaagaaagaaagaaagaaaaagagaaagatacaatatggataaatcttgaggacgttatgctgaatgaaataaacctgtcacaagaggacaaatcctgtatgattccacttatatgaggtctctagaatagtcccattcatagtgacagaaagtagaatggggccgggcgtggtggctcatgcctgtaatcccagcactatgagaagccgaggcaggtggatcacctgaggtcaggagttcgagaccagcctggctaacaaggtgaaaccccacctctactaaaaatgcaaaaattagctgggcatagtgatgcgtgcctgtaatcctagctacttgagaggctaaggcaggagaattgcttgaacccgggaagcagaagttgcagtgagtttagatcaagccactgcactcctgcctgggggatagagcaagactctgtctccaaaaaaaaaaaaaaaaaaaaaaaaaaaatagaatggtgggtgccaggggaagggaaatggggagttaaaattgaatgggtaaagtacagcatttcagttttggaaaacaaaaaggttctggaagctgggggctgtggctcatgcctgtggtgcagctactcgggaggactgcatgagcccaggcgttggaggctgcagtgagctatgactgcactactgtactccaaccttggagacagagggagactgtcttatttatttttttgagatggagtctcactctgtcgcccaggctggagtgcagtggcgcaatctcagttcactgcaagctctgcctcctgggttcacgccattctcctgcctcagcctcccgagtagctgggactacaggcacctgccaccatgcccggctaattttttgtatttttagtagagacggggtttcaccgtgttagccaggatggtctcgatctcctgacctcgtgatccgcccgcctcggcctcccaaagtgctgggattacaggcgtgagccaccacgcccagccgactctcttattttgagacgaggtctctgttgctcaggctggagtgcagtggtgctatctaactgcaaccttcaccacccaggctcaagtggtcctcccacttcagcctcctgagcagctgggactacaggcgtgtgccaccatgcccagctaatttttgtgtttttgtttgtttgtagagacaggatttcgccatgtcacccgggttggtctcaaactcttggaatcaagcgatccacctgctatggcctcccaaagtgctgggattacagacgtgagccaccgcgcccggccccacaattaaaaaattttttaattttaaaaattactaaaggaggtatggggtggaggaagagctatgttcaatggcttgggaggattatggagttaaaaaaaataaaagcaaagtacagagagacactaatggcctgataatttatacaatggaaaaccacaagaattctccttctggtaatggtgaagtcagccacatcaggccagctctttcatagataacaatgataaacactgagctaaatataaaaaaacaactacctgggccaggcacggtggctcacacctgtaatcccagcactctgggaggccgaggcaggcggatcacctgaggtcaggagtttgagaccagcctggccaacatggtgaaaccccgtctctactaaaaatacaaaaaattagctgggtgtggtggtacgtgcctgtgatcccagctactcgggaggctgaggcaggagaatcgcttgaacctgggaggcggaagttgcagtgagctaagatcacagcactgcactccagcctgggtgacagagcaagactccgccccccaaaaaaaaattagccgagtgtggtggcttttgcctgtaatcccaggctgaagttggaggattgcttgaggccaggaatttgagaccaggctggacaacatagagagaccctcatctcttaaaaaaaataaaataaaaagattcaggctggctgcagtggcttatgtctgtaaccccagcactttgggaagtcaaggcgggaggatcactcaagcctaggagtttaagaccagcctggacaacatagtgaaacctcacctccacttcaaaaaaaaaaaaaaaaaaaaaaaaaatcagcgaggcatggtggtgtctccctgtagtcctagctactctctaggaggctgaggtggaaggatgacaagcctgggagatctaggctgcagggagctgtgatcacaccaccagcactctaacctgggcaacagggtgagaccgtgtctcaaaaaaaaaaaaaaaggtttaaataaaaaggttttaataaatatgttgcactaacaacatttgtatactcaatagccacatgtagccagtggctaccactttgcagaattcagatatggaacatttccatcattgtagaaaattctaggccgggcacagtggctcatgcctataatcccagcactttgggaggccgaggtgggcagatcatctgaggtcgggagttcgagatcagcctgaccaacatggagaaaccccgtctctactaaaaatacaaaaaaattgccgggtgtggtggcacgtgcctgtaatcccagctactagggaggctgaggcaggagaatcgcttaaacctggaaggcagaggttgcagcgagccgagattgcaccactgtattccagcctgggtgacagagcaagattctgtcttaaaaaaaagaaaagaaaaaagaaataaaattctactggacagtatcactctaaagaggaaaaacaagtagcaatcggaagggaatctataaatggaagaaagaaatggcactgggtgaatttctcatttttattgctattcattggagataaaaactggcttaaagattaagaggatagggccgggtgtcgtaactcatgcctataattccactgcttcgggaggctgaggtgggaggattacttgaggctaggagtttgagaccagctttggcaagatagtgagaccctgtctctaccaaaaaaaaaaaagaaaaagctgggtgaggtggtacatgcctgtagtcccagctactcaggaggctgaggtgggaggatcctttgagcccagaagctatgattgcaccactgcactccagcctgggagactgtctctaaaaaaaaaaaaaaaaaaaaaatgctgggcacagtgcctcatgcttgtaatcccagaactttgggaggccaaggcaggcggatcacgaggtcaggaaatcgagaccatcctggctaacacgatgaaaccctgtctttactaaaaatacaaaaagaaaattagccgggcatggtggcgggcatctgtaatcccagctactcgggaggctgaggcaggagaatggtgtgaacccaggaggtggagcttgcagtgaaccgagatcacaccactgcactccagcctgggcgacagagcaagactccatctcaaaaaagaaaaagaaaagaaaagagccagagatggaaagccccatattctacattaaaagtctgtgtacatctcttgctgactcttagcccatggatattgaacgtattccaactagccttgctgaggctaacagaactaggccaagatttcatctgctacccaccacaggagaaacagactttggagtctgagtccagccaggttaactgcctgataaaaaaatagttaaattttaaaaaatcattgctcttcaaaggaacataacagaatccagagactctacaacatatcttccacaatatccagcactcaatccaaaatttcttgacatctcacaaaattggaaaacatggcccatgctcaggaaagaaggaagttaaaggagactggctctgaggtgacccagatgttggaattagcagaaaggtgtttgaggcagctattatgtctgtaatcccagcactttgagacgccaaggtgggtggatcactagagttcaggggttcaagagcagctgggcaacatggtgaaacaccgtctctacaaaaaatacaaaaattagctgagcgtggtggcataagcctgtagtcccagctacttggggggctgaggcaagaggatcacttgagcccaagaggttgaggctgcagtgagctgtgattgcaccactgcattccagcctgggcaacagagtgagaccctgtctcaaaaacaaacaaacaaacaaaacaaaaaacaaatggaaattataaaacttaaaaatatacacaatctgaaatttaaaaattcactgtttgggcttgatagcgcattggagatgataaaagaaagtgctaacaaatttaaagacagattgatagcaaatatccaaactgaagaacagagaagaaaaaagtttaagtaaaaatggatagtggtaatggttgcacaacactttgaatgtactgaatactactaagttgcacacttaaacatgtttaaaatggttaattttatattacatatattttacctcaatttagaaactgtatagagccttggtattttctggatgatatcaaaagatctaacttatggctgggcacagtggctcccgcctgtaatcccagcactttaggaggctgaattgggcggatcacttgggtccaggagtttgaaaccagcctggccaacatgatgaaaccctctctctaataaaaatacaaaaattggccaggcgtggtggcacatgcctgtaatcccagctactcgggaggctgaggcaggagaatcatgtgaacctgggaggcagaggctggagtgagccgagatctgagatcgcaccactgtgctccagctcaggcgagactccgtctcaaaaaaaagaaaaaaaaagaaaaaaaaaggtctaacttgcatgcaatgggagtactagaaggagaaaggaaagagaatggggcaggtgaaatatttgaaaaaataagaaagaacaccaaaggattttgatttttttccctatggctacatatatgcacataaacacacagaagaaggctgtaaggccagatgtggtggctcacacctgtaaccccagcactttgggaggctgaggcgggaagatcacttgagctcaggagttcgaggccagcctgggaaacacagtgagaccttgtctctactaaaattaaaacaacaacaacagcaaataacaactagctgggtgtgttggcacatgcctgtagtcccagctactttaggggctgaggcaggaggatcacttgagcttgggaggttgaggctatagtgagtcctgaacatgccactgcattccagcctgtctgacagagtgagaccctttctcaaaaaacaaaaaaggctgggcatgttggctcacacctgtaatcctagcactttgggaggccaaggcaggcagcagatcacctaaggtcaggatttcgagaccagcctggccaacatggtgaaaccctgtctctactaaaaatacaaaaaaatagctgggcgtggtggcaggcacctgtcatcccagctactccagaggatgaggcaggagaatcacttgaacccaggagacggaggttgcagtgagctgggatcgcactgaactccagcctgggtgagagcgacacacgaagaagaagaagaagaaaaaagaagaaagaagaagaagaaaaaagaagaaagaagaagaaggctctaagggtatagtccacatgcatgtgagttgttatactagggagctggtccgggttgggatgggagccagtgaacctgtcttgtgttttactgatcatagctcactgcagcctccacttcctgggctcaggtgatactcccagctcagctccccaagtagctgggattacaggtgtgcactaccttgcctagctactgttttaattttttgtagagatggggtttcaccatgttgccaggctggtctcaaactcttggactcaggggatccgcctgcctcagcctcccaaagtactaggattacaggcatgagccaccacacctggcattcatggatttttttttttttttagatgaagtctcaccggcccaggctggtgtgtgcaatggcgcaatctctgctcattgcaacctccgccccaggggttcaagtgattctcctgcctcagcctcccaagtagctgggattacaggcatgtgcccctatgcccagctaatttctgtatttttaggagagacaaggtttcaccatgttggccaggctagtcttgaactcctgatctcaagtgatcctctcaccttggcttcccaaagtgctgggattacaggcatgagccaccatgatcggccttcactgatttttttttataaggagtgggtttaagggtgacttcttaaaaaaaaaattttttttttgagacggagttttgctcttgttgcccaggctgcagtgcaacggcgggatctcagctcactgcaacctccgcctcccaggttcaagcaattctcctgcctcagcctgctgcgtagctgggattacaggcacctacaccacacccagctaattttttatatttttagtagagatggggtttcgccatgctggccaggctggtctcaaactactggcctcaggtgatctgcccacttaggcctcccaaagtgctgggattataggtgtgagccaccatgctcggctgacatatttaaaaattttttttaattgtggtaaaatactcaacatttaccattaatcgtgtttaattatacagttcagtggcattaaatatttcacatggttgtgtaaccataaccaccatccagctccagaattctttcatgttgtaaaactgaaactctggcagggcacgttggctcacacctgtcatctcggcactttgggaggccgaggcggacggatcgtgagactctggcagggcacagtagctcacacctgtcatctcagcactttgggaggccgaaatggacggatcatgaggtcaagagatcgagaccatcctggccaacatggtgaaaccccgtctctactaaaaatacaaaaattgtctgggcgtggtggcgggcgcctgtaatcccagctactcgggaggctgaggtaggagaatcgcttgaacccaggaggcagaggttgcggtgagccgagatcacgccactgcattccagcccagcaacatagtgagactccgtctcaaaacaacagcaacaaaaacctgaaaatccatgcctaataatcaataattccctgttccctctcctttggcacccaccattctactttctctctgtgtgaatctggtgacgctaggggcctcatgtaagtggaatcacacagtatctccccttttgtgactggctgatttcatgtaccataatgtcctcaaggttcacccacatgacatgttacatccttcccttttaaggctgaatcaggctgggtgcagtgactcatgcctgtaagccgagcactttgggaggctgagacgggtggatcatttgcgatcaggagttcgagaccagcctgggcaacatggtgaaaccccatctccactaaaaatgcaaaaattagctaggcgtggtggccagcttacttccaagtaagtcccagatacttggaaggctgaggcatgagaattgcttgagccaagatcaaggcagaggttgcagtgagccgagatcgcaccactgcactccagcctgggtgacagagtgagactctgtctcaaggaaaaagaagaaaaaaaacctgaatcatattccagtgtatgtatatatattaagggtgactttttaaatagaaaattatagtacatgaaaatgaaaagatttccactgaaggtgtgtttgatacaggagacagggttgatacaggagagggggcatttttggtagggaatgagccctctacccccacctcactacttaagaaaccaattctcttttttttgagacagtttcgctcttgttgcccaggctggagtgcaatggtgcaatcttggctcacggcaacatcaacctcccaggtttaagcaattctcctgcctcagcatcccaagtagctgggactacaggcatgcaccaccacatccagttgattttgtatttttagtagagacagggtttctccatgttggtcaggctggtctcgaactcctgacctcaggtgatccgtctgcctcggcctcccaaagtgctgggattacaggtgtgagccactgcgcctggcctaatttttgtgtttttagtagagacggggtttcagcatgttggccaggctggtctcgaactcttgacctcaggcaatccgcctgcctcagcctcccaaagtgctaggattacaggcgtgagccactgtgcccagtctggtcttgaactcttttgctcaagcaatctgcccacgtcggccttccaaagtgctgggattacaggcatgagccactacacgggccaagaaaccaattttccatcaagatcagcccctttggtgatgtccctgcccaccttccagggtggagataattgtgaaatctgggttatgctctgatgggatccttccttcactcaacctgctctaacatctgcccctcctcccaccagctgttggctgggcccctgtgctgctccctggtgacagcatacatggaggtagattcatatagggccaagcaggtgcaaagccagactgttctgtgggagagcaggcttttgcccacacccacaccaggattatcctaaggcaccagtgaccaatagcgttggtaccatcccaggtattatccatcagacgcttacccagggacaagcccttacctccctgcattggaaatatcagtcacaccctgaggaagatactgttaccattctttttttttaagacagagtcttgctctgtcactcaggctggagtggagtgcagtggtgtgacttcggctcactgcaacctctgcctcccggattcaagcgattctcccgtctcagcctcccaagtagctgggattataagcatgcgccaccacacctggctaatttttgcattttttagtagagacggagtttcaccatgttggccaagctggtcttgaactcctgtacttaaatgatccgcccgccttggcctcccaaagtgctggaattacaggcgtgagtcaccttgcccggtcaccattctcatttcacagatgaacaaactgagtcttggagacatgccggatcacctacacagggtcacatagctgacaaatggccaggcagtaatttgaccccagctctgtggcaccaggcattccagacagacatgggcccagagacactcagctcatcagcagtagcctcagaattatcagaaaacacggccgggtacggtggctcacgcctataatcccagcactttgggaggcggaggtgggtggatcacctgaggtcaggagttcgagaccagcctggccaacatggagaaaccccatctctactaaaaatacaaaaattagctgggcttggtggcgggcacctgtaatcccagccactcgagaggctgaggcaggagaatcgcttgaacccgggaggcggaggttgcagttagccgagatcgctccattgcgcactccagcctggggggccaagagtgagactttgtctcaaaaaaaaaaaaaaaaaaaagaattattggaaaacaggacttgccttcctgcttctattcactgtccactgccacctctctgtccccaccctactactccagcctttggcttttggccatcagtcgcagcctcccatggccaatcccaagtggtcaattcctctaagcatgaaactgggaccctctagtagcatctcctccccttgtccatccctccttcccagaatcatgacctcctggttcccctcctctctgctgttttctctaatttgtgctggtttttctccctaaattatgccagtcctggatcccctcacaccatctgctctccctgggaaattcacctgcctggaagctgcggccagcacgtccatgctgtcagtttccagatttctgctgctcccaggtcaccatcccgccaaagccaaacctgctgccccaatacctcccgtctgcgcgctgtccagacacgtcagggctgaagtcatctcccacagagccttctttcctcctcccctggcttcttggccaagatcccaccctccacccagtcttcagggacaaaattctgagagtcatctctgactccatctcacaccctctcggcactcagctcctcattaagccctacgattacgtccgtctttcccgcgacagtccctcctctgcccgatttccacggctcccatttcttgattgaatcatggtggccgcctccccactcagcacccaggtctttcttcttgcctgcaaatcagacccgcagctttgaatcctgcaagtgctcccactggcctggcacggtgctccccagcaaatggaccttggcacatgccattccctaccagtaatgccctcccttcagcctgccaaattcctcccagctcttcacgactctgttcaacagacacttcctctaggagggccgaccaatcgccgctgggctgggttaggggacactcccctcctgggttctcctacctcatctttctcagaacttttggggcaacaatttttttttttttttttttgcgatggagtctcgctctgtcacccaggctggagtgcagtggcacaatctctactcaccgcaatctccgcctcccaggttcaagcgattctcctgcctcagcctcctgagtagctgggattacaagcgcgtgccaccacacccggctaattattgtatttttagtagagacagggtttcaccatgttggtcaggctggtctcgaacccctgacctcgtgatccgcccgccttggcctcccaaagtgctgggattacaggcatgggccaccgtgcctggccttttttttttttttttttttttaaagacggagtcttgctgtcacccaggctggatggagtgcagtggtgtgatctcagctcactgcaccctccacctcccaggttcaagcaattctcctgcctcagcctcccaagtatctgggactacagacacgcaccatgatgcccggctaattttttttgtatttttagtagagacggggttttaccatgttggtcaggctggtctcgaactcctgatttcaaatgatccgcccgcctcggtctcccaaagtgctgggattacaggcatgagccactgcacccagccacgggcaactgttttttgtgtttttgtttttgagacagggtcttgctttgttgcccaggctggagtgcagtggcatgatcaaggttcactgcagtttcgacctcccaggctcaagtgatcctcccacctcagctttctgagtagctgggattataggcgtgcactgccacgcccggctaattttgtctttgtttttttagacagagtttctctcttgttgcctaggctggagcacaatggtgcaatcttagctccctgcaacctccgcctcccaggttcaagtgattctcctgcctcagtctcacaagtagctgggattacaggcgtgtgcaaccatgcccagctacttttgtatttttttagtagagacagggtttcaacatgttggtcaggctggtcttggactcctgagctcaagtgatcctcccacctctcagcctcccaaagtgctgggattacaggcatgaaccactgcacccggcccggccaattaaaaaagaaaatttttttgtagagaccaggtctcactatgtttcccaggctagtctcaaactcctgggttcaagtgatcctgatgcctcaacaggatcccaaagtgctgggattacaggtacatgccgccatgcccagctaatttttttttttggcagagacagggtttccctatgttgcccaggctggtctcaaactcctggcctcaagtgatcctcccacctcaacctcccaaagtgctgggactatagatgtgagccactgcacccagccagggacaactatcttcccccatatcctggtgattaggacctctccattttcccagcacctgacacacaacgggtagcaggaaactgtccaccgactgcacaaatgagtaaaaggctcaactgagaccgggcacccaggattccagagaacaaccaagctccagtttcaggctttcccaccaccctcatggccacctgtccgtcttccacctgtgctgtgaggcactcactgctctccttcaaaaggctcgtgctggccaggcacagtggctgacacctgtaatctcagcattttgggaggccgaggcgggtggatcatctgaggtcaggagttcaagatccgcctgaccaacatggagaaaccccgtctctaccaaaaatacaaaattagccaggtgtggtggcgcatgcctgtaatcccagctactcgggaggctgaagcaggagaattgcttgaacccaggaggcggaggttgccgtgagccaagatcacaccattgtactctagcctgggcaacaagagcaaaactccgtctcaaaaacaaaaataaataaataaaaaaggctcatgctggccaggcacagtgactcacgcctgtaatcccagcacttctcggaggctgaagcaagaggatcacctgaggtcaggagttcaagaccagcctggccaacatggtgaaaccccatctctacaaaaaaatacaaaaattagctgggcatgatggtgggtgcctgtaatcccagctactcaggaggctgagacaggagaatcgtttgaacccgggaggccgaggttgcagtgatccgagattgcgccactgcactccagtctgggtgacagagcgagactccatctcaaaaaaaaataaatagggccgggcgcggtggcttacgcctgtaatcccagcactttgggaggctgaggcgggtggatcacgagatcaggagattgagaccatccttgctaatacggtgaaaccccgtctctactaaaaatacaaaaaattagctgggcgtgatggcaggcacctgtagtcccagctactgggaggctgaggcaggagaatggcgtgaacccgggaggcggagcttgcagtgagccacgatcatgccactgcactccagcctgggcgacagagcaagcctctgtctcaaaaaaaaaaaaaaaaaaaaaaaaaaacataaaaaaataaataagtcagtaagtaaatataaaataaaattttaggctgggtgtggtggctcatgcctgtaatcccagcactttggtaggctgaggagggcggatcacttgaggtcatgagttcgacctcagcatggtgaagcctcgtctctactaataatacaaaaaaattagctgggcatggtaatcccagctacttgggaggccgaggcaggagaatcgcttgaacctgggaggtggaggttacagtgagccaagatcgtgccactgcactccagcatgggtgacagagcaagattccgtctcaaaaaaaaaaaataagaaaaaaaaaagttaaaaggctcacattgtttgtttaccgaaatacatttattttcagaagacactttctctccctccctctctccctgaaagagcaagccagcattggcatcacgtgcagaggctagccgtgaaaacaaatacaatgaacacaaaacaaagtgcagtcttgaccagttcccgatgttggcaaggctgccagcccaggccctcgggcactccagattcaaggggaggttaccaagtgtctgttaccatgccttgaaggacacagcagcagaaccaggtacagtggctcacacctgtaattccaatactttgggaggctggggtgggaggattgcttgagcctagcagttcaagaccagcctgagcaacatagcgagaccctgtctctgtttaaaaaaaaaaaaaaaaatacacaggccgggcacagtggctcacgcctgtaatcccagcactttgggaggccgaggcgggcagatcacaaggtcaggagatcgagaccatcctggctaacagggtgaaaccccgtctctactaaaaaaaatacaaaaaaattagccaggcaccgtggcgggcgcctatagtcccagctactcgggaggctgaggcaggagaacggcatgaacccaggaggcagagcttgcagtgagccgaggttgcaccactgtactccagcccgggtgacagagcgagactccgtctcaaaaaaaaaacaaaaaaaaaaacacaaaacagcagtggtaacagaagccctcagccttgatgccatgggaaggcggcagagatttcgggagggaccgattctgggagttctcctggcaacacaggctgcccttggaggttgtcccatccctggaggtcactcagaggctggctggcctcttgcaggtgacagcagccagagtggggaagctgggtcagaacaggtagggaggctcagccggacgcggtggctcatgcctgtattcccagtactttgggaggccgaggcgggcagatcacctgaggccaggagttccagatcagcctggccaacatggtgaaaccccatttctactaaaaatataaaaattacctgggcatggtggcacatgcctgtaatcccagctgctcaggaggctgaggcaagagaatcacttgaacctgcgaggtggagattgtagtgagccgagatcgcaccactgcactccagcctgggtaacagagcatggtgctgtctccagaaaagaagagagagggaggctgaaggtggagggtggcagagacaggagcctcggggaggggtgctgaggtccgggtagggtatcttcaaggggtgggggtggcagattgggatgagtatctggggtagatctgggaactgcctgcttgggcaggaataaggggacacacagccgaggggtgggagggggcgaggagagccggtgggcaaattccaggcatggaattctaagatggcatcatccgagagggaggaaaacaacagggtgagggcagcagccgtggagctccagggtccccaggtatgtatccacttaacaaattttttttttttaagagacaacaggattccactctgttgcccaggctggagtgcagtggcatgatcatagctcactgcagcctcaaactcttgggttcaaatgatccccctgcctcagcctcctgaatagctgagactacaggcacccatgccactatacccagctaattttttttttttgaaacagagtttcgctcttgttgcccaggctggagtgcagaagcacagtcttagctcattgcaacctccacctcccgggttcaagcgatttttctgcctcagcctcctgagtagctggagttacaggtatgtgccaccacacctggctaatttttttgtatttttagtagagacgggatttcaccatgttggtcaggctggtctcaaactcctgacctcaggtgatccatccgccttggcctcccagagtgctgggattacaggcataagccactgtgcccagccctcacccagctaattttaaaatatatattttttatagagatagggtcttactatgttgcccaggcttgtctcgaactcctggcctcaagccatacttgagcctcagcctctcaaagtgttgggatgacaggtgcaagccaccgtgtccggcctccaggcatccatctgaacctacatgggcctgcagtcctgcctgggtctcagaggagctgggggcagtgggttgagacagtagcaaactgtggacctcagagcctgctcctatcctgcagggtggctcaggcagctggagttctctgtgaaatcaagtcaccacctttttttgcgggagatgaagtctcgctctgtcacccaggctagagtacaatggcacgatctaggctcacggcaacctccgcctcctgggttcaagtgattctcctgcctcagcctcccaagtcgctgggaatacaggcgcccgccaccatgcccagctaatttttgtatttttagtagagatggggttttaccacgttggccaggctggtctcgaactcctggcctcaagtgatcctcccgcctcggcctcccaaagtgctgggattacaggcatgagccacggctcccggcctcaagtcaccatcttgatacccatccacccagtgaagcaagaagccacagagagcccctgcagagcacacgtcttccatcagccctctgggttggatgggttggcacagagaagggcccccagtggggaggcagaggctacctatcgtccctttaaggaccggaggtgtttgtgtaactggaggcaaagcacttcctctcagatgacggtccaggaccgcccctcctctgggatacacacagatggagtccatccctctctcagcagtggctctgagtaccagcctgtcccttccccatctcaagatctcctcggaggctccccatggctcctgacctggcattcgaggcctttgtgacctggccgaacgcactgccctgtcctggcctccctgtctgccctcccgcagccaccctgactccgaggttctcagcctagggtctccacgggtggattcccagagtctgcttcaattttaggaatgttgctccgatgccattcccggatgccaggcctttgcctgggccgctccctctaaatcactgttcagcattccgttatctgatgcctggcatggttaaaccttcaagtgggcagcttgcctgtggctgcctccaggaagtcttgaagactcccagcctgggtcaagagcctctccttggtcatgcacagtggctcatacctgtaatcccagtgctttgggaggccaaggtgggcagatcacctgaggtcaggagttcaagaccagcctggccaatatggtgaaacctcatctctactaaaaatacaaaaattagctgggtatggtggcacgtgcctgtaatcccagttacttgggaggctgaggcagtagaatcgcttgaacccgggaggcaaaggttgcagtgagccaagattgcaccactgcactccaacctgggcgacagagtgagactctgtctcaaaataaaagcaaaaacaaaaagaaggccaaatgtagatcccagcactttgggaggatgaggcgggcagatcacttgagatcaggagttcgagaccagtctggccagcatggcaaaaccccgtctctacaaaagaatacaaaaattagccaggtgcggtggctcacgcctgtaatcccaacactttgggaggccgaggcgggcggatcacgaggtcaggagatcgagaccatcctggctaacagggtgaaaccccgtctctactaaaaatacaaaaaaaatagccaggcgtggtggtgggcacctgtagtcccagctactggggaggctgaggcaggagaatgacatgaacccgggaggcggagcttgcagtgagccgagatggagtcactgcactccagcctgggtgaaagagcgagactccatctcaaaaaaaaaaaaaaaaacattagccaggtgtggtagtggacacctgtaatcccagctactcaggaagctgatgcaggaggatcgcttgaactcgggaggcggagattgcagtgaaccgagattgcgccactgcactccagcctgagcgacagagcgagactctgtctcaaaaaaaaattaaaaaacgagcctctccttgccttcagtgtctctgattgttttccttgtaccctggttaatctgccttgtaactgcccaaagacacgtctgtctccccactgaatgaggggtctctgggagggcagtaaacaagtccaattcctgtctcagcccatcactcactcccactcaggccccagccctaatgtcgccttttcagaggggtcctgactgcccaaaataaagtaacgtctccttgctcttcatcacatttctggaaaattctaggagtgggtgggaaagtcataaatgtcctgtctcagagtctgaccctctggaggcctcagattggcccccagctccttccagactccagcaaggtccccgggaagctgacatgtgttaagtgccaggtccctctgtcatctgtactttgcaactggggaaagtgaggcatggagtcatccaaagtcataaagtagggagtagagtctgggacttggacccaagcctgcctgtctccagaacctgcctgttacctgccacccgaggtacgctacccccaacgccatccgccccccaagtccaacctctcaggctgcagccataaggacccaggatggctgacatcacttcacatttatcgggtgcccactgcataccaactacacactgggatcccagcagagaacagagtagacaagaaatttcactccatggagccaatattctggacatggtggagatgagggagtggcaaagactctatatcttaattttttttcagaaatggggtcttgctatgttgcccaggctggtcttgaactcctgggctcaagtgatctgcccaacttgcctctcaaagtgctgggattacaggcatgagccacctgatctggccctgcattttgataatttgtttgttttgttattgtcaggtggagagaaaaataaggcaggaaaaggaatgaggagtcaggcagtgggggctgtaattttctttttttttttttttccaagacaaaatctctctctgtcgcccaggctggaatgcagtgccaccatctcagctcactgcaacctccatctcccaggttcaagtgattctcctgcctcagcctcccaagcagctgggattacaggcgcccaccaccacgcctggctaatctttgcatttttagtagagacggggtttcaccttgttggccaggctggtcttgaactcctggcctcaggtgatctgcccacctcaggctcccaaagtgctgggattacaggtgtgagccacggtgcctggcagggctacaattttaaagagggaggtcaggaagccctccctgagaaggtagggaggtgagggaggaaaccctgatgatagaacattctagaaagggggaagagccagtgcaaaggccctgaggcagggccaggcatcctggactcgaggcacagagaggtggcttatgcctgccctcaccaacatcccagatggagaaacaaaacccagaggaccacctccctcccgtcctgttaccgtctgggtgccatcaccctaaaaagcccagcccctattcccctgtccctgctgtggctcatcacacctgccagatcacagaggagtgccagggacaagggatgccccctcccagtttggacggggatggaggggacagtccgggtcacagtgccgtggctcaacagaacctcagatctaggctccagcatccaagtgtctaaattccctcccagtgaagcccaggttcgtggtgggagtggggagggtgcccaggctcttgtggggtacagggagaggggaccgagttctctctcttttgcctgggaagggagcgactgcaggctagaggctggcccatcccccagacacacccgctgcttgttttttgtttttttttttttgagacagagtcttgctctgttgcacaggctggagtgcagtggtgtgatctctgctcactgcaacctccgcccccctggttcaagcaattctcctgcctcagcctcctgagtagctgggactacaggcacacaccgctgcacctggctaatttttgtatttttagtagagacagggtttcgccatgttggccacgctggtctcgaactcttgacctcaggcgatccacccacatcggcctcccaaagtgctgggatcacaggtgtgagccaccgcgcctggccctgctgcttggcttttgctgtttgtcctctaggcccctgatcgaggctaccatccctgcatccctagggctcccccatcacctatctgagaacgtcctggctcctccatccagctctggctgcttgcccactggctgctgccgttgcttcttcctcctcgtcctccccctcctcttcctttttctcctcctcctcctccctctcctccccctcctcttcctttttctcctcctccccctcctccctctcctccccctcgtcttcctccctttcctcttcctcctcccctcccacctcctccccactgcccttcatctcctctgcttccatacgctcatcagtacccttccctggctacttccctctcccagttcagctgagccccattgtgtggaggggaggaggagaagtcttggccactgcgtagtcctcctctccttcctcctgccagcttcctcagccttcaaggttcgagcaccccagcacaggtgaccactgcacatacaggacgacaaagtaaccgtgcaaaagcagtagggtcccataacctttcactcctcaagtccccttgagcaaggactctccagggtatgctgtggttggactgggggttcccaaggaccttcagtctcttcatctactcctctctctactctatgactccttgcttagtttgctccagccaccccagcctcattgcattcctccaacacaccatgcctgttccagcctcagggcctttgcacctgctgggccttctgcccggagcactcttcctccagatgtctagctgctccttcaagcctcatccttgtccccatcaccttctccctgcggggacatcagctccgtaaggcttcctgtggctgtctgtccccagtgcctcccactgcagacacttcctaagtctgtgctgaatgaacaaatgacagacagacagacagacaggggtgggaggaaagtggggccaggcacagggcagaaggggtccccagggcatagctgataggaaatgatcactcttcagacacagtgtcatgggaccctggattaaaatctgtctctgggagtccaggagggggtagggagggaaagctgagctgagctccaggcggttcagtgtgtgtgtgtgtgacagcatcctattaacaaaggtataaagtccagactcagggaggggaaggtctcttctatgctactctgttttttgtttgtttgtttttgagacagtgtcttgctctgtcacccaggctggagtgcagtagtgcagtagtgcgatcttggctcactgcaacctctgcctcctgggttcaagcaattctcctgtctcaacctcccaagtagctgggattacaggagcatgccaccacacagggttaatttttatatttttagtagagacggggtttcactatattggccaggctggtctcgaactcctgacctcaggtgatctgcccgcctcggcctctcaaagtgctgggattacaggcgtgagccaccgcgccgggcctctctatgctactctggtcagagccatgatgggtctgaggggcctattcaaggatggcaaagaaaagcctgcgcttggccaggcacagtggctcatgcctataatcctagtgctttgggaggttgaggctggaggctcgcttgaggccaggagttcaagaccagcccgggcaacatagtaagacccctgtccatgtgtataaaatttttttttaaggattagctaggcctggtggtgcatgcctgtggtcccagctctcaggaggctgaggttgagctcaggaggtcgaggctgcagtgagttatgatcatgccactgcactccaacctgagcgacagagcaagattctgcctttgaaagaaagaaagaggccgagtgcagtggctcatgcctgtaatcccagtactttaggaggctgaggcgtttgagctcaatagtttcagaccagcctgggcaactggcaaaactctacaaaatcactacaaaaaaatgcaaaaattagccaggtgtggtggcttatgcctgtagtcccaggctgattgcttaaacttgggaggtggaggttgcagtgggcgaagatcgcaccactgcaccccagcctgggcaacagagccagaacttgtcttgaaaaaacaaaacaaaaacaagaaagaaaagcaaagaaaagagcttgtactgaaaggcatggggaacagaacagggttggtaaagagcagccacaaaagaaagtgagacgggctgggcgcagtggctcacacctgtaatcccagcactttgggaggccgaggcaggtgcatcacctgaggtcaggagttcgagaccagcctggccaacatggtgaaacccaccccccttcatctctactaataatataaaaattagccaggtgtggtggttcgcacctgtaatcccagctactcaggaggctgaggcaggagaattgcttgaacccgggaggtggaggttgcagtgggccgagatcgcaccattgcactccagcctgggcgacaagaacgaaactccattccaaaaaataaaaaaaataataattaaaaaaacagtaagatgcctgctactgaattatcaaacaggggtttcaagaccctttcctcctatgacagccccagctcccttggctcccagcttgccacccactcctggttttccttctgccctctttctgctgtctcccaagctcccagcttgctttaaagcccatcctacgccgtaccacctgggtgtctagcagcatggcaatttccagatgctgagaacagattgctgacttacacctaaagcttctcccccatgagcagctgctccctcccccggcctctccatatctctccaagatccacccaagtctcacccgtccacgccttcacctggtccagccccaccattactcccctggcctggtgcagtcccttccatcctggtctccaggctcctgccttcgacccctgcagtctgttccctgagctctaaataatgccaaatgcttgttcaaggctggcaggctggctctgcccttcttcctctcccctcttctggatcttacaaccctggctttgtggttgtttcatccaagcaccctggcagtttctctcctctgcaatttgcccactggtctcttggcctggttaactcctccttacccttagcgacccagccaactgtcacctcctccaggaggccttccctgactcctccttaggctgagtcaggtgactcctctggactccccctgaccccaggcatgactctgaatttttttttttttttttttttttggagatagtctcactttgttgcccaggctggagtgcagtggcgcgatctcggctcactgcaaattctgcctcccaggttcaagagattctcctgcctcagtctcccatgcagctgagattacaggtacatgccaccacgcccggctaatttttgtatttctagtagagatggggtttcaccatgttggccaggctgctctcgaactcctgaccttaggtgatctgcctgcctcagcttcccaaagtgctgggattacaggcgtgagccaccacgcccagcccctccgtgatattttaatagcctccagctctgtgatattctcgtgatattttaatagcctgtttagcacgtattcacaaccagccaggcactgtgttcagctctttacctataggtcatgactgctattatcccattttacaggtggagaaactgaagcaggaagtggtgaagtcagtagcccggaggccctcaactcaaagtggcaggacagggctggggggtggtcaggctcaagcccagccagtcggaaagggagaagcttgtggtgctcagagaaggggacagggcagcgagctcccaaggcacctgcctttctgtgccatcccacgggtgggaggagggaacctgggcccacttctgctgccaactacaggcatcccagtggctcctgagccaagacattctgtgccacgcactgggtcaaccgctttattcaacctgcagacagccctgggtcaggaggtggacactgttgtgaatttctcagaggagaaatggaagcccatacatccccctgaactcccaccgggcgttagaaccctctccggttccttaggggtgtggctgccaccgagatctgcctagcctcggctttcatcgatccatgaacactcccaggctcagatactactgacccattttacagatgggtaaactgaagctcagaaacctttccctgggggccctacagccagttcaacgaccaaggccgccccccaccccccacaccccaggctcaaagtacctctgctggcagtgggtgagctggaaaaacaggtaaggaaagtcctcaatgcctcttcctccacgcctggctgggcctgctggggcccaggtgcactgaatgaggcttctaatcagtcccccagctccacttctgtgtttattcacagcagctgctcctggaaggcagacccatttgaggctgggggaggccgagggcttcaaagacaattccacagtccaggaaccctatccccatataacagacccaggtcgccccagtggggtcaccctggcctctgcgctcagatgcctgagaccttgcctgagctcagactggagtcgatgggagcattcccccatctggtaggttttgcaaaccacaacagcctctccccctgcccaccttcctgtgtcccccagagcagcttctcctcaagtctcccaacccagcaatgaaagcctcttctatatactcctaactacccaggagaaacatcggtcccccacgctccacttgcaaacagacagaattagacgatgttactctgccaaagcgaattttcagttcacccacttcctatcacaccttccagccaggtcaagccagaagcccccttccaagtatccccatctctcctacccacagcggctacgggatgttcttaagacacaatccgatcacgccatgcacctgctgttccaagcctccctggtccccaccgccccgagaacgggttccacactctcctcgccgcttcccaggccccggccaacctctctccacctcagaccctccctctccgcgtttcagccaggctggcctcttttctgctccgcacacactcccggctaggccctgggcctaaaaagccctcgctggctggtccaaccaggccaaatgacattatccccgcctgggcacctccacctcaccccggccgcctgatgggttagctcgggcttggaatgacgtgtttaagcggttctcagaagccgtctacgcggccgggctgcggactccgaggccagggccccagctgcgtccccagccctggcacgtcggggaaacggggcgctcccccggctcacacatccggattcccccgcgtcacgaggccaggatcgcccctactcgctccagcccgtttcacagccgcgtcctcgggcacccgttgcgccccggccctcgtgggggagcgcggatagctcggggagacggccatgatgggaagccccgagggggacagtccccggcggggtgatgggggctggagcccagctgcgagtgggggccgggctggggccgccatggccgcggaggcggggccggggaccgccgtgagggtggcgttcggggcggtgttcgcggcgcggggtgctcgcttacctgggggtgcaggcggccgggcgcaccgagggccggcggcggggctggggacggcgcgcctagcgggctacccggagcagctgcagacacgcgccgcccgccccaggcagccggactctgctcctggccgggcctcggcccccagcaggggaaaaaaggcttgagtggggggagcccggggcggggccgtgggggcggggcctgggcggggcacgcgccccggaacggtggggcctggcgcggggctggggccctggagaggcggggcctggcgcggggcgggggacttggaggggcagggcctggagcgggcgccgggtcctccaggcgcttgcccccctcgacgcaactaggcctctccctggcccccgaccccgcacccgcaccccatccccgcccccgtccccgcccccccattctcgcccccgcccccgttcccgctccgcccatctctgccccgcggcgcgcctggcccgggtccagcctagcgtttctagtctgcgccttatctctcccctttgaacccagtattgtccgctgcgcgctccgtccggccccggcttcacccctgttcgctgtctgtctccccggccccctcccaggtcccctcttctgcccgagatgctctggctctgctcatctgtccacacccccacactcccggggcgccctgagcctctggggcgcgcagttggatggtgcacaggggaggcccagatttctccaggcctcagcggccaccctgggtaccccgagtctggggccctgttggagggccagtccaggggttcgcccgaggcgcgcgcgggggccaaccgaggcggtgagggcaccgggcaaaggctgcgatttggtggggtgcaggggtcaggcgacagagctggggagataagatgggagataggccgggtgggtggtggcgcagccctggttttggctgagggcagcagcagtgggggctgggtcccccgcttgcctggtagaaccgaaaatgacccagtctcagcagcgcgcaggggcagggagcctgggcgatccctgaacagaggacagccccaggggttttcatagtcgctggcccaccgcatgtactctgggcaagtggcttcgcctttggacaataagcctctgtaaaatggggataataaacctttctctgactcagctcagcagacccaagacccatggggtgaagttggggcctccctgccacagggccctaggcaagctgagatttgatttcctcacacagacaggggcgcggggggcggggcggtcagggaggcaggagacctctgttgcaagtgtggaagaacctgtccctccaagttcagactcctggcgtttgcacttggccttccctctgctacactgtttctcttttcttttttctttttctttttttttttttgagacggagtcttgcattgtggcccgggctggactgcaatggcatgatctcggctcactgcaacttctgcatcctggtttcattcgattctcctgcctcagcctcccgagtagctaggattacaggcgcccacaacacccggctaatttatatatatatatatttttttttttggagagacgggggtttcacaatgttggccagactgatctcaaactcctgacctcgtgatccaccagccttggcttcccaaagtgctgggattacaggcgtgagccagcatgcccgaccttctcttttctttttttaaaaaaatctgttagaggctgggtgcggtggctcacacctgtaatcccagcactttgggaggctgaggcgggtggatcacctgaggtcaggagtttgagaccagcctggccaacgtggcaaaatcccatctctactaaaaacacaaaaattagcctggagtagaattacgtgaacccaggaggcagaggttgcagtgcgtggagatcgtgccactgcactccagcctggacaacagagtgagactctatcaaaaaaaatttcgttaaagatgggagtctcactctgttgcccaggctagaatggaatgtcatgatcccagctcattgcagcctgggactccagggctcaagcagtcctctcacctcagcctccagaggagctaggactatagatgcctgccaccatgcccggctaatttttttttgttttaaataaaaaaactttggtaggcagggtgtggtggctcatgcctgtaatcccagcactttgggaggccgaggcaggtggatcacgtgaggtcaggagttcgagaccagcctggccaatatggcgaaaccccttctctactaaaaataccaaagttagctgggcatggtgttgcgcacctgtaatcccagctactcgagagtctgaggcaggagaatcacttgaacccaggaggcggaggttgcagtgagtcaaaatcgtgccgctgcactccagcctgggtgacagagcaagactctgtctcaattaaaaaaaacaaaaaaaaaaactttggtagaggtggggtcttgctatgttgcccaggctggtctggaacgcttaggctcaagtgatccttccgcctccgctttccaaggtgctgggattacaggcaagagccactgtgccccagcctctttcccttttcaaatgcatacatacttctccctgagcctcagtcccctcctccttcctccattgcctgctttaccccacccccaccatattcacctgtttattttctcctctccttccctccaagagcttgtttgcacacctggaaaagaaagataataaagcaactcttctcagttgttgtgactagggagttattgaatatcacatgtcgcatactccagggtgctcagagcatggcatttgtttgtattaataataatatatgaccgggcttggtcgctcacacctgtaatcctagcactttggaaggctgaggtgagtggattgctggagctcaggagtttgagacaagcctcggtaacatggcaagagccccatctctaccaaaaatacaaaaattagccaagcgtggtggtgtgctcctatagtcccagctactcagaaggctgaagtgggaggatcacttgagcccagaagtcaaggctgaggtgaactatgatcatgccactgaactccagcctgggcaacagagtgagatcctgtctcaattaaaaaaaaaaaaaagagacaccagcctgggcaacatagtgagaccccggtatctacaaacaataacgataatataatacaggatacatggtggaatggtggagtccacgccccagtggagaagccccaggactccggagaagtggagtaggggagctcaaaagaggacctgggcaggccagggctggagagagatttcaggtggaaggtaccacatggggcaaaggttgggaagctggaggaagacacctggggtcagccaggcaggaagggacccaggctgcaccttctgcagttgggcagcttctcgcctgtcctcaccttccaccccgatccctgaccatggagctcaggccggaccccaagcttgagagtgagtgggtgttcaaggcaggcttcctggaagaggtgacatctgagccctgagaaatgagcgggtgggggaactatactgagaggaagtttcctgggaggacagcagggctggcccagccacaataagccctcctgggttctctccagggagaggcaccaatggacttactgatttattttgagatggagtctcactctgtcatccaggctggagtgcagtggcacgatctcagctcactgcaacctctgcctcctaggttcaagtgattctcctgccttggcctcccgagtagctgggattacaggcgcacaccaccacgcccggctaatttttgtattttttgtagagacggggtttcaccatgttggagaggctggtcttgaactcctgacctcgagtgatccctcaagggattatgggcatgagtcaatgcacctggccaacaattggacttaaaattaggaaagaacagagtgggaggctgggaaggtgtcactctaccgtgggcagctggatgggaggacctggggcctggttcgggggtgatgaataggagaagagggagggattccagggggctttagaggtaaaattaccagaactcaggcgatgaggggaggctagtggtggcagtgagggccacctcctctgctcgcctttctccaagggtcccccctgctccatgcctaaatatcctcatctacccgaataggtacttggcacctgatctctcccacctgccacctgtcccctgcccagcttcccagggcacttggcaacccagcatgagtccagcaagcaggctaaccggttctcattgatgatgtctcctgccaagccaggccctgcacccacctgaggttcctagtggttgagtggaatcacagccctagaaccctgggtgaggagagggcagtggcaaaccttgtcctggagcagtgacaacctggtcagtgccagggcctgtgcaaagtgatgtaaaaagatggatatgaccggccctctctgtgaagcaggtgcacttaaacttcccattttaggccagctgtgatggctcaagccttgtagtcccagcactttgggaggccaaggtgggaagatcgcttgagcccaagaggtttttcatttttttcttttttgaaacggagtctcacttggttacccaggctggagtgcaacctctgcctcctgggttcaagcgattctactgcctcaggagcagctgggatcacaggggtgcaccaccatgcctggctaatttttgtatttttagtagagatggggtttcaccatgttggccaggctggtctcaaactcctgacctcaggtagtccgcccgcctcccaaagttctgggattacaggcatgagccaccacgcccagcctaaagaattttaagaattagctggcatgtacctgtagtcctagctacttggaaggctgagtcaggaggattacttgagtccaggaggtcgaggctgcagtgagccatgattgcgccactgcactccagcccgggtaatagagcgagaccctgtctcaaagaaaaaaaaaaaaagaaaaatcccattttagagatgagcccagagtggtgcaggaagctacacaaagccacacagccacaaggtggatgaactgggaggaggtgcttttaacctagctctgcctgccattatctccattcagcaaagaagaaaaaccttggccgggcacggtgactcatgcctgtaatcccagctacccaggaggctgaggcaggagaatcgcttgaacccaggaggcggaggttgcagtgagatcgcaccactgccctccagcctgggtgacaaagtgagactccatctcaaaaaaaaaaaaaaaaaaaaggacaaaaccacaaaaacaaaacctggagccagctgcattgtcaccagctatcccacgttctggggactgaggaatttcctgcaacacagaatgtcaagcctccgagtccaagcctgcacgtgtatttctagatggcctgaagcaactgaagaatcacaaaagaagtgaaaatgcctggttcctgccttaactgatgacattaccttgtgaaattccttctcctggctcagaagctcccccactgagcaccttgtgacctccgcccctgcctaccagagaacaaacccctttgactgtagttttccactacctacccaaatcctataaaacagcctcaccccatcttccttcgctgactccttttttggactcagcccgcctgcacccaggtgattgaaaagctttactgctcacacaaagcctgtttggcggtctcttcacatggatgcgcatgacatggaatttttagggctaatgtcaggacagtcccaagcaaaccatgacgcttggtcaccctaccaatgtaatgcccaaccttgtttttactaaccctgtttttagactctccctttcctttaatcacctagccttgtttccacctgaattgactctcccttagctaagagagccagacagactccatcttggctctttcactagcagcctcttcctcaaagacttaacttgtgcaagctgactcccagcacatccaagaatgcaattaatcgataagatactggggcgagcaatatctgcagttcccaggaattcgtctgattgataacgcccaaagccccgcgtctatcaccttgcaatagtcttaaagcccctgcacctagaactgtttactttcctataaccatttatccttttagcttttttgcctactttacttctgtaaaattgttttaactagaccccccctcccctttctaaaccaaagtataaaagaaaatctagtcccttcttcaaggccaagaaaactttaaacgttagccgtctcttggccgccagctaaataaacggactcttaattcgtctcaaagtgtggcgttttctctaactcgctcaagtacaacaccaagaggtgagatgacttgcccaaggtcacacagctaccacaagcgcccctgtgccagcactcgcctatttaagacaccatcccctctcctagactcgatggggaggactttagggtaaccctggaagcagttgggtttttttctctttgtgtcaaaatatcctttctaaaaaacatttcaatagtttttggggtacaggtggtttttggctacatggccaaataaccactaaagaattgattagtggtgatttctgagactttggtgcacccgtcacctgagcagtatacactgtacccgatatgtgtgtgtgtgtgttttgagatggggtttcactcttgttgcccaggctggagtacagtggcgccatctctgctcactgcaacctccgcctccggggctcaagtgattctcctacctcagcctcctgagtagctgggattacaggcaagcgccaccacacctggctaattttttttgtatttttagtagagacggggtttctccatgttggtcaggctggtgttgaactcccaacctcaggtgatccacccgcctcggcctcccaaagtgttgggattacaggcaggagcaaccgcgcctggccgatatatggtcttttatccctcacctccctccccaccctttccctctgaattcctgttttctttctttccttctttttgtccttccttcctgccttccttccctctctatctccctctttcttgcttgctttttttttttttttgagacggagtctcactctgtcgccaggctggagtgcagtggcgtgatctcggctcactgcaagctctgcctcccaggttcacgccattctcctgcctcagcctcccgagtagctgggactacaggcgtccaccaccacgcccagctaattgtttgtatttttagtagagacggagtttcactgtgttagccaggatggtctcgatctcctgaccttgtgatccacccacctccgcctcccaaagtgctgggattactggtgtgagccgccgcgcccggcctctttttttgagacaggatctccctctgtcacccaggctggagggcagtggcacaatcatagctcacagaagcctccacaactcctgggctcaagtgatcctcctgcctcagcctctagaatagctgggactacaggcatgcaccactacacctagctcatttatgtatttatttattttctgtagagatgggggtctccttcctgcctttttctttcttgggaaactgagtgttttactttgtgttgcttggtaacagctttagagatataattttcataccatccagtttgcctatttcaagttttcaagtcgaaggtttttgatccattcacagagttcagcagttctcaccatcttgttcttcttttatttgacaaatattaattgtatatacttaccaggtacagtgtgatcttttgatatatgcatactttgggaaccactttgctctttttctgtttcgttttgtttttctttttcttttctttcagagatagggtctcattctttcgcccaggctggagtgcagtggtgtgatcatagctcactgcagcctcgacctcctgggctcaagtgatcctcccacctcagcctcctgggtagctgggactacagtgtgcactatcatggccagctaattttttaaagttttgtagagatggggtctcactgtgttgcccaggctggtctcaaacctgtggcctcaagtgagcctcccactttggcctcccaaagtgctgtgattacaggtgggaggcagtgcacctgtccccatattgttctttttagcggctacataggatgccacggttgagccagactttgcttatcagtttcctattgatggactaggcgattttcgttgtttgttgttgttgtttggttgcatttttggagacagagtcttgctcttgtcacccaggctggagtgcagtggcacgatctcggctcactgcaacctctgcctccccagttcaagtaattctcccgactcagcctccccagtaggtgggatcataggtgcctgccaccaagcccggctaattattgtggttttagtagagacggggttttgccatgttggtcaggctggtctcgaactcctgacctcagatggtctgtccgcctcagcctcccaaaatgctgggattacagacctgagccaccacgcctggtctaggcggttgtttttgatccaagcaacgatgaattgaataacctgccgtagaggtcatatgtcaacccagcatgaagagatctcatcagtaaattcctagaagtggaattacttgtcaaagggtgtgagcaggtgtatcgtggataactattgccaaaggtttctccacaaaggactcatcctccacatgttatcaaacattctaatctttgctaactgagaggtttaaaagtatgtagttctcatttgcatttttattttttattttatttatttatttatttttttgagacgaagtctctctcttgtcccccaggctggggtgcaatggcgtgatctcggctcgctgcaacctccacctgcctggttcaagcgattctcctgcctcagcctcccaagtagctggcaccacaggcgcctgccaccatgcccggataatttttatatttttagtagagacggggtttcaccatgttggccaggatggtcttgaactcctgacctcaggtgatctgcccacctcggtcttccaaactgctgggattacaggcatgagccaccgcgcctggcctgcatttttattatttcgagtgaggttgaacatctctgtgtttaaaaactggatctcagagccaggcacggtggctcatgcctgtaattccagcactttgggaggtcaaggccagaggatggcttaaggtcaggagtttgagatgagcctgggaaatagttaggttctgtctttcttttttttggagacggagtctcgcactctcgtccaggctgctggagagcagtggcgcgatctcagctcactgcaagctccgcctcccaggttcacgccattctcctgcctcagcgtcccgagtagctgggactacaggcgcctgccaccacacccagctacttttttgtattttttttttttagtagagacggggtttcaccgtgttagccaagatggtctcgatctcctgaccttgtgatccacctgcctcagcctcccaaagcgctgggattacaggtgtgagccactgtgcccagcctggttctgtctttctatatacacatttgtaagtggatcttgtccagacgtggtggctcatgcctgtagtctcagctactcaggaggctcagggaggacgatcacttgagtcaggagtttgcagctgcagtgagctatgattgcaccagtgccctctagactgggcaacagagcaagacactgtctctaaagtaaaacttttttttttttttgagatggagtcttgctctgtcacccaggctggagtgcaatggtgtgatctcagtttactgcaacctccacctgccgggttcaagagattctcctgcctcagcctcccaagtagctgggattacgggtgcccgccaccatgcttagctaattttttctatttttagtagagacagggatttaccatgttggccaggctagtctcgaactcctgacctcgggtgattcacccgcctcagcctcccatgagccaccatgtctggcctttaaaataaaacatttttaaacgtggacctctagtctttccctggaaacgttttttttttgtttgtttgtttgtttttctgcaggcgacagcctttttgttattgatttatagagcctctttacttttactgtggtaaaatatatatagaagctctttttagtattaaagaaattacttcttattctgtgagcttcaatcttcttcctccattttttttttttgttgttgttgttttttgagatggagtcttgctctgtcacccaggctggagtgcagtggtgtgatcttggctcattgcagcctctgcctcctggattcaagagattctcctgcttcagcctcccgagtagctgagattataggcgtgcaccaccatgcccagctaatttttgcatttttagtagagacagagttcaccattttggtcagggtggtttcgaactcctgacctcaggtgatccacctgcctcagcctcccaaagtgctgggattacaggcttgggccaccatgcccagccctttggtgacttttatgtttattttattcttagaaaggcctttcctgtgcattcagttgtacatcagcccccgacctaccccaaaaaaagcctttgcggctaagccccatggctcatacctgtaatcccagcactctgggaggctgtgggagcattgcttgagaccaggagttcaatgctggagtgagctgtgagctgtgattgtaccactgcactccagcctgggtgacagagtgagactcttgtctgaagaaaaataaaaattaaaaataatttgaggccgggtgcggtggctcatgcctgtaatcccagcactttgggaagctgaggcgggtggatcacgagttcaggagatcgagaccatccttgctaacatgttgaaaccccatttctactaaaaatacaaaaaaattagccaggtgtggtggcaggcgcgcctgtagtcccagctacttgggaggctgaggcaggagaatggcgtgaacccaggaggtggagcttacagtgagccaagatcgcgccactggactccagcctgggcgacagagcgagactctgtctcaaaataataataataataataataataataataataataataatttgagtgtatttcagtgtggggaagggctttttttttttttttttttttttgagacagagtcttgctctgtcatccaggctggagtgcagtggcgcgatctcggctcactgcaagctccacctcctgggttcaagggattctcctggctcagcctcctgagtagctacgattacaggcacgagccaccatgcccggctcatttttttttgtatttttagtagagacaggtttcgccatgttggccaggctggtctcgaactcctgatcttgtgatccgcccaccttcacctcccaaagtgctgggattacaggcatgagccactgcacctggccggctttttgtttcttttctttctgttgttttgtttttcagagatagtgtcttgctctgtggcccaggctggagtgcaatggtgagatcatagcttactgcagccaggacctcctgggttcaaataatcctcccgcctcagcctcctgagtagatgggacacaggcataagccaccacgtcaggccatgcatgaccttcttagaaggccagcaatcattggatcatatcacactttaatccaggataacctcatcttaacttggttacaactgcaaagactctgtttctaaataaggttaaattcacacgtgcccagctttaacaaatctccttggaggacacaattcaaaccacactacctacaagcatttttttttttttttttgagacagagtctcgctctgtcgcccagactggagtgcagtggtttgatctcggctcactgcaagctccgcctcccggattcacgccattctcctgcctcagtctcccgagtagctgggactgcaggcgcccgccaccacgcctggctaattttttgtatttttactagagacgggttttcaccatgttagccaggatggtctcgatctcctgacctcgtgattcacccgtctcggcctcccaaagtgctgggattacaggcatgagccactgcgcctggctgcatttttttttaaatgtgttcatttttccaaaaattgactctctagaatcatgctggaaagttaaatgtaaactattgcatacaaatttgcagaggaaaaaaatgccttcccttcaaaaaaaaaacctttcaatgaattatttctttttttggttttgagagttagcttgtaatctccattatagcccgcatcttgttaactacagcatggaatggattcattgtcatattggtactttccagaagatacagttctttcccatcaatgctttttgcctctgttctggggttttcgtgcgtgtttaattagagggggcttcttttctgggatcagtgagccaaagctaatgaacaggctccttggtcaatccaggtcagtactgggggcgtttgatggggaggtgtgggtgagaacaggatgttcgaggcatgagtaggatcccaaagaggaagtgtccctcagctgagggggtgggtgagtgtgaagaggagctgtggaggagagaaggggctccactgaaacaaaagttgggccggtgtagtgtggctcatgcctgtaattcccatgctttgggaagccaatgtgggaggattgcttaagggcaggagtttgagaccagcctgggcaacatagagaccccatctctacaaaaacaaacaaacaaaaccagacctggcggcacgtgctttcggccccagctacttgggaggctgaagtgggaggatcgattgagcacagttctaggatgcagtgggctatgatggtaccactgcattccagcatgggtgaccctgtctcaaaaaaacaacaaggccaggtgcagtggctcatgcctgtaatcccaacactttgggaggccgaggcaggcagatcacttgaggtcaggagttcgagactagcctggccaacatggtgaaacctcctctctactaaaaatacaaaaattagccaggcatggtggagggttcctgtaatcccagctactcgggaggctgaggcaagagaattggttgaacctgggaggtggagactgcagtgagccgagatcgcaccactgcagtccagcctgggcaacaagagcaaaactccatctcaaaaaaataaaaataaaaattaagccaggcgtggtggctcatgcctataatcccagcactttgggaggctgaggcgggtggatcacgaggtcaggagatcgagaccatcctagctaacacggtgacaccccgtctctaggaaaaatacaaaaaattagccaggcgtggtggtgggcacctgtagtcccagctactccggaggctaaggcaggagaatggtgtgaacccgggaggcggagcttgcagtgagccaagatcgcgccactgcactccagcctgggtgacagagcgagaatccgtctcaaaaaaaaaaaaaatagagtgaccagggctgcagggtgggaggtgagtggagagaacggagcaaaacagagtccggttccgagatgagggtgtctggagtctgggggacccagggaagggaggagggggaggcagaggatgggaaggtctaccccccaggcctggactatgctgggcaggcgggcctggctcggtgcccatctctgggcagggagcacagggtgaaagcagatctggagggaagatgtggcattggatgttagaaggtgcagatctccagggggctgtgggaggtgcacatagaggaagctcagagtgtgtgtctgggctggagacaggatgtccttggtgtctgctcagaagggaggtgcacggtagttgaaggccccttgggtaaagacaggaggaagtatggggagaagctagtcccagctgcaaggcagacacctggttggggtgtgtttcatctctcatgccactgtactccagcctgggcgatagagtgagactctgtcacaaaaaaaaaaaaaaaaaaaaaaaagacagggtctcactctgttgcccaggctggagtacagtggcataatcatagctcactgcaacctccagctctcaggctcaagccatcttcagcctcccaagtagctgggactacaggttcatgccacattttaaattttgttagagatggggtcccactaagttgctcaggctgcagacactatttgaaatgaactcatctgatcctgcaacagccttgtgaggtgggtcctcttaattcctctttgacaggtgaggaaaccgaagcccagagaggttaggacactggcccaaagtcacacagcctgtgagccgctggaaccagaacctaggagctgtgtttctgctttcgtgcagacagatgcattttcctttaatacttcactttttagatgcagaagggcaggatcagggaggtggagcgacttgcccaaggtctggcagtgagttagtggccttccaagcctgtgtgtctgagcaaggctatgggctctagttgagaacgggcaaaaacagcggtcttgaaggaagcctgcctgatatccgtgtcagtgaggatgtgggctgccgggctgggcggtggaggagggtggctggagataggctggggcatgtcaagtctgaacatttagagtatgaactagacataagacagccctgactgggcacggtggctcatgcctgtaatcttagcactttgggaggctgaggtgggcagattgcctgagttcaggagttcgataccagcctgggcaacacggtgaaaccctatctctactaaaatacaaaaaattagccgggcgtggcggcgtgtgcctgtaatcccagctactcgggaggttaaggcaggataattgcttgaacccgggaagcagaggttgcagtgagccgagatggtgccactgcactccagcctgggtgacagagcgagactccatctcaaaaaaaataaaaaaataaaaaaataaaaaataaaagaaatagccctaaccccacccccttgtgacatccccaactaggctggacttcccccatgtctgcaacaggctggggcatcctccggaaatgagtgcgggagggaggccagggctgggccagcagagttgggggaggggatgggagtgcagggctggggacacaggaagaggctgcaggaaaagaggggcagtgtccaagctcagggtctcgggacctttggggtttctgccttgtccccctgcaactctggaggagcaagaggcctggggtttctcagttctttccagcccaggagtcccctggggtggctcagggagtggggacttccctggaggaaaggaccatggagtgagcatctaaacttttgcatttgactcagagctttgtctcttattttgtaaaaccccagtgtatgtgtgatatgtgtgcactgactacaaaaaaaaaaaaaagaaaaaagaaagaaaagaaacctaggccaggcacggaggctcgtgcctgtaatcccagcactttgggaggccaaggtgggcggatcacctgaggtcaggagtttgagactagcctggccaacatgagaaaaccccatctctaccaaaaatacaaaaattagctgggcttggtggcgggtgcctgtaatcccagctactcaggatgctgaggcaggagaatcgcttgaacctgggaggcagagactgcagtgagctgagatcatgccactgcactccagcctgggcaacagagcgagactcagtcttaaaaaaaaaaaaaaaaaaacgaaaaacccaaaaaacctactatccccatatataaccaatttgtgctgtgcaccaacaagaacctgctttaaatttccattgcaatttacaacccccatattataccaggcaaggttagtggctgttgaaaataccaccaggacagggctatctaaagacacattcagtagtgcattaactgtacaaaaaaaaaaaaagacactgtgtagtttcaaaacaaatcttacacagccttacatttcaattttttcttttctttcttttttttttttttgagactgggtctcacactgtcgcccaggctagtgtacagtggcgtgatctcagcttgctgcaacctccgcctcacaggttcaagcgattctcctgcctcaggctcacgagtagctgggactacaggcacaagccaccacgcccggctaatttttgtattattagtagagatggggtttcactatgttggccaggctggtcttgaactcctcaccttgtgattcacccacctcggcctcccaaagtgctgggagtacaggcatgagccactgtgcccggcctcagtttttttctttaaaaagagtgaattgtgtacaagggggttaaatgcttaatggaaaagaaaaatgaaagaaagaaagaagaaaaagaaagaaagaaagaacgaaggaaaaaggaaggaaggaaggaactgctagaaccaacttattcatcatcgtcttcttaatcttcccagcccaaagcctcctgggcccctagatccgggtaggggtgggagggagggtctgaaggagagggatgcttcccagagcagaggcattcaagctgaatctcaaagaacaagaatgtgccaggggcagtcaggcaattatgcaaagctgactgcaggtgcaaaggcccagaagttggaagctgcaccttcagggcccaaggttaatgatgtgagaagcagcaagagcaggtagagatcaggctgcaagacaaccagagctgaagtagagaaagtccttgggagtctcaataaagactttgatctaatcttgggggtaatagggagccatgggagagtttagagcaggaaggaacatagtcttagttgtgtgccccaggaattcccctggttgctttattttcttttctctttttttgttttttatttgagactcagtctcgctgtgttgcccaggctggagtgctgtggcacgatcgtggctcagggcaaactccaccttctgggttcgagcaattctcctgcctcagcctcccaagtagctgggactgaaggcatgcacaaccatgccaggctaatttttgtattgttactagagatggggtttcactatgttggccaggctggtctcaaactcctgacctcaggtggtcctcccaccttggcctcccaaagtgctgggattacaggtgtgagccactgtgtgggtccttccttcctccctccctcccttccttccttccttccctccctcccctccttctcctcctcctccttctgcttcctcttcctcttcttcttcctcttcctcttcttcttcttcttcctcttcctcttcttcttcttcctcttcctcttcctcttcttctttctctctctctcttctttctttttcttgagacagggtgtatttgtctttgtccagtctggagtgcagtgttaccattgtagctcactgcagcctccagctcccaggctcaagtgatcctcctgcctcagcctcctgagtagctgtgattacaggggcatgccacctcatctaatttttaagtgatcctcctacctgggcttcccaaagtgctgagattataggcaagagccaccatgcctggccattcctggttgttttctatcggaggggctgtaggagagggggcaggtaggagaagtgaagtcacccagtgcagcgtgggtaaggtctaaacaggacagaggggtggaaggaagataggataattttttttttaatttttagaagcttttgtttaaatatagcacacataaggcccagcatggtggctcatgcctgtaatcccagcactttgggaggctgaggtgggtagatcgcttaagcccaggaatttgagatcagcctgggtaacatggcaaaaccccatctctatcataatacaaaaattagccaggcatggtggtgcacacctgtaatcccagctactcgaggggggctgaagtgagaggatcacttgtgcctgggatttgtagtcagtggagattgtgccactgtactccagcctgagtgatagagtgagaccctgtctcaaaaacaaacaaagaagaagaagaaaggaagaaaagtgtagcacacttttagtaaagaaaacaatgcataaattcataaatgtggccaggtgtggtggcttatgcttgtaatcctagtactttgggaggccgaggcaggcagatcacctgaggtcaggagttcaagaccagcctgaccaacatggtgaaaccctgtctctactaaaaatacaaaaattagctgggcatcctgtaatcccagctacttgggaggctgaggcaggagaattgctggaacccaggaggtggaggctgcagtgagccgagatcacacccctgcactccagcctgggcgacagagcaagactccatctcaaaaaaaacaaaaaccaaaacaaacaacaacaacaagaacaaaatcataaatatatgccttaaggaatttttatcatgtgaatgtagggtatagccaggacctagattaggtcaagaacagaacataggccgggagctgtggctcacacctgtaatcccaacactttgggcggccgaggcaggtggatcacaaggtcaagaggttgagaccatcctggccgacatggtgaaaccctgtctctactaaaaatacaaaaaaattagccgggcatggtggtaggcacctgtagtcctagcaacttgggagactgaggcaggagaatcacttgaacctaggaggcagaggttgcagtgagccgagattgtaccactgcactccagcctggctgacagagtgagactctgtctcaaaaaaaaaaaaaaaaaaaaaaggccgggcacagtggctcacacttgtaatcctagcactttgggaagccaggcaggtggatcacgaggtcaggagattgagaccatcctggcgaacatggtgaaaccccgtctctactaaaaatacaaaaaaattggctggacatggtggcgggctcctgtagtcccacctacttggtaggctgaggcaggagaatggtgtgaacccgggaggcgaaacttgcagtaagccgagatcaagccactgcactccagcctgggcgacagagtgagactctgtctcaaaaaaaaaaaaaccaaaaaaaaaaaaaaaaaaacaacagtccaggcgcggtggctctcgcctgtaatcccagcactttgggaggccgaggcgggtggatcacaaggtcaggagatcaagaccatcccggcgaacacggtgaaaccctgtctctactaaaaatacaaaaaaattagccgggcatggtggcaggcacctgtagtcccagctactcgggaggctgaggcaggagaatggcgtgaacccgggaggcggaacttgcagtgagtggagatcatgccactgcactccagcctggccgacagagtgagattccatctcaaaaaaggaaaaaaaagaacagaacatcaccagcccctagaagtcccccattgtaccctgccctgctactctccacaaagggtaaccccattttttttttaagagatagggtcttgctgtgtcacccaggctgtagtgaagtggtgcgatcacggctcactgcagccttgacctcccaggctcaagtgatcctcccacctcagccccctaagtagctgggactacaggcacacacgccatcacgcccagcaaatttttgcatttctttgtagggatgggtttcactatgttgcccaggctgggttggaactcctggcctcaagcaatcctcatgccttagcctcctaaaatgctgggattataggtgcgagccaccgtgcccagcccttatcttgatttttaacagtctagaatcactctgtctgctatttgaacattatataaatgaaaacaagcaggacgtttcctttatgtttggtttcttttgtgtaacaccaggtttgtgtggttcatccatatttttgtaggttacagttattgttccttgccattttttttttgttttgttttcagacagtctcgctctgtcacccaagctggagtaccatctcagctcactgcaacctctgcctcccacgttcaagtgattctcctgcctcagcctcccaaatagctgggaccacaggactgtgtcacgacgcccggctgatttttgtatttttagtagagacagggtttcaccatgctggccaggctggtctcaaattcctgacctcaagtgatcctcccgccttggcttcccaaagtgctgggattacaggcatgagacaccgcgtccagcccgttgccatttggtatagcaaggtttctcaactgctgttgacatttggagctgaataatctttgttcctacacattgtatgtatttagcggcatcccaggcctctactcacagcgtgacagtaacactcctcccttcggttctgacaacgcaaaacatcgctagacattgccaaatattcccttagaagcgataagatcaccacccagtcgactagacgtggtggctcacgcctgtaatcccagcactttgggaggccaaggcaggtggatcacctgaggtcgggagttcgaggccagcctgaccaacatggagaaaccccatttctactaaaaacacaaacattagccaggcgcggtggtgcatgcctgtaatcccagctactcagaaggcttaggagggagaatcgcttgaattcgggaggcggaggttgcggtgagctgagatcacaccattgcactccagcccgggcaacaagagtgaaactccgtctcaaaaaaaaaaaaaaaaaaaaaaaaaaatcaccacccggttgagaaccgctgtcttcccttttgtgaacttaccacagtttatttacctaaacttttttaggcatttgggttgtttccaatttctggctgtgataagcacaggtgctgtgaacattctggccagtttctggatgaatgcaacaatgtatattctttaagtttatacttaggagtagaaatgctgattcatattgtgtaggtgtttgttcagctttctggatattgccagggttttccaaagcggttgtaccatttcacacgctctccagagtgtgggagtataacttgatattaaattttctttttttttgagatggagtcttgctctgtcgaccaggctagagtgcagtggtgtgatctcggctcactgcagactccgcctcctgggttcaagtgattcgcctgcctcagcctcccgagtagctggaattacaggcacccgccaccgcacccgactaatttttgtattttttagtagagacggggttgcaccatcttggccaggctggtctcgaactcctgacctcatgatccactggcctcggcatcccaaagtgctgggattacaggcgtgagccaccacgccccgctagcattttgggtttcatgtgcatttctctgatgactcatgaggtcagccctctttcatttatcagccatttggagatcaccttttgtgaaagactcatttgtcctttggagtttttgtccttttcattttctttctttccttccttccctccctaccctccctttctctcttcctcttccttcctttctctgtcttccttccttccttcctttctttctttccttctcttttttcttttatttgacagagtttcactcttgttgcccaggctggagtgcagtggcacaatctcagcacactgcaacctccggctcctaggttcaagtgatgctcctgcctcaacctcccaagtagctgagattacaggcgcccaccaccatgcacagctagtttttgtgtttttagtagagacggggtttcaccatgttggccaggctggtcacaaagtcctgacctcagaggatcaaccttccttggcctcccaaagtgctgggattacaggcatgagccactgtgcctggcctccttttcatttatcgctttccttccttctttccttccttccttccttccttccgttgctctctctctgtctctctctctctgtcacccaggctggagtgcagtggtgcaatcatagctcactgcagccttgacctcctgggctcaagtgatcttcttgcctcagcctctcgaattgatgggactacaggcacctgccaccatgtccagctaattttttgtagagacaggagtcttgctatgttttccaggctggtgttgaactcctggactcaagtgatcctcccaccttggcctcccaaagtgctgggatgacagtcatgagtcaccccacctggacccacatataactttttttcttttttctttttttgagacagtctcactctgtcatccaggctggagtgcaatggcacaatcctggctcactacaacctctgcctcctgggttcaagggattctcatgcctcagcctccagaatagctggaccacaggtgcgtgccaccacacctggctaatttttgtatttttagtagagacagggttttgccatgttggccaggctgttcttgaactcctgacctcaagtgatctgccagcctccacctcccaaagtgctgggatgacaggccactgtgccgagcccctcacatataacttttgactcctcaaaacttaactactaggttgggctcggtggttcacacctgtcatcccagcactttgggaggctgaggcaggaggaatgcttgagtccaggagttcaataccagcctggacaacatagcaagactccatctctaaaaaaactaaaaattagctggccatggtggtgcatacctgtggtcccagctactcaagagcctgaggtgggaagatcacctgagcccaggaagtcgaggctgcagtcagccatgtttacaccactgcactccagcctaagtgacgggataaaaccccatctctaacaaaacaaaaacaaaaacaaaaacaaaaacaaaaaaggctgggcgcagtggctcacacctgtaatccctagcactttgggaggccgaggcgggcagatcacctgaagccgggagttggagaccagcctgaccaacatggagaaaccctatctctactaaaaatacaaaattagccaggcgtggtggcgcatgcctgtaataccagcaacttgggaggccaaggcaggagaatcacttgaacccaggtggtggaggttgcagtgagccaagatcgcgccattgcactccagcctgggcagcaagaacaaaactctgcctcaaaaaaaaaaaaaaaaaaaaaaaagaaaagaaaaaaagaaactatcagaacgtccatcaatgagggagtagagaaatgaaaggagaacgaaatgtaatggtaaggtaatggaatattaaacaggagtgaaaaggaataagtaactctccctgtctgtgtgtctctctttctctctcttgccttgctctcactctcactctctccagctctactctatgtcaatataaatgtatcttaatgtggtgctgtttcaaaaagaaattcaagttgtgcaatgttagtttagtgtgatactgtttatataaatttgaaacataatagcactctgggttgcttatggatacaattccacttaaaaacagatacagattaaggaagtaatggcctttttttttttttttcccctgggtacttgtaggtttcaaatgtgtctccctgcagggaccaaagagagcaggtcactataggtcagtggccaggggagtccaggggtcagagtgggatgtgactgaatgatcagtatagccaagggatcagtatgactgaggtagccagagagaccacgtagaaggtagactttttatttttcttttgagacaaggtcccactctgttgcccaggctggagtgtagtggcatgatcatagctcactgcagcctcaatttcccaggctcaagccagcttcccacctcagccttccaagtagctgggactacaggtgtgcgccaccatgcctggcgaatttttcttttcttcctttttagagagagtttcctgctatgttgcccaggctgcaggctggtctcaaactcctgggctcccaaaatgttgggattacaggcgtgagccattgtggctggtggaaggtagctttttttcttttcttttcttttgccagaatctcactttgtctccaaggctagagtgcagtggcatgagctcagcttactgcaacctccgcctcccaggttcaagcgattcttttgcctcagcctcctgagtagctggaattacaggcatgggccaccgtatccagctaatttttgtatttttagtagagatggggtttcaccttgttggccaggctggtcttgaactcctgacctcaggtgatcctcttgcctcgtcctcccaaagtgctgggattacaggcgtgagccactgcccagggccggaagttagctttgatgcacccatttgtcctggagccccaggaacaaggtgtgctctaccagaaagagtgcagatgggatgtggattctggaaatcatatgtaggatttgcaacctcgtgcatggttctgagtatctgtagcttgcagcaggtctagatatgccaacccttgattcagagctcaaaagtcatcagggtcttatgggccagctgaggacagccaggggtcaggcaccaggattttcttttttttttttgcattaaatcaattttttaggctggatgcagcacctcatacctgtaatcccagcactttgggaggccgaggcggcattgcttgaacctaggagttggagtccagcctgggcaatgtagtgagaccctatctataaaaaaaaaaattaaaatctggctgggcgctgtggctcatgcctgtaacgccagcactttgagaggccgagtccagcggatcacataaggtcaggatttcaagagcagcccggccaacgtggggaaaccccatctctatcaaaaatacaaaaatgacctaggtatggtggcgcatgcctgtaataccagctacttgggaggctgaggcataagaatcacttgaatctgggaggcagaggttgcagtgagctgagatcacactactgcactccagcctgggcgacagagcaagactgtctcaaaaaaaaaaaaaaaaaaaaaaaaagaaaaaaaaaaaaagaaaagaaaaagaaaaagaaaaagaaaaaaaaaaagaaaaaaaaaatgctggatggggtggctcatgcctgtaatcccagaactttgcgaggctgatgcaggtggatcacctgaggtcaggagtttgagaccagcctggccaatgtggtgaaaccccgtctctattaaaaatacaaaaattagccaggcatggtggcgcacacctgtggttccaggtcctcggggggctgaggcaggagaattgcttgaacccaggggatggaggttgcagtgagccgagatccactgcactccagcctgggtgacagagcgagactctgtctcaaataaaaaaaaagaaagaaagaaagaaagaaaaagaacaacttcatcaccccgtaaaattcccttacactgcccgttaggagtcacatccttccttccttctccttgacaaccactgatcggctctctgtcgccataatttagcctttccgggactgttgtataaatggaatcagtcacacactggatagccttgtgagactgggttctttctttcttttcttttttttttttggatggagtttcattcttgttgctcaggctggagtgcaatggcacgatctcggctcactgcaacctccacctcctgggttcaagcgattctcctgccttagcctcccgagtagctgggattacaggcatgcgccaccatgcccagctaactttgtatttttagtagagacggggtttctccatgttggccaggctggtctcgaactcccgacctcaggtgatctgcccacctcggcctcccaaagtgctgggacttacaggcgtgagccaccgcgcccagcgagactggcttctttcactcaagcagaggaaaacagtatttgttttcccatgggcttttttttttttaagacaaggtctggctctgtcactgaggctggagtgcagtgatgcaatcacagctcagtgccaactccacctcccaggctcaagccatccttctgcctcagcctcccgagtagctgggactacagatgcacaccaccacacctggctaatttttgtattttctttcttttttttttttttgtagagatggggccttgctatgttgctcagggtggtctcaaactcctgggctcaagcgatcctcctgccttggcctcccaaagtgctgggatgacaggcgtgaaccactgcacccagcccataaacgttctgatttatagcagttcaggtttgcagcaaaattgagtggaaagtacagagatttcccatatatctaccctgctccccaagcccagcctcctccttatcaatgtccgccactagagtggtgcattggttatacttgatgaatctccagggacccgtcctcatcaccccgagtccacagcctacattagggctcactttttttttttttttttttttgagaaggagttttgctcggctagttatatgtttttttagccaggctctttctctgtcatccaggctggagtgcagtggcaccatcacagttcactgcagtgtcgacctctccagctcaagccatccccctgcctcagcctccctgagtagctgggattacaggtgcaccatcatgcctggataattaaaaaatttttttaggctggtcacagtggcttacacctgtaattccagcactttgggaggccaaggtgggcagatcacttgaggtcaggagttcgagaccagcctggcaaacttgttggaaccctgtttctactaaaaattcaaaaattagccgggcgtggtggcacgcacttgtagtcccagctactcaggaggctgaggcagaattgcttgaacctgggaagcggaggctgcactgagctaagatagcactactgcactccagcctgggtgacaagagtgagattctgtgttagaagaaaagaaaagaaaaaatatattgtaatttaaattaatttatttagagacatggtctttctctgtcccccagtctgacctggaactcctaggctcaagcaatccttccacttcagcctcctgagtatctgggaccacaggcttgtgccactgtgcccagcaagagctcatttattttaattaatgagttcccattgtctgaaagtaccactgtttatttattcattcaactcccgaagggcatcttggttgcttccaagttttatgcaattatgaataatactgctgtaaacatccgtgtgcaggttttgttttgttttgtttttttggttttgagacagagtctcactctctcgcccaggctggagtgcagtggcgccatctcggctcactgcaagctctgcctcctgggttcacgccattctcctgcctcagcctcccgagtagctggtactacaggcacctgccaccatgcccggctaattttttgtatatttagtagagacagggtttcaccgtgttagccaggatggtctcgatctcctgacttcgtgatcctcccgcctcggcctcccaaagtgctgggattacaggcatgagccaccgcacccggccagtttgtttttttttttttgagtcggagtctccctgtgtcgcccaggctggagtgcagtggtgtgatctcggctcactgcaacctctgcctcacgggttcaagtgattctcctgcctcagcctcctgagtagctgggactacaggcacatgccaccacgcgcagctaatttttgtatttttagtagagacagggtttcaccatattggccaggctggtcttgaactcctgacctcgtgatctgcccgcctcggtctcccaaagtgttgggattacgggtatgagccactgcacctggcccatgtgcgggttttcttgtagacatgagctttcaactcgtttgggtaaatatctaggagtgaaattaattggttatatggtaagagtatgtttagttttgtaagaagctgtcacactgtcttctagagtggctgtactgtttggcatttctctcagcaaagagtgagatttcctgttgctatataggaaacatcttttttttttttttttttttttgagtcagtcttgctttgtcacccagggtggagcacagcggtgtaatctcagcttattgcaacctccacttcccggactcaagcacttctcatgcctcaccctcccgagtagctggcattacaggcatgcaccaccacgcccggctaatttttgtatttttagtagagatggggtttcaccatgttgcccaggctgatctcgaactcctggcctcaagtgatccacccacctcggctcgcaaagtgctgggattacaggcgtgagccaccactcctggccatataggcaacaaaatttttaattacggcaacatctagaaaaaaatgttttatcctatatcctgcatttttctttttctttcttttttttttttttttgagatggagtctcactctgtcacccaggctggagtgcaatggtgccatctcggctcactgcaacctctgcctcccaggttcaagcaattctcctgcctcagcctcccaaatagctgggattacaggcttgtgccaccacactctgctaattttttgtatttttagtagatatggggtttcaccatgttggccaggctggccttggacaccttgcctcaagtgatccgcctgctttggcctcccaatatcctgcttttttctgtaaaaatagtatgaaaatattttacatattgttaaagaaaatctacaaacatttttcataactgcatattggatcttatcacgtgattgtacacagcgtaccggatacctcaggctttgcactaactgaatattaaaataacaataacagaagcattgttatatgtaaatatttgcctatttctcatatttctttctcatggattcccagcagtggaaatactggctggaaaaaggcaaacacgttatgattcttggtacatgttgccaagagctcaccagaagcctgaaatttatgctaaaagcagcaagctggccgggcacagtcgctcatgcctgtaatcccagcactttgggaggctgaggagggtggatcacctgaggccaggagtttgagaccagcctggccaacatggcaaaaccccatctctactaaaaatacaaaaatgagctgggcatggtggtgtgtgtctgtaatcctggctactagggaggctgagacaggagaatcacttgaacctgggaggcagaggttgcagtgagccgaaattacgccactgcactccagcctggacgacaaagcaaaactctgtcaaaaaaaaaaaaaaaaaaaaaaaagctgcaagctggggtaagagtcttcaggaaaaaaaaaaaaaggttagattaaaatagacaaaagatgtctcattctcttttcttttttagagatagagtcttactgtgttgcccaggctggggtgcagtggaactatcatagctcacagaagcctcagcctcctgggttcaagtgatcctcccacctcagcttcccaagtaggtgggattacaggcatgtgcgaccatacccagctaatttttattttttgcagagatgtggtctcactacattgcccaagttggtctcaaactcctgggctcaagtgattctctcaccttggcctcccaaagtgctgggattacaggcatgagccacagcacctggctaagaattcctctttaagttttaaagagagacaactcagtacattgcttgaccattttgccctctgctcttaagcttagaaaatgctttcacatctcagagatttaaaatccatttccagctgggcacagtggctcacgtctgtaatctcagtactctgagaggccaaggcaggcaaatcactagagaccaggagtttgagaccagcctggccaacatggtgaaaccccgtctctactaaaaagacaaaaattagctgggcaaggtggcacatgcctgtaatcgcagctactcgggaggctgaggcaggagaatcgcttgaacccaggaggcagatgttgcagtgagccgagattgtgccactgcactccagcctgggcaatagagtgacactccatctaacataataataaataaatccaaagaacttagtaaactcctttggtgtcacaaagctgtttgatgacagaatcagtattataacctggaagttcaaactctggcttggcgctttttcttattttatagctagtctttgaggtaagatttgtactgttaattcattctgcctacccatccacacacaaaaaattatgaggtcaaaaataaataatttgaaatagagcaaaagtagaggaagtagtgaaggaagaaaggattctggaattccataaaagttttgtgttttctttgtttgtttgttttttgagatggagtctcactctgtcacctaggctggagtgcaatggcgcaatctcggctcactgcaacctctgtctgcctcctgggttcaagcgattctcctgcctcagcaacctgtgtagctgggattacaggcgcctgccaccatatctggctaatttttgtatttttagtacagacagggtttcaccatgttggccaggctggtctcaaactcctgacctcaaatgatccacccgcctcggcctcctaaagttctgggattccaggcgtgagacaccgcgcctggcctgtttcttttcttttctttttttaattgagacagggtctcgctctgtcacccaggctagagtatggtagtgccatctcagctcaatgtggcctcaatctgggctcaagcaattctcccatcaggctcctgagtagctgagactatagttgtgcactactatgcctggctttgctgctttttgatctgataacagaaaatggcctgtatcagcgacataatcagaagtagataacaaaaccagctggttaaaaggaaattgcaaaagaataatacacctctttggtcaggtgtggtggctcatgcctgtaatcccagcactttgggaggccgaggtgggtggatcacttgagttcaggagtttgagaccagcctggccaacatggtgaaatcccgtcttcaatataaatacaaaaattagctgggcgtggtggcaggtgcctgtatttccagctaatcgggaggctgaggcagcagaattgcttgcagccaggaggcggaggtttcagcgagccaagatcacacctttgcactccagcctgggtgacagacagagactctgtctctaaatcaatcaatcaatcaatcaatcaaccaatcacctctttcacatgcccctaacactgatcatgaagggggtcaactcactgaactacaagaaattgattatggttacagaaaatgtcataagttgtatgtttgtagagcattatctgcacacacacatattcacttttccatgcttgttattcagatagcagctgcattacatttatatcatcccagctattggcttagtagccaagaatctatatagagttatagggcagtgataaagatacggttttagaaggcatttactatagatttttttttttttttttttttttgagacggagtcttgtcctgtcacccaggctggagtgcaatggcacgatctcagctcactgcaacctccacctcccgggttccagcaattctcctgcctcagcctcctgagtagctgggattacaggcaggtgccaccacgcccagctaatttttgtatttttagtagagatggggttttgccgtgttggccaggctggtcttgatctcctgacctcgtgatctgcctgcctcagcctcccaaagttctgaaattataggcatgagccaccgcaccctgcctaggttgttacctttttttttttttttttttttgagatggagtctcgctctgttgcccaggctggagtgcagtggcgtgatctcgggtcactgcaagctctgcctcccaggttcacgtcattctcctgcctcagcctcccaagtagctgggactagaggcgcctgccaccacgccctgctaattttttgtatttttagtagagacggggtttcactgtcttagccaggatggtctcgatctcctgacctcgtgatccgcccgcctcggcctccgaaagtgctgggattacaggcgtgagccactgtgcccggcctagatagttacctttaattaaagtaacttttagctgggcatgtacctgtattctcagttacttgggaggctgaggcaggaggaccatttgagcccaggagttcaaggctgtagtgtgccatgatcctgtctgtgaataaccaccgcactccagcctgggcaacatagcaagactttctctctctctcaaaaaggtaacttataattttcgtaacttttgaactccttgagcccaggagtttgagaccagctctggcaacatattgagacctcatctctacaaaaactttaaaaattaactgggtgtggttgtgtgcacctgtagtcccagctactcaggaggttgatgcaggaggatcacatgagccgcagtggtcgaggttgcagttagctataatcatgtcactgcacgccagcctgggtgacagaaagacccagtcttttttttctttttttgatggagtcttgctctgtcgcccaggctggagggcagtggcacgatcttggctcactacaacctccgcctcccgggttcaagcaattccctgcctcagcctcccgagtagctgcgattacagacatgcaccaccacgcctggctaatttttgtatttttagtagagacggagtttcaccatgttggccagggtggtcccgaactcttgacctcaggtgatccacccgcctcggcctcccaaagtgctgggatcacaggtgtgagccactatgcccaaccgaccctatctcatttatttatttattggatttatttatatatatatttttgggggatggagtctcactctgtcacccaggctggagtgcactggagtgatctcagctcattgcaacctccatctcccgggttcaagcaattctcctgcctcatcctcccgagtagctgggactacaggcgtacaccactacatctggctaattttttgtatttcagtagagacggggtttcaccatgttacccagcgtggtctcacacttctgagctcaggcaatctgcctgcctcggcctcccaaagtgctaggattacaggggtgagccaccgcacctggcctggaccgaccctatctcttaaaaaaaaaaaaaaggccggcatggtggctcacgcctgtaatcccagcagtttgggaggctgaggtgggcagatcacgaggtcaggagatcaagaccatcctggctaagactgtgaaacccagtctctactaagaatgcaaaatattagccgggcatagtggcacctgcctgtagtcccagctacccaggaggctgaggcaggagaatcgcttgaacctgggaggtggagcttgcagtgagccgagatcatgctattgcactccagcctggatggcagagcaagattctgtctcaaaaaaaaaaaaaaaaattgtgttggccaaaactttcacaacacccatcccaaaatacttgttctgcgtggtatgcagatcaactgtctcttcagacaagcacttctttaacctttacttcatcaaaatggaatatttctttgaaattccacaccttttaaaattcctaaatcctcagacagctttcttagttggttcatctgaagtctcatcatctttggtacaacaatctctaatgagaacaggtttcaataaaggaggtgactcaatcaccatcttgtttttgagatagagtcttgctctatcacccaggctggagtgcagtggcacgatctcagctcgctgcaaccccgcctcctgggttcaagcaattctcatgcctcagcctcccaagaagctgggattacaggcacatgccaccatgcctggttaatgttttttgtatttttagtagtaacatggtttcaccatgtcggccaggctggtcttgaactcctggcttcaggtaacccacctgcctcagcctccgaaagtgctgggattacgggcatgagccaccgcgcctggcctcaatcatcttgtttaactatttctcaaaagctctgatctgcaaaggaagattaatttcaggtctgaactggccaacagaaaccaccaaatgtcctggggtcatctttttctgaagtcagggaatgttcagaaatgcccgcataccacgtggtggatgaacaatactagcgtaattcccagctttccacagtgagaggatatggttcagtgtccaagaagaattcatcatgagtacatacatcactgcaagaaccgaagagtccacaaataaaccgaaaactaaatagtagtagatgaactttgctttactgaggattcctggtaacgaaggctgtgttattttattcaacattttgtgcccatgcctgtagtctcagctacttggaaggctgaggtgggaagatcacttgggcccaggaagtcgaggctggagtgagctgcaatggtgccactgcactctagcctgggcgacagagtgagactctgtctcagaaataaacaagcgaacaaacaaacaaacaacataggctgtgtgcagtggctcatacctttaatctcaccactttgggaggctgaggtgggtggatcacttgagatcaggagttcaagaccagcctggccaacatgatgaaaccctgtctctaccaaaaatacaaaaattagccgggcgtggaggcttgggcctgtaatcccagctacttgggagcctgagacaggagaattgcttgaacccaggaggcggaggttgcagtgacctgagatcgcaccactgcactccagcatgggcaacacagcgagactgtctccagaaaataataataataataataataataataataataataataataacaacctgcttcaagatacttactttttctgcagggctcttgaaaccacaccataaaactcattctccttctccactagcattgcagtatggattaaaaaaattcaaataggccagacgcggtggctcatgcctgtaatcccagcattttgggaggctgaggtgggcagatggcttgaggtcaggagttcaagaccagcctggtcaacatggtgaatccccatctctacaaaaaaaaaaaaatacaaaaattagccagacatggtggcgcatgcctgtactcccagctactcaggaggctgaggcaggagaatcacttgaacccaggatgtggcagttgcagtgagctgagatcatgccactgcactgcagcctgggtgacagagtgagacactctcaaaaaaaaaggccgggcgtggtggctcacgcctgtaatcccagcactttgggaggctgaggcagacggatcacgaggtcaggagatcgagaccatcatcctgactaacacggtgaaaccccgtctctactaaaaatacaaaaaattagctgggcatggtggcgggtgcctgtagtcccagctacttgggaggctgaggcaggagaatggcatgaacccaggaggcagaacttgcagtaagctgagatagtgccactgcactccagcctgggcgaaagagcaagactccgtctcaaaaaaaaaaaaaaaacagcaatcactatttgattttttccatttttttgctggttgacactgactttttctttcttgatagcagcagattcctcaaaggatgattaccaaagatttacataaatttccacatacaattagctcacgaaagaacaatgaattaaattacctcaacaactcaaagaccagtcccctcccatggggccccatcttccgaagaccccccaaactaggaagcccttcattgtttctctcctctatgagctcctccacacactgtcatttctttttctttctgtatttttattattaagacagggtctcactctgttgcccaggctggagtgcagtggcccagtcatagctcaatgcagctttgaactcctgggctgaagcgatcctcccacctcagcctcccaagtagctgggactataggtgcatgccaccatggctggctaattttttttttttttttttgagacagagtctctctctgtcgcccaggctggagtgcaatggtgggatcatggctcactgcaacctctgcctcccagattcaagctattcttctgcctcagcctcccgagtagctgggattacaggcacttgccatcatgcccggctaattttttttctgtatttttgtagagacagggtttcaccatgttggccaggctggtcttgaactcctgacctcaggtgatccacctgccttggcctcccaaagtgctgggattacagacgtcagccaccgtgcccggccatcttggctaatttttaaagattatttttagagatggggtctcactatgttgcccgggctggtctcaaactcctggcctcaagtgatcctcccgtctcggcctcccaaattgcttggattataggcatcagccattgcgtccagcttctcttctaattttctaggctatttatagggtccacaatggatcatgccagcccctctgctaagggttatccaccaacatctcatttaacctacactatcctctccagaagcaaatattgcattggtgcaaaagttattgcggtttttgcaattaaaagtaaaggcaaagctgggcacagtggctcacacctgtaatcccagcattttgggaggctgaggcaggtggatcacaaggtcaggagttcaagatcagcctgaccaacacggtgaaaccccatctctactaaaaatacaaaattagctgggtgtggtggcgcgcacttgtaatcccagctactcgggaggctgaggcaggagaatcgctcgaacccgggaggtggaggttgcagtgagccaagatcatgccactgcactccagcctggcaacagagcgaaactctgtctttaaaacaaaaaggtaatggcaaaaaacgcaattatttttgcaccaacctagtattatttctctcatgtcacagatgagaaaactgaggcttagggggaatctctaaatttgtctagtgtcatgtggccagagacataattcatacctggacacctcactccggacgctgttcacagccctactcctctttggtgggtaaatactccgggaaaggcacgattttctcctagtgtgaattcagggtaggcaaaatagcctcatccagtcacaagaggcccctgacctgcctgagaaaggtgctgcaaaccccgtgctctgtggcttcccccacccttgtgtttttggtctcccaggggaaactgaggcagcctgggcagtggccaatgatcccagacattagcagaaagaaatcccgaattttccttggcagagggaagcctcaggacccacaaagcaggaacctgtgacttgagggcaattcccggagctcccaaccccgctgacacccctgtgaaatatggcatagcccacgcccagaatcccactccctatgacctgtaactaccgtcttttcttttcttctcttttcttttgaaacagagtctcgctctgttgtgcaggctggagtgcaatggcaccatctcggctcactgcaacctccgcctccctgcaacctccgcctcccaggttcaagcaattctcgtgcctcagcctcctgagtagctgggactacaggcacctgcaaccaagcccggcaaattttttgtatttttagtagagacggggtttcaccgtgctagccaggatggtctccatctcctgaccttatgatccgcccgcctcggcctcacaaagtgctgggattacaggtgtgagccaccgcgcccagccttgtcttgtcttttcttgtcttttgaaacagagtctctctctgttgtgcaggctggagtgcaatggcacgatctcagctcactgcaacctccgcctcccaggttcaagcaattctcctgcttcagccttctgagtagctgggattacaggcgcctgccacctcacctggctaatttttgtatttttgtagagatggggtttcaccatgttggtcaggttagttttgaactcctggcctcaagtgatctgactgcttcagcctcacaaagggctgggattacaggcttgagccaccgtgcctggcactactcccacttctataaccccttcatctctctgatccttttatcctcatgacagctttacccaagcccctgaacaggagcagaaaatccattcatttaggccgggtgcagtggcttatgcctataatcccagcactttgggaggccgaggcgggtggattactggaggtcaaggagttcaagaccagcctggccaacatggtgaaaccctttctctactaaaaatacaaaaattagccagatatggtggcgggtgcctgtaatcctagctactcggaagggtgaggcagtagaatcacttgaacctgggaagtggaggttgcagtgagctgagatcgtgccattgcactccagcctgggcaaaaagagcaaaactctgtctcaaaaaaaaaaaaaagtctgggcgcggtggctcatgcctgtaatactagcacttcaggaagctgaggtgggcagatcacttaaggtcaagagtttgagaccagcctggccaacatggtaaaaacccgtctctactagaaatacaaacattagctgggcatggtggcacatgcctgtaatcccagctgctcgggaggctgaggcaggagaatcacttgaacctgggaggcagaggttgcagtgagccgagatagtgccactgtactccagcctggacaacagagcgagactccatctcaaaaaaaaaaaaaagaaaagaaaaagaaaatccattcatttaatgcatgaacagatatgaattgagctgtgtaaactcaaagtatctgagtcaggtctcaatcaatttaggaagtttatttagccagctgggttcagtggctcacgcctgtagtcctggcactttgggaggccaaggcaggaggatgtcttgagctctggagttcgagaccagtccgggcaaaatggcgaaacccagcatctacaaaaaacacaaaagttagccgggtgtggtggtgcatgccttcggtcccagctgctcaggaggctcaggtgggaggattgattgagcccaggaggttgaggctgcagtgagctgaaatcatgccactgcactccagcctgggtgacacagcctgggtgacactccagcctaggtgacactgtctcttagaaaaaagtattttttttgttttgctttttttgagatggagtctcgctcttgttgcccaggctggagatggccaggttgctcttgaactcctaacatcaggtaatccacccacctcagcctctcaaagcgctgggattacaggaatgagccaccacacctggctgaaaaaaaccttatatttagagatggagtcttgctatgccacccaggctggtctcaaactcctggcctcaagcgatcctccctcctcagcttctcaaagtgacatgattacagacgtgagccacctcaaccagcagccttttttttttttaatggaatcttgcttggtcacccaggctggagtgcagtggcacaatctcagctcactgcgacctccacctcctgggttcaagcgattctcctgcctcagcctcctgagtagctgggattacaggcacctgccaccatgcccagctaattttttgtatttttagtagagacagggtttcatcatgttggccaggctggtctcaaactcctgacctcaggtgatctgcctgtctcagcctcccaaagtgctaggattacaggcatgagccactgtgcctgacctgcttcttattttattttatatttatttatttatttttttgagacagagtctcgtcaggctggagtgcatggcacgattcggctcactgcaagctccgccttccgggttcacgccattctcccgcctcagcctccccagtagctggtactaaagacgcccaccaccacgcccggctaatttttctgtatttttagtagaggcggggttttaccgcattagccaggatggtctcgatctcccgacgtcgtgatccgcccgcctcggcctcccaaagtgctgggattacaggcgtgagccaccacgcccggcccctgcttcttattttaaaatgtagcaggaggccagacacagtggctctcacctgtaatcccaacactgtggggggccaaggtgggagaattgcttgaggccaggagttcgagaccagcctgggcaacatagcaagatcccatttttacacgctggccatgatggtgtatgccccatggtcccagctacttgggaggctgaggtgagaggattgcttgggcccaggaagtcaaggccgcagtgagttgtgattgcaccactgcataccagcttgggcaacagagcaagaccctgttctcaaaaaaaaaaaaaaaaaaaaaaagagagagagagagacctggggcagtggctcacgcctgtaatcccagcactttgggaggccgacgcaggcagatcacctgaggtcaggcgtttgagaccagcctggccaacatggtgaaaccccatctctactaaaaatacaaaaattagccgggcatggtggcggctgcctgtaatcccagctactcaggaggctgagacaggagaatcactgaatctgggaggcggaggtggcagtgagctgacattgcaccactgcactccagcttgggcaacagaagcagactccgtctcaaaaaaaaaaaaaggaggcggagagagcaggagaaaatgtgggtaagagcctttattatagtttccatgggacaggcacagtgaggcagatgaaagttgccacgggctattttgaataatttctccaggctctggggcatacgtgctgtccctaattgcctggcacatggccctaaagtaatcaggtcagggcaacaggcttggattgtcacagctctgcaaaaaaggtggttgtggggtgtgagctttccataggaaccgtgtgctcttggacaagccagttgtttgcaaactctccaacaaattagctaaccctgaagaaatcggcaaaccctgggagaagctgtctttccggcattagcaaggcccaagatgccaaaacatcaggaaacagagaaactcctggcctcaagtgaacctcacagaaagaccagtcccctcctgtggggccccgtcttctgacgacccccaaactaggaagcactttattgtttctcttctctgtaggctcttccacatgttgtcatttctttctctttctgtatttttatgtattattatttgggtcagggtctcactctgtgcccaggctgcagtgcagtggtgcaaccatagctcaatgcaggcttgaactcctgggctcaagcaatcctcccacctcagcctcccgagtggctgggacttacaggtgtgtgccactagtccaggcttttccctttcaccttgctttccctagggtctgttcccctgccctacctggctcctgtgtccccagagagctggccaagcagcaagggaaaggggtttcccccttcatgtgttactacggctaagggacagaacccaagttagccacccacctgcacatttgacctcgccacagggtctggcagctgcaccctccacagacacttggatcagatctcggttctgttgctctgtgacctcctgttgcaatttgctggaaagcaagtgaatcctgtgccaagacacactggcacacatctgtgattgcatgccaggtccccaggaggctaaggtgggaggattgcttgagcccaggagttcgagaccagcctgggcaacatagtgaggccttgtctctacaaaagataaacaaaattagtcaggtgtggtggcatgcacctttggtgttggctattcaggaggctgaggtgggaggatggcttgagccctagaggtctagacttcagtgagctgtgatcatgccattgtactccagcctgggcaaaagagcaagacccggccgggcgcggtggctcacacctgtaatcccagcattttgggaggctgaggcgggcatatcacctgaggtcgggagttcaagaccagcctgaccaacatggagaaaccccatctctactaaaaaatgcaaaattagccaggcgtgttggcgcaggcctgtaatcctagctactcaggaggctgaggcaggagaatcactggaacctgggaggtggaggttgcagtgagctgagatggtgccattgcaccccagcctgggcaacaagagcaaaactccgtctcaaaaaaaaaaaaaaaaagtaagaccccatctctaaacacatatagatacacatataaaatacaaaatatatataaagaataaaaatcgtattagaaaatctaagctggccgggcacagtggctcacgcctgtagtcccagcactttggaaggctgaggccagtggatcacctgaggtcaggagttcaaggccagcctggccaacatggtgacttcccagctctactaaaattacaaaaaattagctgggcatggtggtgggtgcctataatcccagctacttgggaggctgaggcaggagaactgaacctgggaggtggaggttgcagtgagccgagatcacgccattgcactccagcctgggcaacaagagtgaaactccatctaaaagaaaagaaaagaaaatagcagcagctgcctatacaaccaaaggaccaatgagacttttttttttttttggggatggcgtctcaccctgtcgcccaggctggagtgcggtggcacaatctcggctcactgcaaactccacctcccgggttcatgccattctcctgcctcagcctcccgagtagctgggactacaggtgcccgccaccacgcctggctaattttttgtatttttagtagagacggggtttcaccgtgttagccaggatggtctcgatctcctgacctcgtgatcctcccgccttggcctcccaaagtgctgggattacaggcgtgagccactgcgcccggccaagatcacctagattttcttctagaagttgtagagttttgtagagttttttctccttcccttcctcctccctcctcctccctcctccctccttccctctccccctcccctcctccccctccccctccctccctccctccttccctctcttcctcccttcctcccttcctttctttccttccttccttccttccttatttttgttttctctcccttccattctccaccttcctcttgcaccatcacctatagctttgtatttgacatataggtctacaattctttgtgtttgtttgcatggtataatatatatggcatacaatttaccctttttttttttttttttttttttgagacagagtcttgctctgtcgcccaggctggagtgcagtggtgcaatctcggctcactgcaacctccgcctcctgggttcaagcgattctcctgcctcagcctcccgaatagctgggaatacaggtgcgggcgccaccacgcccagttaatttttgtatttttggtagagatggtgtttggccatgttggcaagggtagtctcgaattcctgacctcaagtcatccgaccgccttggcctcccaaagtgctgggattataggcatgagccaccgcgcccagccacaatttaccattttaacctgtcaacgcaaagagtcaaactttaaaatattcgaagagatttattctgaggcaaatatgagtgatcatagcccatgacatagctctcaggaggtcctgggaacatatgcccaaggtggttcgggagcagcttggtttgatacattttagggaggcaagagacatcaatcaaacacatctgagaaatacgctggtttggtacagaaaggtgggacaattcaaaggaggtggcgggtcttccaggctataggtaaatttgaacattttctggtggacaattggttgagtttgtctaaaggcctgggattaagctgggcatggtggctcacctctgtaatcccagcacttctggaggctgaagtgggtggatcacttgaggtcaggagttggagtccagcctgaccaacatgatgaaaccctgtttctatcaaaaatacaaaaaaattagccgggcatggtggcaggtgcctataatcccagctactctggaggctgaggcaggaaaatctcttgaacccgggagatggaggtttcagcgagtcgagatcatgtcactgtgctctaggctaggcaacagagtgagactctgtctctaaataaataaataaataaataaacaaacaaacaaaataaagacctgggattaatagaaaggaaatgttcaggttcagataaaagattatggagaccaaggtttgtttgtttgttttgagacagagtttcgctcttgttgcccaggttggagtgcaatggcacgatattggctcactgcaacctcggcctcccgggttcaagcaattctcctgcctcagcctcctgagtagctgggattagaggaatgggccaccatgccagactaattttgtatttttagtagagatggggtttctccgtgttggtcaggctagtctcgaactcctgacctcaggtgatctgcctgcctccgcctcccaaagtgctgggattacaggcgtgagcgaccacacctggcccaaggccatttcaaaatatggtaaagaaacatgttttggggtaaaatacttttattttcttctttgccacataatgttatggcagagtcaggttggaaagtaagtgacgatatataggattaaataaaacccatctgatgaggatttatggtttgtggggcaggccccttagataggaatctgggcaagataaaaaatatcggagcttagttctcaaaccatttttaagtatgcaactcagtggtattaagtacattcgcgttgttttgcaaccatcactgtcagaagtatgtaaaccagagcgactccgtcttgaataagggctgggtaaaatcagcctgagacctactgggctgaattcccaggtggttaagtcattctaagtcacaggatgagacaggaggtcagcacaagatacaggttataaagaccttgctgataaaacagattgcaataaagaagccagctgaaacccaccaagaccaagatgacgacatgagtggcctctggttgtcctcactgctgcactctcaccagtgccatgacggtttacagatgccgtggcagcatcaggaagctaccctctatgctctaaaaaggggaggcatgaataatccaccccttgtttagcatatcatcaagaaataaccataaaaatgggcaaccagcaggcctcggggctgctctgtctatggaatagccattcttttattcctttacttttctaataaacttgctttcactttatggacttgtcctgaattctttcttgtgcgagatctaagaaccctctcttggagtctgaactgggagccctttcccataatatcttcaccattcatctccagaactttttccaaacgggaaatctgtacctattaaataatagcactggccgggtgctgtggctcacacctgtaatcccagcactttgggaggccgaggcgggtggatcacgaggtcaagagatcgagaccatcctggccaacatggtgaaaccccgtctctactaaaaatacaaaaaaattagccgggcgtggtagcgcatgcctgtagtcccagctactcaggaggctgaggcaggagaatctcttgaacctgggaggcggaggttgaagtgaaccaagatcatgccactgcactacagcctggtgacagagtgagacactgtctcaaaataataataattatgataataataacactccatccctcttcccccagcccctggtaacctccattctactttctgtctctgtgaattttccaattctaggtacctcactatggtcccttttgtgttcatttttttgttttttttgagtctcactctgtcacccaggttggagtacagtggctcgatcttgactcactgcaacccccacctcccaggttcaagtgattctcctgcctcagcctcccaagtagctgggattacaggtgcccactaccactcctggctaatttttgtatttttagtagagacggggtttcaccatcttggccaagctggtcttgaacccctgacctcaggtgatctacccatcttggccttctaaagtgctgggattacaggtgtgagccactgtgcctggtctgtgttcatttttgttttgttttgtttttagatttttaaaaagttttaaaattttttgtagagaggggttctcacttgttcaaggccggtctcgaactcttgggctcaagcaattctcctgtttcagcccccaaaagtgctgggattacaggcgtgagccactgcacctggctgcattcattttttacgaaaggtgtaaagtctgtgcctattttttgcgtatggacatctgattgttctagcaccatctgtggaaaatgtaaccacaccagaccaatctggttcacctttttttttttcttgaagacagagtctcactctgtcgcccaggctggagtctagtggcgcagtctcagctcacagcagcctctgcttcctgagttcaagtgatcctcctgtctcagcctcctgagtagctgggattacaggtgagcaccaccacacctggctaatttttgtatttttagtagagatggggtttcactatattggccaggctggtctcaaactcctgacctcaggtgatccgcccgcctcggcctcccaatggttcaatttttttttttttttggagtctcgctctgtcacccaggatgaagtgcagtggcgtgatctcagctcactgcaagctccgcctcccgggttcacgccattctcctgcctcagcctctggagtagctgggactacaggtgcccgccaccacacccggctaattttgtttttgtatttttagtagagacggggtttcaccatgttagccaggatggtctcggctagtctcgatctcctgacctcgtgatctgcccgcctcggactcccaatgtgctgggattacaggtgtgagccaccgcgcccggtcccaatggttcaactttttattttttattttttttcaagaaggagtttcactcttgttgcccaggctggagtgcaatggcaggatctcggctcaccacaacctccgcctcccaggttcaagcgattctcctgcctcaacctccctagttgctgggattataggcatgtgccaccacgcccggctaattttgtagttttagtagagacggagtttctccatgttggtcaggctggtcttgcactcccgacctcaggtgatccgcccgcctcagcctcccaaagtgctggaattacaggcgtgagccaccacgcccggtcagttcaacttttatgtagcagagttgtgagttgtttttcagttgccacggacccccaggtagaaggtcgcataacctgagcatgtccaggtgaaccaactgtgtaaccacaggcagaacctaagtgctcccactgaggagagaggggtggagactgaattaagaagcagacactgcatgacaggacccaggatccaatcagagtgagccctgacatcatcccatggccggatccaatcagatcatgcctcccggcatcacctcagtgcaagatccaatcagaacacgcctcattaccctatgcttataaaagctgccccagcctgcagctcccggagacagatttgaatgtttcttcctgtctccgtgcagtcgacttgcaataaagcttttattttctgaaaagctggtgccatgtattggcctgtatgtgcattgggcagggaacacattgattgcatagacagcaaaaagactgtcctttctccgttgaattgcctgtgagcttttgtcaaagatcaattgattatattggtgtggatttatttctggactttctgttctgttgatctgtgtgtcttcttttgccaatactgtcttggttattgcagatttccagaacgtcttgatattgggtagtgacagtcctccaacttggttcttctttgatattttgtaggctattctcagtctttgtctttctgtatcaattttaggatcagtttgtcaatatctacaacctggcaacatctattaaaattaaaaatataggccgggcacggtggctcacgcctgtaatcccagcactttgggaggctgaggcaggcagatcacgaggtcaagagagcaagatcatcttggccaacatgatgaaaccccatctccactaaaaatacaaaaattagctgggcgtggtgccacgcgcctgtagtcccagctactcgggaggctgaggcagagaactgcttgaacctgggaggaggaggttgcagtgagccaatattgcaccactgcactccagcctggtgacagagcgagactcggtctcaaaaaaaaaaaaaaaaaaaaaaaaaaatatatatatatatatatatatatatatatatatagagagagagagagagagagagagagagagagagaaagagagagagagagagagatccttcacccagcaacctcattgctagaaatctttcccttggaaagaaaatcgtcagcacgtatgggcataggtataaaaattaatttttgtagagacagggcctcgctctaatgcccaggctggagtgcagtggcgtgatcatggctcactgcagcctcaacctcccaggctcaagtgattctctcacctcagacttccaagtagttgggactacagatgccatcatgttcggctagtttttaaaaatttttttgtaaagacaggagtctcattacattgtccaggctagtcttgaactggtctgaagcgatcctcctgcctttggcctccgaaagtgctgggattacaggtgagagccactgcacccagccaaaaaattcttgttgcagcattttttgcttactttttggtagtggtggggaataaaacctgttaaccaagtgaaaactcatcagtggggatgtggttgaataaatgaaggttcatccacaccatagatgattatcaagcaattaaaaagaatgaattcagattttagtaggtggtctaagaagtttccagaaagtcctgtgaataaaaaagtatgttcaatatgattccatatttatgaaacaatgaccccatcctctctttttggtctatgtatttatgaatatctaccttcgtttaatgaacaaagagaacaacctggtagattgttaacttgaagaatgaccaaagtaagaggaaataagagaaaaagagagggtagttcaacccctgatgactgttgaaaaaaatagtaacttctttttctaaatcagtgctgtccaatagaaatataaatgcaaggtcaggctcagtgactcatgtccataatcctagcactttgggaggctgaggcaggaggatcgcttgggcccaggagtttgagatcagctgggacaacatgatgaaaccttgtgtttacaaaacatacaaaagttagccgggtgtggtggcggcacttgtaatcccacctactcgggaggctgaggtaggaggattgcttgagcctgggaggttgaggctgtagtgagccatgatcacaccactgcattccagcctgggcaacagaacgtgatcttgcctaataaaaaagaaataaaataaaaactaatgcaaccgacatagacaatcttaactcttttagaacccacattttatttcatatatatttacttatttatatatatatttttgagacggagtctcactctgttgcctaggctggagtgcagtggtacgatcttagttcactgcaacctccgcctcccagtttcaagcgattctcctgcctcagcctcccgaatagctgggatttcaggtccctgccactatgcccagctaattttttgtatttttagtagagatggggtttcaccatgttggccaggctggtttcaaactcctaacctcatgatccgcccacctgggcctcccaaagtgctgggattacaggcgtaagccaccgagtggcctagaacccacattttaaaaagtaaaaagaaacagatgaaattttaataatataatttacttagtccagtgtacccaaaatatcagcatttcacccctgtcattgctatttgaggcatcttacattctttctcttgtatgaagtgcttgcgattccgtgtggatttcacacttatatctccatagaactggttcaaatgctcaaaagctccctgtgaccagtggccacctaacaatctatgggaagacttgagtgccccctagtgacagatttgattaacttcctcttggcaatgaggtcctcaaaggtaaatcagatggcgtcgctccctgcctagaacccaccgtggctccctgctgccgccaggtcatgtccacgctcctggttttcaagactcctttcaatctgagtcctgctcgtctctccacaagcaacttccactccttccttccggtcatatcagatttgctcaccattcattcatttactgatccatcgattcagcgtttattgagtgccaatgaaggccctggcacatgtgcgttttctgaagatcagtgatattcaggtttctgggtctgacaatttgcacttaaccaactttatttttgagtgtcagtcttcttgtctgacttaactaatggcacccttaaggtttcagagggcagagtggaaagctgcaagtgcacccttagcccgcaaggatgagaccagagggagagaggctgggcgggcattggggccccagataaatgggtgcagatggcagaactggcagtgggtgccagagtcctctcttctcccagcagggctaatcctaatccagttgaagtctgacctcaaagcccaccttggcatctcaaaatgctgggattacaggcttgagccactgcatcccggcctctcttgctttctttccctccctccctccctcccttctttccttccttccttccttccttccttccttccttccttccttccttccttccttccttccttcctctctttctcctctctctctctctctttctccattcttttgacagagtctcactctgtcgcccaggctggagtgcagtggcatgatctctgctcactgcaacctccgcctcccgggttcaagcaattctcttcttcagcctcccaagtaactgggattacaggtgcccaccaccacgcctggctaattttttttgtatttttagtagagatggggtttcaccatcttggccaggctggtcttgaactcctgacctcatgatccacctgcctcagcctcccaaagtgctgggattacagacgtgagccactgcgcatcttctctcctctcctctttcttcctttttcttctctctctttctctatctctctgtctttctttttatttgaaagggtcttgctctgtctcccagtccggagtgcagtgatgtgatctcggatcactgtagcctctacagtgacatctggggctcccagacatctggggctcaagtgatctcatctcagtctcctgagtagctgggactacagactcatgccaccaggcctggctaatctttgtgttgtttgtagagacggagcttgccatgttgccccagctggtctctaactcttgcactcaagggatctgcctgccttggcctcccaaagtgctgggattacaggtgtgatcccccgctcccggctcgacatggaaatattgccaagatgtaataagaagttaaaagaggctgggcgtggtggctcacgcctgtgatcccaccactttcggagaccgaggcaggcagatcatgaggtcaggagatagagaccatcttggccaacatggtgaaaccccgtctctattaaaatacaaaaaaaaaaaaaaaaaattgccaggtgtggtggcgtgtgcctgtagtcccagctacttgggaggctgaggcaggggaactgcttgaacaggggaggcggaagttgcagtgagccgagatcgcgccactgcactgcagcctgggtgacagagagaaactctgtcacaaaaaaaaaaaaaaaaaaaagtaaaataaaataaagggccacctagtgtgtgattccatttacgtgaaacgtctaggccaggcacggtggctcatgcctgtaatcccagcactttgggaggtcaaggcagatggatcacttgaggccaagagttcaagaccagcctggctaacatgatgaaatcccgtttctactaaaaataccaaaaaaaaaaaaaatagccagacgcggtgccgtgtgcacctgtaatccctgctactcggaaggctgaggcagggaaacattcgaacctgggaggtggaggttgcagtaagccaagatcatactaccgcactccagcctgggtgacagagggagacttcatctcaaaataaaataaaataaaataaaataaaataaaataaaataaaataaatacgtgcaatgtccggaacaggcaaatccacagagaatagaaagtggattagtgtttgccagggactggggtatggggaatggggagcaactgctaatggggacaggatttcattctggggtgatgagtacgttttggaactagatagagggggtggctgcacatactgcgtgtactgaacgctactgaattgtacacttgaacatagtaagtgctatgttgtgtgaaattgatctcagtaaaagaaaacagtaaaaagaagatggtaattgagagggattgatttagtttgcaagaaaaaaatatattttttttacaaagatgagaaaaagcaaatacagaacaagatacaaaggtgctaacatttgtgtttattagaaagagaaagaggccaggcaccgtggctcacgcctgtaatcccagcactttgggaggcggaggcgggcagatcacatggtcaggagttcgagaccagcctggccaatatggtgaaaccccgtctctactaaaactacaaaaattagggtgtggggtgggcgcctgtactcccagctactcaggaggctgaggcaggagaatcgcttaaacttgggaggtggaggttgcagtgagctgagagtgtaccactgcactccagcctgggcgacagagcgagactctgtctgaacaaaaaaagaaaaaaaaagaaagaaagaaagaaagaaagaaagaaagaaagagaaagaggccaggtgtgacggctcatgcctgtaatctcagcactttgggaggatgagttgggaggatcacttgatcccagagttcgagaccagcctgggcaacatagtgagactctatctctaaaaaaaaaaatttttttaaattagacaggtagtatgtgcctgtagtcctagctactctggaggctgaggtgggaggattgcttaagcccaattcgaggctgcagtgagctgttatcttccccactgcactttagcctgggtgacagagggagaccctgtttttttgtttgtttgtttgtttttaattatttttacaaagaggaaatagggcaaatacagaacaatgtataaaggtgcaaacatgtgtgtttattagaaagagaaataatatattgtatatggaccctagacaggtcccccagctagaacatcaaggcaatggggtgagggtgtggctgggggcccaaggccacggggaaggttccagctttgtggcctgggttcagatttgcctgtattctttcctggtggtggggtcccagtgggcgatgtggtggctctgtgcctcagtttcctcatctgtgtaatgggatgatatcagagcctgtcttcagggtctcttgtgaggatccagcttgatctcttcctcagagctttcctgggtcctctgcggcttccctccccgctccaagcctcattcctgggcacgtggccaaactcctggcgttgtatgcaatgctttgactcccagctgcttcctgtgcttatacaaagagggctctgtccccaagccaccctggcctaggctggcccagcgcactccacacaccatagactgcaggcatctccccgtccctcctcccatctccttgtccccagccttgaccctgtgctcctgggcacaccctgcccactcctgtctccatgccttcctcgagctcatgctaatgaacatctggggtctgctggctctgggtgcacacagtcaagtcccgcctatgagggggggctccatggctgctcagaaagtcaaacggagggtggggctggcgtgactcacagtgaccttaacgggatgacagtggcagcagcggggggggacagttctgggggacattaatagtgtgacaatgtgacagcaacaggtgacaacgtcacaggaactgggaatgatgggaaggcaacaggtgacagcaacaggtgacactgtaattttaaaacccactaggggccaggtgcagtggctcacacctgtaatcccagcactttgggaggccaaggcggacatatcatgaggtcaggaattcgagaccagcctgaccaacatggtgaaaccccatctctactaaaaatacaaaaaaaaaaaaaaaaaaatagccgggtgtggtggcacacgcctgtaatcccagctacttaggaggctgaggcaggagaattccttgaacccaggaggaggaggttgcagtgagccaagatcccaccactgcactccagcctgggtgacagagcaagactgcatctcggggcgggggcggtccggggaggacaaaaaccaaaaaaagagaacatccactaggggtcaggcgcggtggctcacacttgtaatccccacagtttgggaccgaggcaggtggatcacctgaggtctggagttcaagaccagactggccaatgtggtgaaaccccatctctactaaaaatacaaaattagccagacgtggtggcaggcacctgtaatcccagctactcaggaggctaaaacaggagaatcacttaaactgggaggtggaggttgcagtgagccgagatggcaccactgcactccagcctgggagacagagcaagactccatctaaaaaaaaaaaaaaaaaaaaaaaaaggaaaaagaaaaagaaaaaaaaaaaactagatggtgatgtgtgcctgtagtcccagctacttgggaggctgaggcaggagaatggcttgaacctgggaggcggttgcagtgagctgagattgcaccactgcactccagcctgggcgacagagcaagattctgtcaaaaaaacaaaaacaaaaactttaaaacaccagatccccattggagcccccatggacctcattttactgagggtggggggaactggtgccagcatctcggatcactgagcagcatcagggcttagggtgccagatggtaatgaatggtgtcttcctggggcccgatctgcatgtgatgtgtgtgaatgtggttggctgcggcaccaccacgcttggtcactctttctgctgagcccggttgttgctgatgccagtgaattgtgatgttaagaaccctgacattctgggtaatggtatgaccatgagccggggactgtgtcacagcagaaaggtgaaggtgtaaaggtgacaggagacatgcatgtcccaggtagcggagcaaccagaaaagagcagggtgtcacatggacaggtgacaatgagacagggtcatagggacaagtgactgtagaataggaacatggtgatgatgatgatatacatacatatttagagacaggttcatgatctgttatccaggctggagtccagtggcaacatcatagctcactgcagcctcaaactcctgggttcaagcactcctcccacctcagcctcccaagtagctgggactacaggtacatgccaccatgcccagctaatttttctatttttttgtagagatggggtcttgctatgttgcccaggcttgccttgaactcttggcctcaaaggatcctccaccttggcttcccaaagtgttgacattacaggcgtgaggcacagcgcctggctgatgatgcagttttgacggagagaccatgcatgtgttttgtacagtcctgggtggggggactgtgatatgcggtaggatttaaagcctaaatgtcccttctttttttttttttgagatggagtctcgctctgtcgcctaggctagagcgcagtggcgtgatcttggctcattgcagcctctgcctcccaggttcaagcgattctcctgcctcagcctcccaagtacctggaactacaggtgtgtgcccccgtgcctggctaatttttttatttatttttattttatttattttttttttgagatggagtctcgctctgtcgcccatactggagtgcagtggcaccatctcggctcactgcaagctctgcctcccgggttcacaccattctcctgcctcagcctcccgagtagctggaactgcaggcgcccaccaccatgcccagctaattttttgtatttttagtagagacggggtttcaccatgttagccaggatggttttgatctcctgagctcgtgatccgcccgcctcagcctcccaaagtgctgggattacaggtgtgacccaccgcgcccagcaattttttatatttttagtagagatggggtttcactgtgttagccaggatggtcttgatctcctgacctcgtgatatgcccaactcggcctcccaaagcgttgggattacaggcgtgagccaccatgcccagcctaaatgtcccttcttaacagtgtgatgtaataagggtacagtggggggtgacactgtctgtgataccacatcaataactggcaataacataacagaccagggtggcaccatgggaagtctgaaactacagcacgcggtgtggacagtagcttgggttgggggctgtgaacaaccaatgcccactatctgccgttttcgagcacttcagttgcggtgacttccaacagctccacatcctggtcttgccacaccctccggcttccttctcccctctcttctggagggcaggtagggagacttctaggactgagtcgctccctggcccacagttcttccaggaaagccctcctccagacttagccatggcaacagtggctgtgcagtgtccctgggatgggacaatctctccccaccttttgcacctatgctgggctgcttctagggcacccggtgcttgtccccgtgcccatgtaagattcatttgttgcagaacaaatctgggtggaccttggcagaggagcctggaaagaggtgtccaaggtggccggggaaactggtttgtccacaatagcccctgggcccaccctccaacaggaaccccacccccctgtctctgctgggccacctccatcctggggttccctccccagtccaccctccccatgccccagcaccccacctgacccttctcacagggtccacgggcccctcccttggccaggatgactggatcttgtccctgaagtcggcgtctgtcccatgctccccgagcccagccctggggccctcaatgctccccggacacagtctaagacctggaagtggagccttgggagaacctcccctttctgtgagtccaccgtgtctcccctcagaggtggggggggagcctgctgagggctcctcggtgcttctagcctcttcttatgtttcctgctttcctcttgctccctccccttctcctctctcctaaagttccaacctcactccatccaggcatgtttgttctaagttctctccttctccaggcctttgcctgttctgtttcctccagcaaactcctatgcaactgtcaaaacctacttcaaaaatccccttctgggccagactcggtggctcacgcctgtaatctcagcactttgggaggccgaggcaggtggatcacgatgttaggagttcgagaccagcctggccaacatggtgaatccccgtctctactaaagatacaaaaaatttaccgggcatgatggcacaagcccgtaatcccagctactcggaaggctgaagcaggagaattgcttgaacctgggaggtggaggttgtagtgagccaagatcgtgccattgcactccagcctgggtgacagggcaagactttgtctcaaaaaacaaacaaaacaaaacataaacaaaatcctctccctccctgcaaattgtgagtttaccctattgaactcccaaagctgacttgctgaatatactcccaccatagcacttccggaatggagacagggtctccaatttttggagatagggtcttgctcagttgcccaggctggagtgcagtggcacaatcataactcactgcagcctcaacctcctaggctgaagcagtcctcctgcctcagcctcctgagtagctgggactatagatgcatgccaccaggcctggctaattctttttaattttttttttttttttttttttagagatggggtctcactatgttacccaggttagtctcgaactcctggtttcaagcccactgggcttacttatttattagattccggaagtactgtggtggggggatattcagcacaatcagctttgggagttcaatagagtaaactcacaatttgcggatagggagggaatttttgaactggactttgacagatgcgtaggagtttgctggatggagtaacagcttcaggcccaacgcacagcttctgacagatccccatgttaagggtctattctcaaaggtatgaaggtagtggaaaagcctagaaatttttgtttggagtactgacaacagatagggagccaaaattcttgtctggtccctttggtaggtggacaaacaggttcaaagagatttgaaagtttacaccgtttgaattgttaacctcttcattttgagaaccagatgaaaaacctgggcccttctccctgggaaatacagctttgcccaatgttttgtcaacatatttaggggcccctgatctcagcctagttaagaatccaggctccaagagccaggtgagtttccaacgtcactctcgcaattctccttgctcgagggagggggtggcggcttgggaggccctgagagggccgcccaggtgagtcccgggacttctctgcccaggctgtcgtccaggccctccaaaagtcagagccccacctccaccttagtctcgatccgaaaacgcggccccggcagcccctactaggcgcccccagcccgccctcacatccctccagtccatcggagtttttcactcggagccccggaccctcccccgagccgcagcctctctccccgccccggatcggagccccccgtccccgccccgggagctaagaggtgcaaacgcgccctcctccaactcctcccgcccccaactcccccccgagtggcagctctgggctgggaacgcggcggggtcggcctctcggctttgcgttcccgccccgggtccccggcgccgcaggagcccgccctgcagcgctgagtcccgcgcgtccgcctgccgtgcccgcctccacgcgcgccgcctcgcaggtaggtgaaggcgcggggccagcggcggggcgagatcgcgggcgctgaagggtggagaaggcgggggcgggggggccggcagggggagggggagaggattcctttgttcgcagccgggcagccccgggcccagccccctcccctctccgccttctagtggcgcccgccgcagtggggagtgggggcgcggggacccggcgggaggggctcggccggggcgcggggcccctgaccccacaggtgagggcggagccaagcgtggtcgcggccgggggccctgccgggtggagatcgcgccccgcgggctccgggggcgccccctccccgtcggcgaagcttggtatccctcgctgtttggccctcagcctccacaccccgtgccgggcgcgccttctctgctcattcattccacaaactccagggtgtggctcgcagaagcagcggtgtgtaggggggaccgaggcaaatcaggccagagactccccccacctaattcccccacccgacccgaggcagggggctggggcggagggagtgggggaggagggcttgcaagccccgaggctgcttggagtccacggagcctcagagtgcggactgacccggacaactgagaagaaaaagagggcgcccctctccagccagccaaccctccaacgttgacaggggtctctcccttctccggggcctttggacaaccaggttggcccagagaggggcgtggccaagaccacacagcagggctccccgcccattctccacctagggccggttcctttcctccctggaacctgaatggaacaggaaggccacttggtctggcttctctccctcaagtattttgcctccaccctccaaacggtcgtctcctgtcccggtcttctccctcccgtccttcatggcccaggaaagacccagccaaggggggcaggagcgagttccgttcctgatcttcttcccctccttcttctcttcgtgggcttaagctccggcttagcccctcactcatggtgtgatggccttagtttgtgcatctgtgaaatgggcacagaagcggtcccttccctgctgggcacagggttactctctgcattgggaagttccagcccctgcctgggccccctgcccagggaggcatccagccctgacctgggagcagtgaacagtcagaggaggcttcctggaggaggtgtgatgttagaaaagggtcttgcggctaagggtgcacagcccaggcaagaccggcgtgggatgtggaggcgaggggacacagggccaggtggggccaggcattgcaggagtgggggtatctgtgtcacagagggacagtggggttgttgccttccacgacttaccatcttcctcctaccctggacgctctctgggctccaccgtcccagctagaactttgggaatctcctcaatgccctccacctcccacgacatgagcctcccattcctctcctctctctcccatctggacagcccccagccttctgacaccctgtttcccccccgggaccctgctgcccttccccacaccacctaacatgcatttctgaccttgctcctcccactcaaagcttttcaagggctcttcattgtccttgacgaatgagcaaaagctgcatgacactgctatgcccactcctgcaacgcctggccccacctggccccacctggccctctctcccctcccttccacttcccactcccgtcttgccttggctgtgcaccctcagccccaagacccttctctaacatcacacctcctccaggaagcctcctctgactgttcaccgcttcccggttggggctggatgcctccttgggctcccagaggccccggggctgccccatttggcaaccaccctgccctcctcgttgtgttgggtcccccatggctagggtggggggctcatctagggctgactctgcttcctctccgcagcctccaggggacacgccatgactctggagggtctgtatttggcaaggggccccctggcccggctcctgctggcctggtcggccctgttgtgcatggcaggtggccaaggccgctgggacggggccttggaggctgcaggtcctggacgtgtgcggaggcggggcagcccaggcatcttgcaggggtgcgtggtacctgggatgctgggagaccccttcggtgtggattgggctgtcctggggccagcggaatacccggggggatgtccacacgggcaggggctcaccagacccatctcgctgtccccgaaggccgaatgtgtgcggctcccggttccatgcctactgctgtccaggctggaggacattccctggcaggagccagtgtgtcgtacgtgagtgctaccgccgtctggaggtgggggggcacaggccggggacactcttacctgcctgcaggttcagctctgtttacacggggacttagccagggacctctggctgaaccacaggaatggcccttgcatctgcgtctgtcctcagggttccaggccaacctgccatgttcatttcctttgccctacaacctccttgtgtctgtctgtctctctggttcccttgctttgtctctgcctctctctattcatctctgctcatgtctctctctgttggtttcttttctttattattattatttttagagatgggggtctctgtgttgctcaggctggtctcaaactctggcctcaagcgattttcccatctcagcctcccaaagtgctaggattccaggtgtgagccactgcacctggcctctctctgttggttactgtctctctatctaactgattctctctctctctgtttctctgagtctctctctgtttgtctctctctggcctcaccctctctttctgtttctgtctctggaatctgactccacttcccaggagacacccaacctcagtatccaggaccccagcacctccagctctgtcctcacagctcagcagctctggcccaaagagcattctctccccatggctctagcagagtccccaacccacagcctgggtcacacaccctgcccagcccagcccgagagtggggggacatcccatgaaaacaggggtggggtgtgctatgagcagagccggggatgcagatgaccagcagcgtccactgaggtgttccggccagcccggacaccaatggagcagggacggcccaggctcggtcctggtcttgactgccacccgctgcactcatccagccatctgtaggcgcgcctgcggtgaaggcttctgctcccagcccaacctgtgcacctgtgcggatgggacgctggctcccagctgcggggtgagccgaggtgagcgggaagcggcctcttgcgggagggagaagaagttcacagggttctggttgccacgaggagcctgggctgcttttgttgaaggacaggagcggggctgagcatgcctagtcctgcagccttcctaggagggcatctcggggcccatctccacattactatgcgtcctgccttcctgtccccagggtcagggtgcagtgtgagctgtatgaatgggggcacctgccggggggcgtcctgtctgtgtcagaagggctacacaggcaccgtgtgtgggcagcgtgagtatccccatgggactcccctctttgcacacctgggactgtgatcccagagtattagtctctgctgccacctgcccactgcccagggttccttcttcctggactggagattgcaggggacgtttattgccacagtctcttttttttttttttttttttgagacagagtctcgctgtgtcactcaggctggagtgcagtggcaagatctcggcttactgcaagctccgcctcccaggttcacgccattctcctgcctcagcctcccgagtagctgggactacaggtgcccgccaccttgcctgactaatttttttgtatttttagtagagatggggtttcactgtgttagccaggatggtcttgatctcctgacctcgtgatccgcccgcctcagcctcccaaagtgctgggattacaggcgtgagctaccgtgcccggcccttttttttttttttttttttttttgagatggagttttgctctgttgcccaggctggaatgcagtggcaccatctcagctcactgcaacctccgcctcccaggtttgaacaattcttctgtgtcagcctcctgagtagctgggattaaaagagccggccaccatgcctggctaatttttgtatttttagtaaagatggggtttcactatattggacaggctggtctcgaacccctgacctcaggtgatccacctgccttggcctcccaaagcgctcggattacaggcgctagccactcagctcagcctcagtcttattcaacctgggccagatcctggggattcctgggtgaagacaggcttgctgtgaaccccagctctctctgctgctgggggacctccagccatcaccctctctcctccacagccatctgtgaccgcggctgccacaatgggggtcgctgcattgggcccaaccgctgcgcctgtgtgtatggcttcatgggacctcaatgtgagagaggtaccaagcatgcgcgggtgggaggtagacaggggactcgatggaggaaagggggtttcctggaagtccctgagacatggccaggccttgaaaggaaccagctggcctccttcccgcatttggggcagtctgaggacatttctttcatttgctcatctgttctccaaaacatctgctattcactggctctgagcgagcacctgtgttggagtctggtaggaaagagagaggatgtgccagtctgaggggcagggagaagaaactgcaagcagaagattcttatctgggggtgtcaaggctaagacaagggttggggcagccctggagcatgtgaaggacagagaaaccatctgctccatggaagggagtcagggagggcttcctggaggaggggacccctcagctggatctggtagggtggactggacttcatgagatgggcaaaccccctctttattgcaccctaattctctcttttttttttgagacaaagttttgctctttcgggctagagtgcagtgatatgatctcggctcactgcaacctctgcctcccaggttcaaccaatcctcccgcttcagcctcccgagtagctgggattacaggcatccccacgctcagctaatttttgtaattttagtagagatgaggttttgccatgttggccaggctggcctcgaactcctggcctcaagtgatctgcctgtctcagcctcccaaaatgagccaccacacccagtcaccctaactcttaaaaatgatcccatttttaagacggctaagataggtggggtcacctgctgagaggttgttaccaaaattaagagggtggatgtaccaggagtttgagatcaacctgggtagcatagtgagacaccccccctctctaaaaaaagtaaaaaattagcctggcatggtggtgcatatctgtagtctcaggctgaagtgggaggattgcatgagcccaggagttcaaggctgcagtgagccgtggtggtgccactgcattccagcctgggtgacagaaccagaccctctgtctcttaaaaaaaaaaaagaaagaaagaaagaaagaaagaaaagaggccaggcactgtggctcatgcctgcaattctagcattttgggaggccgaggcgggcagatcactcgaggccaggagtttgagaccagccatggccaacatggcaaaagccatctctactaaaaatacacaaaaaaatgtaactgggtgtggtagcgcgtgcctgtagtcccagctacttggaaggctgaggcatgagaattttttgaacctgggaggcagtgagccaagatcgcaccactgtactccagcctggaagacagagcgaaaccctgtctcaaaaaaaaaaaaaaaaagaaaagaaaagaaaaaaggagaacggacacagtgatgtctttcttgtgagcagtgaggtgtggcagggacggggagagaagaaggagggagtcaggatgaacccaagacctggtgaaaactggagggaaggtagtggcgcaccctggcagggaggaggaggactctgagctcagtgttggccgagggacttgcaagttgtctgggaagcagctggacactcaggcctggggctgagatggcggcgtgggctgccccatccatggggactgaagcccagggtgccgctgaggatccccgtgagagaaggaagggccagcagagacagccacctgggcatttaagcctggacagaaaaaaccgagcccacaggaggctgagaaagagaaagagaaccggagtgggtggcgtcagggacatccaggcttgtgagattttcagatgcagaggcatctgggtgcctaatgtggtgtttcagcccaggaaggtgaggatgggcacgacccggggactagaagctggaggggctggggaagtgacctgggtttgagggtgggcttctggaaactgcagaattagaacatgggcttgttggaggcgggccaagctctgggtggcagaagagtgagggggagggggagtgggggagctgccaggaattacgttttggcttggggcatcaggacagctggggggtgggggtctctgtgaagcccctcctccttacggggcctgagttgggggtgagtttggcttcttctcttgggagcggctgcccttgtttgagagctaactcctttattggaaacatctgggagaagagagccaagaagtcacatctgggctcatgtactggggttgggggaaccaatgcggtcaccttgggctgggcctgatggggattggggatgtgatgttgggggtccagagaatttaggcagataacagatccttccccaaatctgggcgatatggcagggccaggcgtgtgctcaaggactagacatgctttttagctgggcatccgtgggtccctgcccaggcctgaagggaggataggcctggggaaggagtcccatcagttcagacagggtgttcacacaggccctgagctttattggcttggaggtgctggtctcttggaagttggtcaggaaatgctttgaagaaaaagggttttgaagggtgaataggagttcgttaggtagggaaaggggaggaaagatattctatttagtaagggagcagcataagtaaagcctggtctgtgggtgcaggggccgctgagaaggtgttagagacgcagagatctccagacaggggcagccctcagccaggtacccacatctgtctgccctgcagattaccggacgggaccctgctttggccaagtaggccccgaggggtgccagcatcagctgacgggcctcgtgtgcaccaaggcactttgctgtgccactgtgggccgtgcctggggccttccatgtgaactttgccctgcacagccacacccctgccgccgcggcttcatccccaatatccacacgggggcctgccaaggtgaatagtggggtcagggctgagtgggaggccttagctgccttggttcttccctccgatgggcctctcactcccctgccgggctttgtccttgcagatgtggatgagtgccaggctgtgccaggcctgtgccagggaggcagctgcgtcaacatggtgggctccttccattgccgctgtccagttggacaccggctcagtgacagcagcgccgcatgtgaaggtgggtgactggagggggacaacctgagacctcctctgtgactcatgacctggggggctcaggctcccctgcaggaaggcagaggggtcaggctggtgaggtgcccagttctgaccttgtccctgtttatgtagatgtgaatgagtgtctcagcctgtccggcctctgttctgggggtgactgcaccaacactgtcgggagctacgtgtgcacctgttcccaaggttttgccagcagcctggatggcacccactgcctgagtgaaccgaggggctggagcgggagagagtgggtaggagagagaccccttgttcagctgtctgtctctctcttttttttttttttttttttgagacagagtctcactctgttacccaggctggagtgcagtggtgtgatctcagctcactgcaacctctgcctcccagttcaagagatcctcctgcctcagcctcccaagtagctgggagtacaggcgcacgccaccacgcctagctaatttttttttttttttttttttttgagacggagtctcgctctgtcgcccaggctggagtgcagtggcgcgatctcggctcactgcaagctccgcctcctgggttcacgccattcccctgcctcagcctcccgagtagctgggactacaggcgcccgctaccacgcccggataatttttttgtatttttttagtagagacggggtttcaccgtgttagccaggatggtctcgatctcctgacctcgtgatccgcccgcctcggcctcccaaagtgctgggattacaggcgtgagccaccgcgcccggctggccaactccagactttctaggtctccaccactgggggccatcacagctggcattgggggtagctgtggatacatcccctggactgcggggggtcctctctcagctgctaaagaccagtccttggattggacaaaccagcctctgaacataggctttggaatcagtctggggctcccacccagagctgctcacagaccctgtggccttgggcaagtgacttaaccgctctgtgcctcagtttccccatctgtaaaatggtagataatagcagtacctagctcaatgaagattgagtaagatatcatttggggagtaatttgcagagggctggtacctagaggatacttaatacacattcatggacaccaggtaatgttggggctgtggccacttagctcacagtatgtacttacagcaatgacaggatcatttttgttaaaattcttttaacacattcttactctgtcccccaggctggagtgcaatggcacgatctcggctcactgcaacctccgcctccggggttcaagtgattctcctgcctcagcctccccagtagctgggattacaggcacccaccaccatgcccggctaatttttgcatttttagtagagacggggtttcactgtgttggccaggctggtctcaaactcttgacctcaggtgatccacccgcctcagcctcccaaagtgctgggattacaggcatgagccactgtggctgagcatttttgttgaaattcttatattctgtctctcttgcttgagggactgttgcctgttgggtcccctgagattgggaaatcgagtttcccgtcctcctcttgcttttgcagctgtgtgactttggaggagtctgttgatctctcctcgtctgggcaggcccagtcccctttgaggggctatgataaggctgagaacgaaaaaccctgactcccacgcacgtacctggggggcccccaggtgcaaggggaggggaccagggaggtagaaacatttgcatgttttcccagctcggggcaggtcaggggtggctctcagtggccctcccagctgctgggaggagttttttaaactgtgggccaccagccaaggtttgtgcatttttaagcctaaaaatatgctctttaagccagagcctgagaaatctgatcgctgcataaagccattgaccttgagggcgcagtgggaagtggaagagtgttggtggttctcatacctggggagcctgtctgcctcagtcaccccgggggctgtagccgtcaatccacccctcgactccttggggcccctctctgaaattcacagtctcgtaggcttctgcataatgcctgaagccagcaagcaaagacacacagctgcagatctccgtgtccctgcctggtatcccactggggtagtccttccccgccaatgggtcttccttagtgtggttggatgcctgcagcgacggggagctcactacctctgtgcgataacttggaatcttggtaacaagagatggcactgagcgagcattggccatatgtcaaacttttctatttatttatttatttatttttgaggcggaatcttggtctgtggcccaggctggagtgcagtggcacaatcttggctcactacaacctctgcctcccaggttgaagtgattctcctgcctcagcctcccaagtagctgggattacaggtgtgcgccaccgcacccggctaatttttgtatttttagtagagactgggtttcgtcatgttggccaggctcttcttgaactcctgacctcatgatctacccgcctcagcctcccaaagtgctgagattacaggcgtgagccactgcgcccggccctttattttttttgagacggagtctcgctctgttgcccaggccggagtgcagtggcatgatctcagctcactgcaatctttgtctcctgggttcaagcaattagtgattctcctgcctcagcctcccaagtagctgtgattacaagtgcctgccaccacccttggctaatttttgtatttttagtagacatgaggtttcgccatgttggtcaggctggtcttgcactcctgaccttaagagatcctcccgccccagcctcccaaagtgctgggattacaggtgtgagctactgcatctggactatgtcagacttttcatccaggtaatacttttcccgggtgaggtggatgctccaagcatccccattttatggagaggaaactgaggcacagagcggcaaacagacccgtcctacaggcagtgctgctacagctggaatttggatccaggtctggtcactgatgtcctgtgctcatgggctcaccctctgatcttttgcagactaccgggccggcgcctgcttctcagtgcttttcgggggccgctgtgctggagacctcgccggccactacactcgcaggcagtgctgctgtgacaggggcaggtgctgggcagctggcccggtccctgagctgtgtcctcctcggggctccagtgagtaagagctgcagcctgcagggctgtgggtgaggaggggacaggggagggccaagggcctggcctcaaccctgcttccttgcagatgaattccagcaactgtgcgcccagcggctgccgctgctacccggccaccctggcctcttccctggcctcctgggcttcggatccaatggcatgggtccccctcttgggccagcgcgactcaacccccatggctctgatgcgcgtgggatccccagcctgggccctggcaactctaatattggtgaggcctggggcttgggaggaacattccaagacttgaaggatggtcctggatctggggagagagctccaaacaggggacggtgtccaggcctcagagagagggttagggctttggagggggaactcctggcctggctagtagggatgacagtgctagtagtggatggggatggaggtaactggagaatctggtcctcagagttaggttttgggctggacacagcgactcatgcctataatcccagtactttgggaggccgaggtggaaggatcacttgaggccaggagttcgagaccagcctgggtgacatagcaagaccctgtctctacagcaaattgaaaattagctaggtgtggtgatgcccaccagtagtccctgccactcaggaggaagaggcaggaggattgctggagcccaggagttggaagctgcagtgagctgtgattgtgtcactgccctccaacctgggtgacagagtgagaccctgtctctaaaaataaataaataaataaataaataaataaataagtcagagttcgggctttgggtggggagtttgggcctggtgtgggggtctgtcatgtaggatttaggcctggggtgggttcttgccccataatgaggatttgggcccagagtgggagtctgggcatctctgggaccaggttagagggatctaggctccagattgaagggatctaaggctccattttggagggatctaggccccaggttggagggatctaggctccaggttggagggatctaggctccaggttggagggatctaaggccccaggttggagggatctaaggccccaggttggagggatctagggcccaggttggagggatccaggtcccaggttggagggatctaggcttcaggttggtgggatctaagccccaggttggagatatctaggccccaggttggagggatctagaccccaggttggaggaatctgggttccaggttggagggatctaggcaccaggttggaggaatctgggttccaggttggagggatctaggcaccaggttggagagatctaggccccaggttggagggatccaggtcccaggttgaagggatcgaggtgccagtttggagggatctaggcttcaggttggagggatccaggccccaggttggagggatccaggccccaggttggaggtatctagaccccaggttggagggatccaggcccaggttggagggatccaggccccaggttggagggatccaggcccaggttggagggatccaggtcccaggttggagggatccaggccccaggttggaggtatctagaccccaggttggagggatccaggcccaggttggagggatccaggccccaggttggagggatccaggcccaggttggagggatctaggtcccaggttggagggatctagatcccaggttggagttctgaatctaaggcaggactctccatgagaaagagggcaggatctgagccagggcagggtcccagccttagagggggtatctgggcctagagaggtgaagcccaggctccagactggggcggggccagccactgctcagatgcctctgccggccccacccgtaggcactgctaccctgaaccagaccattgacatctgccgacacttcaccaacctgtgtctgaatggccgctgcctgcccacgccttccagctaccgctgcgagtgtaacgtgggctacacccaggacgtgcgcggcgagtgcattggtgagccgcggccaggtggaagggggggcggttctcactgccctgctcgtgctagggctcagggtcctctcccctcagatgtagacgaatgcaccagcagcccctgccaccacggtgactgcgtcaacatccccggcacctaccactgccggtgctacccgggcttccaggccacgcccaccaggcaggcatgcgtgggtacggctgtccatccaagagtaggggtgatgttgttgggggttctggcccaggcttggagggtggggagcacctcttgactgcccgcctgccttccccgcagatgtggacgagtgcattgtcagtggtggcctttgtcacctgggccgctgtgtcaacacagagggcagcttccagtgtgtctgcaatgcaggcttcgagctcagccctgacggcaagaactgtgtgggtgagttgggggtgggcgggtgggcaggggcttccgggccccactagctgccttttacagccacctcaaatcttcactgtgcccccaaacccacctccctccctacgacgtctcctctgctcacctctgaacccagcagcccacctgagactcttcttatcccctgaccaccctgactctccccttcatttcctccttcctgaatttattccgtgaatcacaaaaaaggaccttttggagccagtcttggtgccttatgcctgtaatcccagcactttgcggggctgaggcaggagaatctcttgagctgaaaaggttgaggctgcagtgagctgtgatcgtgcccctgcactccagcctggctgatagagcgagactccatctcctaaaaaaaaaaagaagtccgagtgtagtggatcacgcctgtaatcccagcactttgggaggccgaggtcaggagttcgagaccagcctgaccaacacggtgaaaccccatctctactaaatacaaaaaaattagctgggcgtggtggcagacacctgtaatcccagctactcgggaggctgaggcaggagaattgcctgaacccaggagacggaggctgcaatgagccaagatcacaccactgctctccagtgtgggtgacagagagagactcagtctcaaaaaaaaaaaaatttttttttatgccaagcttggtggctcacaactgtaatcccagtactttggaaggcaggaggatcgcttgaggccaggagttcaagatcagcctgagcaacacagcaagaccctgtctctacagaaaacccaaaaattagcctggcatggtggcaggtgcctgtagtcccagctactcaggaggctgaggcaggaggatcacttgagcccaggagttcggggctgcagtgagctgtgattgcatcactgcactctagcctaggtgacagacctagaccttgtttcaaaaaatatatatatatatatgtaaaatatatatatttatatttatttatatatttattcatttattcattttgagtctctatctcccaggctggagtgcagtggtgccatcttggctcactgcaacctctgctgcccgggttcaagtgattctcctgcctcagcctcctgagtagctgggattacaggtgtgcgccactgtgcccggctaacgtttgtatttttagtagagatggggtttcaccatgttggccaggctggtctcgaactcctgacctcaggtgatccgcccgccttggcctcccaaagtgctgagattacaggcgtgagccattgcgcccggccatgtatttatttttttgtgattgggtctcactgtgttgcctaggctggactttaactcatatcccagcagacagactaatatgcaagcaaacacagccacagacaaccacagcttctttgcctcccacaccccagggaggggccctggggggctcaagcaatgtccccgcctcagccacttgagtagctgggactacaggcatgagccagcatacctggcttcttcattctttttcatggccgaataatgttccattacatgaatagaccacagtgtgtcgatccattcagtaggacactggttcgttttcactttttgctgttaggcataatgcttctgtgaatgctcatgtgcatatttttgtggtggcatttcatgcatttatttattttatttatttatttattttgagatggagtctcactctgtcacccaggctggagtgcagtggcgtgatcctggctcactgcaacctccacctcccgggttcacatcattcccctgcctcagcctcccgagtaactgggaccacaggcacccaccaccacgcccggctgattttttttttctttttttttttgtatttttagtagagatggggtttcaccatgttagccaggatggtctcgatctcctgacctcgtgatctgcccatctcggcctcccaaagtgctgggattacgggcgtgaaccaccgcacccagccacatttttttttttaaatgtatgttcagtcctttattgtttaaaactgacattttggaaaacaactcatttctgcccctgccaccttccattaaattagaccatggtcttactaactttatttccatttcctttttatgaaattgaagtaagattcacacaacctaaatttaatcatttaaaagtgaacaagaggttgggcgcggtggctcacgcctgtaatcccagcactttgggaggacgaggcgggcttatcacgaggtcaggagttcaagactagcctggccaacatggtgaaaccccgtctctactaaaaatacaaaaacaattagccgggcgtggtggtacatgcctgtaatcccagctactcaggaggctgaagcaggagaatcgcttgaacccgcgaggcggaggttgcagggagctgagatcacaccactgtgctccagcctgggcgacagagcgagactctgtctcaaaaaaaaaaaaattgttgtcttttaaaaaatatttaaacattttaaaatgaacaattcactgatatttaataaatttccaatgttgtgcaaaaaccaccacgtttattcagctttgagcaattatttatgcagcacctactgtattgcagcctgagtaagacaggggtcgtgccccggggaactcaacgtcccagcggacggactaatatacaagctcacacagtcacagacaaccacagcttgtttgcctcccacactccagggagggatcctggggggtcagccctggagcctggaggagggagagagagggtcccagtgtggtccctgcctggacccagcctctgctgttgtccccagaccacaacgagtgtgccaccagcaccatgtgcgtcaacggcgtgtgtctcaacgaggatggcagcttctcctgcctctgcaaacccggcttcctgctggcgcctggcggccactactgcatgggtgagcctggagccagactggccagcggaggggagaagggagatggggaagcagagggacggcgaggaagaggagagggaccggacggggatgggacgagcatgagagaaggagaagagaaggggcagggagaaaaagaggaggaggagggaaaaggggagaagcgaagaagaagaaaaggaagaaaagaagaggcaggtgccgtggctcacgcctgtagtcccagcaccttgggaggccgaggcagatggatcatttgaggtcaggagttcaagaccagcctggccaaaatggtgaaaccccatctctactaaaaatacaaaaattagccaggtatggtggtgggcacctgtaatcccagctacttgggaggctgaggcaggagaattacttgatcctgggaggtagaggttgcagtgagccgagatcgcgccattgcactccagcctgggtgacaagagtgagactccgtctcagaagaaaaaaaaagtgatgcattataaggtggggaggggccaggttcatctgtgatcccagcactttgggaggctgaggttagaggatcacttgaggacaggagttcgagaccagcctgagcaacatagtcagacgccatttctacctaaaaaaaaaattagctgggcatggtagcatgcacctgtaatcccagcactttggaaggctgaggcagaaggatcacttgagctcaggagtttgagaccagcctgggcaacatgatgagactccgtctctataaaaaatttttaaaaattagccgaacatggagatgaacccctgtagtccctcctactcgggaggctgaggcagcaggatcacttgagccctggagttggaggccgcagtgagctatgatcacgccactgcactccagtctggaagtcagaccctgcgtttaaaaaatttgtttaaaggtggagagaaagatagaaagatggggaataatgggagaggagaagaggaaggagacaagaggaggagaggacagagacacagacaacaggaaactggaaagacaagaaactggaaaggaaagaaatagaatggctgggaagatggaaatgttgggagatggggaggggagagaggaagggagcacgctggaacccatccccgtgccgccactgcttctgcagacattgacgagtgccagacgcccggcatctgcgtgaacggccactgtaccaacaccgagggctccttccgctgccagtgcctgggggggctggcggtaggcacggatggccgcgtgtgcgtggacacccacgtgcgcagcacctgctatggggccatcgagaagggctcctgtgcccgccccttccctggcactgtcaccaagtccgagtgctgctgtgccaatccggaccacggttttggggagccctgccagctttgtcctgccaaagactccggtgagcatccggctgcccggtccccatcgcctccttggtctgaatgcctccatcggttctcgcttctggtggggggtcatggctgccatggagtgggggctcttcccaaaaagaggctgaagggagttgctccctccccggggttggagttgtgtcttagtcccaaactcttgcccaagaccagagggcctcatccttgcctgtggctgaatccgagccatggctaagctccctgacccgtctcactctgtccctccatccccagctgagttccaggcactgtgcagcagtgggcttggcattaccacggatggtcgaggtaagtggagcccagcccctccaaacagcagccagcctgcccctaccagatgtggggagagctgtggtgggaggctgtaggagttggcccggggttcccgtaacaaagtgccccagaccagacggcttcaacaacagaagctgattctctcacactcctgcaggccagaggtcggagatcaaggtgcgggcagggctggttcccttggaggctttgagggagaatctgtcccggacctctctccagcttctggtggtggctccagcaatctttggcatttcttggctcatagaggcgtcaccccatctctgcctccatcttcacatggtgttctccctgtatgcgtgtctgtgtccaaaactccccccacccttttttagaggtgagatctcactctattgcccaggctcgagtgatgtggtgcaatcacggctcactgcaaactcgacctcttgggctcaagtgataccacctgagtagctgggactacaggcactcaccaccatgacctgctcatttgtttttcttccttttcttttcttttcttttcttttcttttcttttcttttcttttcctttcctttcctttcctttctttctttctttctttctttctttctttctttctttctttctttctttctttctttcattctttctttctttccttctctctctctctctctttctttctctttcttttctttctttctttcttttttttttgacagagtcttgctctgttacccaggctggagtgcagtggcgtgatcttggctcactgcaacctccacctcctgggttcaagcaattctcctgcctcagcctcccaaatagctgggattacaggcatgcagctccatgcccggctaatttttgtatttttttttttttagtagagatgagattttgccatgttgcccaggcttgtctcaaacttctagcctcaagtgatccacccaccttggcctcccaaagtgctgtgattacagacacgagctgccatgcccagccaatttttaaaacatttactttatggccagatgcggtggctcacgcctgtaattccagcactttgggaggctgagggaggtggatcacttgaggtcaggagttccacaccagcctggccaacatggtgaaaccccatctctactaaaaatagaaaaattagccagccgtggtggcaggcggctgtaatcccagctacttggggggctgagtcatgagaatcacttgaacgagggaggtggaggttgcagtgagccgagatcgcaccactgcactccagcctgtgcgacagagtgagaccctatctcaaaaaaaaaaaaattgctttttatagacatgggtctcgctatgttgcccaggctggtctcaaactcctgggctcaagcaatcctcccacctcagcctcccaaagtggtgggattataggtgacagccatcatatctggcctataattgcttttatttttatgacagtgccactgtatggatgtctgctccactatttccaaactggagataatttggcccctgccccaccgaggtcatttgacaatgtctggagtaatactggggcggtgggtgctactgacatctcatgggtggaggccacgggagctgctcgacatcctaaaatgcgtgggatggcccctcacagcaaaaaatgatctggccccaaatgtcagcagtgtccaggctgagaaacctcggtttagagcagaatgaggccgggtctgggctggagctatggccttggggaatctgacttctagagacccctggtgcgccgcgacacaccctcctcctgcctcggacacaccctccttctgctgctgctgacacaccctcctcctgccgcagacatcaacgagtgtgctctggatcctgaggtttgtgccaatggcgtgtgcgagaaccttcggggcagctaccgctgtgtctgcaacctgggttatgaggcaggtgcctcaggcaaggactgcacaggtgagcatgccacctggcgggcggatgtgtgggcagcctctcccactgcagacccctcacccctctctcccacccccaccccacagacgtggatgagtgtgccctcaacagcctcctgtgtgacaacgggtggtgccagaatagccctggcagctacagctgctcctgcccccccggcttccacttctggcaggacacggagatctgcaaaggtactgggtcccgggctcacgtgggtttgcacacacacatatgctccaacatacttggcatgtggcgtgtgcacgcacaggcatgcacacgctcaaagatgcttacatgttacctctattcacacacgcatgctatatgtagtgtgcacacacacatatatgcacacgctcagatactcacatgttgcatgaggtgtgtacacaagacacacatgcacacgctcagaaacatcctgtacacaaccacactcagacatgcacgttgcatgtgtcatgcatacatacacccagacacgctgcacatgccgtgtatacacagacacacattcagacatgctgtgtgcatgtgtacacagacatgcatactcaaagacacttgcatatgtacctacattcacacatacacactcaaagacacatatatactcacatttacatacacacgtattctttttttttttttttgagacagagtcttgctctatcacccaggctggagtgcagtggcacgatctcagctcactgcaacctctgcctcctagttcaagcgattctcctgcctcagcctcccaagtagctgggattacaggcgtccgtcaccaagcccagataatttttgtatttttagtagagacagggtttcaccatgttcgccaggctggtctcgaactcctgacctcaagtgatccacctgcttcagcctcccaaagtgctgggattataggcgcgagccactacacctggcccatacactcattctcacacttcccacacttgcagtcccagtcacacatggttgtacacactcaggggcacacagttatacacacatcccagaagtcctactcgaactacagagtttggagagcttctaggtggatggacatatctgtgtgctggcagggcggcatgccgagagcaggcacggaagttccacatctcctcccagataccctgcaccgtgcatctcttccatctggctgttcatcatttgtaatatcctttattttttttattttatctttttgagacagagtctcgctctgtcacccaggctggagtgcaatggggcgatctcggctcactgcaacctccacctcctgggttcaagcaattctcccgccgtttaagagattatcctgtctctgcctcccaagtagcccggactacaggcgtgtgccatcacgcccagctaatttgtatttttaatagagatggtgtttcatcgtgttggccaggctggtctcgaactcctgacctcagtgatccacccgcctctgcctcccaaagaggtgggatgacaggcgtaagccacagcgcccagcctgtgatatcctttataataaactagtaaacgtaagttaagtatttccctgagtcctgtgagcccctctagcggatgatcaagcccgaggagaaggcagaaattctggaggccccgatttgcaactggcatctggtgtggaagacagtcttgtgggactgagccctcaacctgtggagtcagactttaactccaggcagaaagcgtcagaattgaattatagggcaccctgctggtgtcggagaattgggcagcttggcaaaagcaaacaaacaaaaaaccccatgtctgatcactgatgtattctgtgttgtgttgaaggtgagagtaagaatacagttttggctgggtgcagtgactcacgcctataatcccagcactttgggaggctgaggcgggcggaccacctgaggttgggagtttgagaccagcctggccaacatcatgaaatcctgtctctactaaaaatacaaaaaaagttagccaggcatggtggcacatgcctgtagtcccagctacttgggaggctgaggcacgagaatcgcttgaacccgggagacggaggttgcagtgagccgggatggtgccactgcactccaacctgggtgacagagcgagactctgtctcaaaaaaaaaaaaaaaacaaaaaaaaaacagtttggcatttcctgtctcttacagcatgtacacacacagctcagcacacacatgtgcttgcatgcacatttgattccagtgccctctgcatgcttgtgcatctgggtgcaccccgtgccaccggttgcggcggccccttggggaggaggggtcctggccaggtaaggcaactcctcctgcagctcaggacctggtggggggctgtccccacagatgtcgacgaatgcctgtccagcccgtgtgtgagtggcgtctgtcggaacctggccggctcctacacctgcaaatgtggccctggcagccggctggacccctctggtaccttctgtctaggtgagcggccccggagcccgacggcgttccagaggctgggcgtctatgggtcagggtgcaggtgtagggccggcaggtgagacaggtgacccgcctcttctccccagacagcaccaagggcacctgctggctgaagatccaggagagccgctgtgaggtgaaccttcagggagccagcctgcggtctgagtgctgcgccaccctcggggcagcctgggggagcccctgcgaacgctgcgagatcggtagtatcctccttgaggcctcccaggcacccatgggaaaagccctccatggggcgggtccccccttgggctggcatgagaaaatgactcctctcttcactcttgttctcccagttgcagaccctgcctgtgcccggggctttgcccggatgacgggtgtcacctgcgatggtaactgcctgcccgtgtccagctcaccccctactccagagcccgcacacaaccaggcgcaccaccctcatgggtgccacctccggccccgccctggagtcttttgcgatggggacagacgttctccctacctggtccccaggccttcttgaaagtccccagtccccgtgtccccgtccccttccttcctcctcaaggacaacttgagaccccaggggaatggccagccagcacccttcccctccctggaccctccggctttccctcctccttacccagatgtgaacgagtgtgagtccttcccgggagtctgtcccaacgggcgttgcgtcaacactgctgggtctttccgctgtgagtgtccagagggcctgatgctggacgcctcaggccggctgtgcgtgggtgagtccaggcgaggtccgcatacagggccacacgttcttcctttgttccctccacccgcagtgacttgaggaacaggagagatttttttttttttttttgagatggagtctcgctctgtcgcccaggctggagtgcagtggcgcaatctcggctcactgtaacttccgcctcccgggttcaagcgattctcctgcctcagcctcctgagtagctgggattacaggcacataccaccacgcccagctaatttttgtatttttagtagagatggggtttcaccatgttggctaggatggtctcgaacttctgacctcaggtgatctgcccgcctcggcctcccaaagtgttgggattacaggcgtgagccaccacgcctggcctgaacaggagagatttcaggcatcctttgggatcctctgcctctggctaacatatcatgaaagacatttgggtgggtttttttttcttttttcttgagacagggtctcactctgtcacccaggcaggagtgcagtggcgcaatctcatctcactacaacttgcacttcctgggttcaactgatttttgtaccttgatctcctgagcagctgggactacaggtgtgcaccaccacacccgctaatttatttatttattggtatatctatatatatttttgtagggacagggtctcactctcttgcctaggctggtctcaaactcctggcctcaagggatccccctacctcagcatcccggagtgctggaagtccagccaggatttatctttgaggacagtattaggttcacagcaaatatgaacacatagcccccacctccacacacgtacagcctccccaactctcaacatcttgcactggggttagaaggtgcatttgttacgatggatgaaactgcacgggtacagcattgtcatctctaagtccatagagcaccttagggtttacccttggtgtattggacattctatgggtttggacgaacgtataatgacgtatgttcaccattgtagtgtcatacagggtagtttctctgccctaaaaatccttagtggccgggcatggtggctcacgcctgtaatgccagcactttgggaggccgaggcaggtggattgcttgaggttaggagttcaagaccagcctggtaaacatggtgaaaccccatctctactaaaatacaaaaattaggtgagcgtggtagcggtgtctgtaatcccagctactcgggaggctgaggcaggagaatcgcttgaacccgggaggcggaggttgcagtgagctgagattgtgccgctgcactacagcctgggggacagagcaagactccgtctaaaaaaaaaaaaaaaaattggccaggcacggtagctcacacctgtaatcccagcactttgggaggctgaggcgggcagatcacttgagttcgagatcagcctggccaacgtggtgaaaccgagtctctactaaaaaataacaaaagtcagccgggtgtggtggcacacacctgtaatcccagctcctcgggaggctgaggccggagaattgcttgaacctgggaggtggaggttatggtgagctgagattgtgccactgcactccagcctgagtgacagagcaagactatgtctcaaaagaaatcaatcaaccaatgaatcaatcacgtaaaaaaaatatggatagaggggcttagaacagtgctacagaacagtacacatagtaccctcccagacagtgcctggaggaagtcacccctttccactctggccctcgacctgactacgtccgggagaaagtttccgatgggagtgactgagcggcacgcctgtcccgcagtgggcacagtgtggcaggggtggggacgcagtgactgtcccccgtgcagatgtgagattggaaccatgtttcctgcgatgggatgaggatgagtgtggggtcaccctgcctggcaagtaccggatggacgtctgctgctgctccatcggggccgtgtggggagtcgagtgcgaggcctgcccggatcccgagtctctggagttcgccagcctgtgcccgcgggggctgggcttcgccagccgggacttcctgtctggccgaccattctataaaggtgcggttggggaaggggtcaggcccctggaaggatggggaggggcacggcataggcaaaagcctggagatgggaagtgtgtttgggggaaaaggggatgtgggtaaggcgaggcactaagaacccagggagggcttggtgtatggatcctgagcttggggacgtcagggtggtttgatgcccctgtacttcagatgtgaatgaatgcaaggtgttccctggcctctgcacgcacggtacctgcagaaacacggtgggcagcttccactgcgcctgtgcggggggcttcgccctggatgcccaggaacggaactgcacaggtaggtgccacctctgcctcttggagagagcgtgatccttggcagggataggggcctcaaataagacgtagagacaacacctgttctttttcttcttcttttttttttcgagacggagttttactcttgttatccaggctggagtgcaatggcacgatctcggctcactgcaacctccgcctcccaggttcaagcgactctcctgcctcagcctcctaagtagctgggattacaggcatgtgccaccatgcctggctaattttgtatttttcagtagtgatagtgtttctccgtgttggtcaggctggacttgaactcccgacctcaggtgatccgcccacctcggcctcccaaagtgctgggattacaggtgtgagccactgtgcctggcgaacacctgttctttgggcacttcttgtgtctgcctctgtgctgtgtgacctagggcaggtgattgccctccttgggctgcagggaccctgactataaaagaaggggctgggctgggcgcggtggctcacatttgtaatcccagcactttgggaggctgaggcgggcggatcacgatgtcaggagatcgagaccatcctggctaacacggtgaaaccctgtctctactaaaaatacaaaaattagcccagcgtggtggcaggcacctgtagtcccagctactcgggaggctgaggcaggagaatggcgtgaacccgggatgcagagcttgcagtgagctgagatcatgccactgcactccagcctgggcgacagagactccatctcaaaaaaaaaagggggcgctgggccaggtgcgatggatcacacctgtaatcccagcactttgggaggccaaggcagatggatcacttgaggtcaagagttcgagaccagcctggccaacatggcaataccccgtctctactaaagatacaaaaattagctgggcctggtggcgggcgcctgtaatcccagctactcgggaggccgaggcaggagaatcacttgaacccgggaggcggaggttgcagtaagccaagattgtgccattgcactccagcctgggtgacagaacgagactgtgtctcaaatataaataaataagtaaataaaacataaaagaaggggctggcaaaggtgacctttagaggcctccagggccagcatggtggctcacgcctgtgatcccagcacttttggaggccaaggtgggaggattgcttgagcccaagagtttgagactatcctgggtaacacagcgagacctccatctctgcaaaaaataaaaaaattattattgcattaactgtagtcccagctattcgagaggctgaggtagaaggatcccttgaggccctgggaggttgaggctgcagtgagctgtgatcacaccactgcactccagcctgagtgaaaaacaaacaggccaggctcagtggctcacacctataatcctagcactttgggaggccaaggcgggtggactgctttaggtcaggagtttgagaccagcctggccaacatggcgaaacaccatctctactaaaaatacaaaattagccgggcatggtggcacacacctgtaatcccagctactcgggaggctgaggcaggagaatcgcttgatcctgggaggcagaagttgcagtgagccgagattgcatcactgcactccatcctgggtgacagagcaagactctgtctctaaaaaagtaaataaataaataagtaataaaaataaaataaaataaaacaaacaaacaaatctaccatcaaaataaagaaaatggagaactcccgtctgtgagaaaactgcctgcccttgtcatgtttagtttggggttcctccatttcctcggctccttttgggggcttctgttctgcctgtcatatctacagattcgatgaccccatacggcaccccatcatgcctgcatcatgcctcccctcttggcctgtgcctccttatgtctgcagatgggcttcctctagcccacacctccatcaaaggacagggacccccctgcctcgtgccccatgatgcggcccacatggcgcctccggcctctgccccctctccccacagatatcgacgagtgtcgcatctctcctgacctctgcggccagggcacctgtgtcaacacgccgggcagctttgagtgcgagtgttttcccggctacgagagtggcttcatgctgatgaagaactgcatgggtcggtgactgccgggcaggggtgtggtgggcgccctgggcagggagggcattgaggagagggagggtggggacggctgttgctgtgtggacgtggatggagggggcaggaggagggaggagctgtaaattagctgaggtacagtgagtctgggctccatgaggcctcgtccttaggagagagacctggggcctgagacctgggggtggccggcacactggggtgtggtctcccagggagggtgtgtagcttgggtagaggacagggaccctcagagaagcctgggaaatactgccggttatgaggcctctcgtccccatcattgacttcgttattcatttgatgagcatttcacatgcatcctctgagctagaggcactgcagggagctctagctccagggagccctctttccttggagctcacagcctaacaggaagacagacatgaataacatgaatcgctgaggaaatgcaaaactgggctgggtgcagtggccctcgcctgtaatcccagcattttgagaggctgaggcagtaggattgcttgagtccaggagttcgaggccagcctgggcaacataacaagaccctgtcactataaagttttttaaaaattagctaggcatggtggcgcgtgctactcgggaggctgaggagggaggatcccttgagcccaggaggttgaggctgcagtgaaccataatcgcacttttgcactccagcctgggtgacagagtgagaccctgtctaaagaaaaaaggaaggaaggaaggaaggaagaggaaaaagccaggcatggtggctcatgcctgtaatcccagcactttgggaggctgaggtgggcagattgcctgagttcaggagtttgaaaccagcctgggcaacatggtgaaaccccgtctctattaaaatacaaaaaattagctgggtgtggtggcgtgcacctgtaggtccagctactcaggaggctgaggcaggagaattgcttgaacccaggaggtggaggttgcagtgagccgagatcgcgccactgcactccagcctgggcgacagagcgagattctgtctccaaattaaaaaaaaaaaaaaaagaaagaaagaaagaaaaagaaaagaaaagaaaaaaatgcaaaattgccactgtcagaagcccttaaaagggccacatgatctgatgagagatggctgagacaggattgcttgagaccaggagtttaagaccagcttggtcaacatagagaggccccgtctctacacaaaatttaaaaattagccgggcatggtggtgcctgcctgtagtcccagctactcaggaggctgaagtgggaggatagtttgaacacaggaggtggaggctgcagggagctgtgatcgtgtcactgcactccaggctgggtaacagtgtgaaaatctgtctcaaaaaaaaaaaaaaaaaaaaaaaaaggctgggctcggtggctcatacctgtaatcctggcaatttgggaggctgaggcaggtgaatcacttgaggtcaggattttgagaccagcctggccaacatggtgaaacgctgtctctactaaaaatacaaaaattagctgggcttggtgatgcatgcctgtaatcccagctacttgggaggctgaggcaggagaattgcatgaacccaggaggcggaggttgcagtgagccgagatcgtgtcactgcactccagcttgggcaacagagcgagactccatctcaaaaacaacaacaacaaaaggaaagaaagaaagaatggagtgggggtgaaaagggtgaagacactggagaacagcatgtgcaaaggccctggggtgggcctgagggatggaaggatgatgcctctgtggctgaagagtgatgaggccatggcgaggctgcctgctccctgccctgagtcctggcgggactgagcctcagctttctggcgtgtcctgcagggagtggaggaaggcctcttagtgccgtttctagtggccccaagagtgtcagcttcgtggcctttgttcttctgagaatctcagcctccctccccatctggctggtctctgctcctggtgcagaccccactcccctgggtcatcccaacccggagcctccaggctctcctggctcccgctggggtgaagggggctggggaggtggcggagagaagccagcatgagcctcatcaccccctccctgcatcagcaccttcatgcctgctctctctttccacacaaaccttcagacgtggacgagtgtgcaagggacccgctgctctgccggggaggcacttgcaccaacacggatgggagctacaagtgccagtgtccccctgggcatgagctgacggccaagggcactgcctgtgagggtaagtgtgcatctgggtgtgcaagtgtgagtgttagcccatgtgtgtgaaagtgagtggatgtctggtgaatgtgggctggatgagtgagagggtgggcatgtgtatctgtctttctgaggccatacctatgtgtgagcgtgcaagtgtgtgtgtgtatctgtgtgtgtaagtgggtttatatgcaagatggcgggagtgtgtttgtgtgtctagatgaacacgcacatgtgtgagtgtctgtacaagggcaagcgtttgtgcatttgtgtgactgtgtgtctgtacaagggggagtgtttgtatgtgaggagtgagtgtgtgtgtgcgtctgtgtgaacacacaagagggtttgagtgtgtatttggctatgaatgtctctaccaagggcaagtgtgtttgcatgtgcgtaggtgtgtttcattttgttttgtttgagacagggtcccagtctgttgtccaggctggggtgcagtggcacaatcacagctcactgcagcctccacctcctgggctcaggtgatcctcccatctcagcctcccaagtaggtgggactacaggcatgcgccactatgcctggctaatttctgagtgggtgtgtttgtacgtaagtctgtgtgtgtgtgtgtaagagaatgtgatgtgtagttggatgcaaatgcatgtttatagaggtgtgtttgtgtgtgagtgggtgtgagaatgtgtttgagtgggtctgtgtgggtgtacctctgggtgtgggtgtctgggtgtggacatgtgtttgcacaaggacaggtatgtttgagggtgtgtttatgtgtgtgtctgtgtgagtgtgcacatgggtgtgtgtgtatgtgtgagtgtgcattgggtgtttgtgtgtctgtgtgtgcacatgggtgtgagtgtgcccctgggtgtggatgtgtatttacacatgggtgagtgtatttgtgtgcaagtggatataaggtgtgttgtgaatttaggagtgtgcacttgagtgtgagtgtgtatctgagtgtgcctgtgtgtgtctgtcaagggtgagtgtgttcacacgtgagtgggtgccagggtgtgtttgtgagtctgtgtgagcgggcacgtggggtgtgtatatgggtgtctgtgcttataggagagtgagtgtatttgcatgtgagtgaatgcaagtgtacggataggcacatgcggggctgtgccaatgctggcagtgtgagctccttagcatgcatgtgtgcccccagtgtgtctcatggtcacacagacggcagatggggcacaggcccgtctttcacctgcactcccccacagacatcgatgagtgctccctgagtgatggcctgtgtccccatggccagtgtgtcaatgtcatcggtgccttccagtgctcctgccatgccggcttccagagcacacctgaccgccagggctgcgtgggtgagactgtgcccacctgctggcccctgggcaccaaccacagtcccagacatagtggtagctcctcctgtcctcacctcaactccactctgctcccacccccaaaccagccccctccccatcctggacccctccccccagccccagcccctgtctgccctgcatcctgcagacatcaacgaatgccgggtccagaatggtgggtgtgacgtgcactgtattaacactgagggcagctaccggtgcagctgtgggcagggctactcgctgatgcccgacggaagggcatgtgcaggtaggtgggcacaacttcttcccactgcctggtgtggagggtgaggaggaggtgttggctgggtcctgcactggcccagagcccagcacagcatagtgaagccagccagacccgaggcaccccctgcctggcctgtggtcctggccccaggcaggctgctcaccctgtgggagagcccctgggatttttgcagaggagggtgaataaggtggaaaagaacctcagaactgcttgagcgcccccagactactcgagtgaccatcgctatcctcacctggctacaggtcgtcctggggcctggggagcagatgtgtactgggtggtctatcagggcaaagctaagcacagtccccaaccctgctcccccagacgtggacgagtgtgaagagaacccccgcgtttgtgaccaaggccactgcaccaacatgccagggggtcaccgctgcctgtgctatgatggcttcatggccacgccagacatgaggacatgtgttggtgaggagccgggacggtggggcggggcgggtggaggaggcagtgtcagaattcacacaccaggtcttccacaaggtggcacataggcatgaaaaatgccaggccccacccctgccattcgcaggtaggaagatgaggctttgtaacagcacttgcttctccacataagggtccccagcaccccaagtctgctctccaaagcccatgagatcccatttatataacagaagcagaattccccaaaccttgctcttttaaatggcatttgtttaatatgacatacccaacatctatcagaggattgtgtcctgttcaagggctgtgctttaagatcactgaagacaaaggggtttctggcagaggacagtggacaaggcaggaaagagactcagaactctgttctctaaggtggcgactgctgtcctcacctggctacaggttgtcctagggcctggggagcagatgtgtactgcataccctatcaggacaaagctgaggccagagtgtggaagttccgggaagtaacaatgtaactcccggccaagaaaccgagtgaagcttaaagagcttagagagttgcagtttataggagtctcagagagcaagtgcttcagcgatgggccttgtgaacaaatgcatttagggaatgcagtctgctccatgcccctgttgcagacccactgtgcatattggcataaaggctctgaaaagtcctgcaggaggaaaccctggttagctttgtggatctcagccttctctaaatatatttgaccataaaatacttttggaaacacattcctggtgtgttccttggaatgtacactgtgaaacgctcacagaacattcccaattgcccagtagtggacatagagggagctccccgcccctggagaaaagaaagagagtcctagcagagaggacctgtgcggcgggacagtcaggaatgctggtgatctccctcccaccctcacctacttcctctcctgtcacccctgcacccagtcctcagacctcatgctctcttccccaacagatgtggatgagtgtgacctgaaccctcacatctgcctccatggggactgcgagaacacgaagggttcctttgtctgccactgtcagctgggctacatggtcaggaagggggccacaggctgctctggtgagccggcggtcagcggtgcaggcagaggggactccccggggccattttgggaatcatggggtctgtttccatcccccagggcagagcacagccagaattcattctcatagatttccacggatggcttcttgtgttaaagcaagaacagagtcctatacagtgccccggggggtcccctgaacagctcaggaagggaagccccaagtgtctgcagcagcatttctgaaacgtgaatccctcataatttgatgcaatacagggatgaacacttaaacatttgaatagtgactgtgttagttccctgtggctgccataacaaatgatcacacaattggtggcttagaaattgattctctgggccgggcgcggtggctcatgcctgtaatcccagcactttgggaggccgaggcgggcagatcacctgaggtcaggagttcgagaccagtctggtcaacatggtgaaacccatctctactaaaaatacaaaaattagccaggcatagtaatcccagctactcgggaggctggggcaggagaatcatttgaacccgggaggcagaggtggcagtgagccaagatagcaccactgcattctagcctgggcaacagagtgagaccccgtctcaaaagaaaataagtaaattcaggaggctgaggcaggagaatggcgtgaacccaggaggcgaagcttgcagtgagccgaggtcgagccactgcactccagcctgggtgacagagccagactccgtctcaaaaaaaaaaagaaaataagtaaaatgattctccgcctggtgcagtggctcacacttttgtaatcccagcactttgggaggccaaagcaggaggactgcttgagcccatgggttcgagaccagcctgggtgacatggatacatcacaacacggccatatggcaacattaatagagacagcaaccccatctatattaaaaattttaaaaattagcctgggcagggtagctcacacctgtaatcccagcactttgggggctgaggtgggtggattacctgaggtcaggagtttgagaccagcctggccaacatggtgaaaccccgtcactactaaaaatacaaaattagctgggcgtggtggcgcacgcctgtaatcccagctgcttgggaggctgaggcaggagcatcacttgaatccaggaggcggaggttgcagtgagccaagatcacaccactgcactccagcttgggccacagagcaagactccatctcaaaaaaacaaacttttttttaattaaaaagaaattgattctccttctagaataatagttctggaagccagaagtctgaaatcaaggtgtctacagggttagtaccttcttgggggctcagaggcagaaagtgttccatgcctccttgctgttcctcagcttgtagatgtgtcattccagtctctgtctccatcttcacacggccttcttctctctgtgtatctatttttttttatttttcatgttttacattttatttattatttatttatttttgtgagatagtgtctcactctgtctcccaggctggagtgcagtgacacaatcatagctcactgcagcctccacctctccaggctcaggtgatcttcccacctcagcctcccacacgtgccgccacactcagctaatttttttttttttttttgtagagatagtgttttactatgtcgcccgggttggtcttgaactcctggactcaagtaatcctcttgcctcggcctcccaatttgttgggattacaggcacgagtcactgcacccagtagtatctaatttgtaaagatgaggtctcgctgtgtcgcccaggctatagtgcagtggtgtgatcatagctcatgaactagttcatagccttaaactcctgggttcaagcaatcctcccagcctcagcctcctgagtatctgggactacaggtgcatgccaccaagctgggctaatttttaaaaaagtgtttgttgatcaggcatggtgactcatttctgtaatgccagcactttgggagattgaggtggaaggattcttgagctcaggtgtttgagataaaaattttaaaaaatagccaggcatgctggcgctcacctgtagtcttagctactcaagaggctgaggattgcttaagaccaggagatccaggctgcagtgagctatgattgcaccattgcactgcactccagcctgggtgacagagtgaaaccatgcctcagggggaaaaaaaagtgtttttgtagaaacaggttctcactatgttgcccaacctcgtctcaaactccttgcctcaagcgatcctcccaccttggcctcccaagtagttgggattacaggtgtaagccattgcatctggctacacagccttctcaaaagaacactcatcactggatgggagcctacactaatccgggatgacctcatcttaacttagttacatctacgaagaccctgtttccaaataaggtcacattcaccagtttcagggtttaggacttgagcataccttttaaggggacacaattctatccactccagttacatggttattttaatgtgtattagaaacaagtgttacataacagagcatcaagcctatgacttcttagaggttgttgatgttgatccaaaattgtcttttaaaacacaatttatgtcagggaaaacagaagtgtgggaaagaaatgtttagtaacagcagctcaccaaggtttaacatggcagagatcataagggtgaggcataattgactctggattggaaatgctggtggacagggaaatcctggcttggaaaaggggcgtgttcatacggacagtcacttttttatttttttatttatttatttttttgagacggagtctcactctgtcgcccaggctagagtgcagtggcacaacctctgctcactgcaagctccgcctctcgggttcacgccattctcctgcctcagcgtcctgagtagctgggactacaggcacctgccaccacgcctggctaattttttttttgtatttttagtagagacagggtttcaccgcattagccaggatggtctcgatctcctgacctcgtgatccacccgcctcggcctcccaaagtgctgggattacaggcgtgagccaccgcacccggctggacagtcactcttaatatctaccccaagtctttcatgctgctatttcaggccatttctgagggctgctgagagtcatgtctgttgggtttcggggttttcctcttgggctctgggtaaagatggaagctccccaggtgaatgggaggaggctttctgggccagctctcccctagagaggaagagtccctgccctttccgctgctattgcatcgagtctttccttctgtgactgggtcttggcgtcgtgcctcctctccctttagatgtggatgaatgcgaggttggaggacacaactgtgacagtcacgcctcctgtctcaacatcccggggagtttcagctgtaggtgcctgccaggctgggtgggggatggcttcgaatgtcacggtgagtacctgggggcagggagtgggggcaaagcagtagaggtaggtggggggcaaggcggtggggggcaaggcagtgggagggtgggatccgggagtgtctgcaggggggcagtcagggttggagggttgatgggtctttctcccttctgcgcccacccaatgcacacaccatggggtggggggtctgggctccatctcctgcagacctggatgaatgcgtctcccaggagcaccggtgcagcccaagaggtgactgtctcaatgtccctggctcctaccgctgcacctgccgccagggctttgccggggatggcttcttctgcgaaggtgagattagaggggtgggagggcaggggccctagagggacagccacgggggctgaattcacggtggctgccatggtcactcgacctcctgactccttctgactcaatcgccgctctgtgggtgctggagaggctgtgtcctcggcccaggcggtgctgcggcctgcccacggctcccttgaacacttaagtgcatgagacgcttccttcctggctgccctcctccctggatccagagagactgggtcccctctctggagtccaagagtccagaccacctctcccctccctgtccctgcctcggtcactcgcctcccacccccaagtcagggactgagtccccagggctacttgcctgggactctggctgacagcgaagtgttccagtgactggggcctcctgcccaccctgtgtgggtcctggtccaccggcctccagccctccgaatcttggggcccctcagacagggatgaatgtgccgagaacgtggacctctgtgacaacgggcagtgcctcaatgcgcccggcgggtaccgctgtgaatgtgagatgggctttgaccccaccgaggaccaccgggcctgccagggtaaggttgggcccgccagggcagaggacagagtgggtaggtcccccctgcagactctgggtggggcaggctgacccagggtccccgcagatgtggacgagtgtgcgcaagggaacctctgtgcatttgggagctgtgagaacctgcctggaatgttccgctgcatctgcaatggtggctacgaactggaccgagggggtggcaactgcacaggtgtgaggtcatctgggctggaaggggagaggagagagcaggagttggggcaggggacatggctcactccctcactgccctcagatctcttttcaagcatcctcccctgcagtcttgctggggggtggggggcgccttgcctgatgtccccatcatttcccgttcctgttcgcctgctaaataagttctgtgattgaagtggcccctccacgctagctgctgaaagggtctcctacctctgtgtgttttagaaatgggcaggtggtaaatatttttggctttgcaggccacacagtcagtctctgtcacaatgattcaactctgccattgtagctcaaaagcagccacaagcaatatgtaaatgaatgaatgtggcccctgtaccaataaaactttattgacacaaacaggtggtggaccggatttgacctacaggttggaatttgctaacccatggtttgaaagtattttctatatatgggttttggctgggagtggtggctcatgcccataatctcagcactttgggaggctgaggtgggaggatcactccaggccaggagttggagaccagcctgagcaacatagcgagacctcatctctaaaaagtaaaaataaaaaattagctgggcattgtggtgcacacctgtagtcccagctactccaaaggctgaggcagaaggatcgcttgagcccaggagtttgaggctgcagtgagccgtgattgtgcaactgcactccagcctggtcgacacagcaagaccctgtctctaaacatcaataaattacggaaataaaatagatatgattttcatatgttgactgcatggaacccagggcaggtagagttcaatgaacaaaactctgccaggcagaacagagcaggagagggaatggggttggaggggacaggacagactggaggctcctgtccccttaggtttcttcccagggaaggacatgacattgtcccacaatctggtgcccaggagttgaccttgagcgagggctgtagcttcccaggatgaagctaggagggaggggggccgaggaaggggctccctgctgaggaccgcgcttcctccctacagacatcaacgagtgtgcagacccagtaaactgcatcaacggcgtgtgcattaacacccccggcagctacctctgcagctgcccccaggattttgagctgaaccccagcggagtgggctgcgtgggtgagtccatgctcaactccagatcagggttctggggtcagcagaggtgggtgggattgccccactgggttaactcagatgtcaacgtgttcaaatctacctgctcctgacaaacgggacatctgctggtctcctgcaagagtggttgtccttgtcacctgttgaaatagacacatgcatgcacacgcacacatacagctttccctctgacacctactaaccatccccttctgcctgttcagacactcgggccgggaactgtttcctggagacgcatgaccgaggggacagtggcatttcctgcagtgccgagatcggagttggtgtcacccgagcttcctgctgttgctccctgggccgggcttggggcaatccctgtgagctgtgccctatggccaacaccagtgagtccctgcggggcagttgaacaccgtgacctaagccaccgaggcccgggagcttagggggtcacctctgctaatggcggtggtggggggcttaggcgacaggaaaaccaagaactgggggaggagaggggctcatcctgggtcacacagtgtacgtcttggtagttcattggctgggcctctctccaaggtcgctttctgtaaattctctgtgtttatagtcacttgatcactcagtcagtcaacaaatattgagagttcctctgtgtcatgtgctggggactggggactcagagaaggatgagccacagcctctgcacgctgcttctccctcacccttaaatcaacagtttcaggactgtgagagtagaactgtcctaagggttttctttgaggcatacccatagctcaggagaaagctgtggggaagtgaaagctctggggaaggctttccaggggaggaggcttgagtgaggttttgaaggatgtgtaggagttttcctagcagagtagggggaatgatgtgcaatgcagtgagaacagtatgtgcaaaggcctcaggtgtgaaacagggaggtacctgtccacctattcaggtgtatgcgtgtgtgaatgtccaaggtcttccttgcatggggaaaacttgcagttacactaggatatggttttggatcagaaggaataatcttctctccctcctacccccagccactaccacataactctgctcacatgttgaatgggaacccacatttacacacacacacgcatgcacacgcacatgcacacacacacgcaagcagccccaggactggccaaagtctcttggccccaagaggctaaagagatatggggatgtcgttagtacagtagaaggatgggagcccactcttgagcccttttcaggcttcctgctgttgctcccctgtttcccctaagctttgccccaataccccacctcacaggagcctgtttccctttacagctgagtacagaaccctgtgcccgggtggtgagggcttccagcctaaccgcatcactgtcattctggaaggtgagttcctggcagatcatccatccatctgtctgcctagagactgacttttctctcatccccacctcaccaaagtgtagagttgagtagttttgtcctgggatggggcagatctttccacctggaggctgagcagcaggaccacactatgcttttagtttgtgtttaattttttttatctgttctttcagccatttcttccacttgttggtttattgatcttttcatttgtcccccatccttccattcatcctccatccttctgtccatttatccttccatccacccatccttccatccattcatccatccttctacccatccatccagccattcatccatctatccatccatccatccatccttccattttttccatccatccagtacatccatacatccttccatccagccatcctccatccattcttccttccatacttccatacttccattcaaccatcctccatctacccattcatccatcctccactcatccctctcttatccttttatccatccatctagtcaaccattcattccccatccttcatctatcccccatctttctgtccattcatccctccatccatccatccatccatccatccttccacccgaccatccatccattcatccatccttccactcatccttccatccattcatccatccatccatccatccatccatccttccactcgaccatccatccattcatctatccttccactcatcctttcatccattcatccttccacccatccaaccattctccatctacccattcatccatccccccacttattcccctcctatccttctatccatccattcacccatttatcccccatccttcatctatcctccatcctttcatccatcccccctccttctgtccatttatccttccatccacccatccttccatccatccatccttccacccaaccatcccccatctacccattcatctatccttccttccatccaactatcctttatctacccattcatccatccttccattcatccatccttccatccatccctccatccttccatccaaccatgccccatccacccattcatccattcatcactcatccctctgctatccttgtatccatccattcacccatccatccaccccccatccttcatctagcccgcattcacccatccattaacctatttcccactctcccatccatccatctcccacccacctatctctcattcttctatccatctattcacccatccatctatcccccattcacccatccatcctcaatacatccatccatccactcatccatccacccatttcccatccacccgttccctactccctttctattcccccattcatccacccttccatccatcttctatctcccatctattcatccattcatccatccatccatccatccacttatccacccattcactcatttgcctgtctactcacctatccatccaccttcctatccatccactcactcatcatcttattcattgacccacttgcttatttacccatccactgtttcatatccatgcatccatccactcatccatccattcatccatcctcccatccatcctttctatagggagtgacaaggttggagaagactattctccatctagaggaagaaaactatctatttctctatctagaggaaactatgtggtggatgggagaatggactaacagatgaagggaatggagttgaatttagggtaacattaactcaagagaatctgtgtccagccatcaagatagaccctttaaatgtctatcagtcatggacagcacttggggatcctcgagagggccctggagaacccagagcatggtgtgggtgccccttaagtcctctgcatgggtttagctcccaagcttggcttccttacttcctgacagacatcgacgagtgccaagagctgccagggctgtgtcaggggggtgactgcgtcaacacgtttggcagtttccagtgtgagtgcccacctggctaccacctcagtgagcacacccgcatctgtgagggtgagcatggattctctttggggtgggtcaggctcttccgctctctccctgccttcctgccctgccaagcctcacaagggtagaggagggaaggcctcatggaaaggcttctgccccctgcctcctcttttgtcatgatctgtcagttctctcttgctgcctttaagatgttcatggctgctgtggatctgtggtgtgggggatggtagatagaccctttaaaatgccacgacactcccttatgaagtacagcagcttccttcttcaccatatctttgtctggatgttgtaagcttttgactgattccagagttctgcaaaagtttatttttgtctgttttgccagctcaatagttgcttttgtggaggaatggagccctggagttccctgctctgctatttttggtgacatcactcttaccatgctaatattccactacctatttttgcctgctagctaagaatactttattacacttttctcaacggttgaaaaaaccaaaagaagaataacattttgtgacacatgaaaattatatgaaattcaaggctgggtgcgtggcagctcaagctggtaatcccagtactttgggaggctgaagtgggaggattgcttgaggccaggagtttaagacccacctgggcaacatggcaaaaccttgtctctacaaaaaattaaaaaaatagctgggcatggtgactcacgcctgtaatcccagctacttgggaggctgaggcaggaggatcacttgagcctcggaagtcgaggctgcagtgagccgtgattgtgccactgtactccagcctgggtgacagaacgagaccctgtcttaaaaaaaaaaaaaagaaaaaaaagactgggcacagtggctcatgcttgtaatcccagctctttgggaggccgaggtgggcagatcacgaggtcaggagttcgagaccagcctggccaacatagtgaaaccccatctctactaaaaatacaaaaattagccgggcatagtgacacatgcctatagtcccagctactcgggaggctgaggcaggagaatcacttgaacctgggaggcggaggttgcagtgagccaagatgaggccactgcactctagcctgggcaacagagtgagactctgtctcaaaaaaaataaaagaaagaaagagagagaaagagagagaaagaaagagaagaaagaaagaaagagaagaaggaagaaagaagaaaagaaaagaaagttatataaaattcaaatttcaggggtccataaataaaatttccttggagcacagccagtgccacagtgtgtttgcatattgtttgtgtctgctttcttgctacattggcagattgaataatcatggcacactgtagtttggcccgcaaaaccaaaatgttctggccctttacagaaaaagcttactacccctggactagagtaatgaccagattgagaatcaatttttttcccccaagaatactttatccataaggtccttgattcctatcatatcatattaggaagacatggatgatcctttcttggtgattataaaactgactcatgaactcaggtcattttgttcctaatagaagcagtatcatcatcaactttatttttaggaatttttttttttttttttagagccagtgtctcactctgttgtccaggctggagtgcagtggtgtaatcacagcttgctgtagtcttgacctcctggactcaggtgatcctcccacctctgcctctcaagtagctgggaccacaggcgtgtgccaccatgcccagctaaattttcattttttgtagagatgggacctcactatgttgcccaggctggtctcaaactcttgacctcaaatgatcctcctgccttggcctcccaaagcagggatgataggcatgagccactgcatccagcttgtaaatgttttttttttttttttttcacttaatgtcatattgtttttgttcgtttgtttgttttttagagccaggatctcattctgcacccaggctggagtgcagaggcgtgatcacggctcactgcaaccttaacctcctggactcaagtgatcctcccaagtggctgggactgcaggcatgcaccaccatgcccagctaattttttaaaatttttagtagagatggggtcttgctatgttgcccagactggtctcgaactccgggctcaaatgatcctcccacctcagcatcacaaagtgctcagattacaggcatgagccaccatgcccagcccatattatagctttcttcatcactaagatgtgtgtgcgttttaaactgattttgaaaccaaacttaggtccctggtgaagtggccttgctgggtctctggagtggagttattcagacaattcctggacgctgcccactgttcccctccaccccttctttccctgcagatattgacgaatgctccacacactccggcatctgtggccctggcacctgctacaacaccctggggaactacacctgtgtctgccctgcagagtacctccaagtcaatggtggcaacaactgcatgggtaagaagcgtgatgacctagggaactggcagtcacagaagcagcacctgggcatgggaggaactgctgggagccttcaagcctatggagagggagggtaagcatatatgaagtgctgacatgtggcagtaaacaaagctgcaggactcaggagcccagagctgccatgaacagttgctcaggttgtgcactgctcaaaaaaggctgaaaaaagtgaatggatcccccaagtgtgttgggggagagacatcaagccaatcaagccagccagtaatctttttttttttttttttttgagatagagtctcactctgtcacccaggctggagtgcagtggcacaatctcggctcactgcaacctccacctcccaggttcaagcgattctcctgcctcagcctcccaagtagctgggattacaggcgtgtgccaccacacctagctaatttttgtatttttagtagagacagggtttcaccatgttggccaggctggtctcaaactcctgacctcaagtgatccgcccgcctccgcctcccaaagtgctgggattacaggcatgagccactgtgcctggacaagccagtaatcttcaaatgaatcagttaaggagttcctatctctttggctccctcttccactgatttaggtgacccttacccacattcttctcctttgtgccaactacagatatgaggaagagtgtctgcttccggcactataacggcacatgtcaaaatgagctggccttcaacgtgacccggaaaatgtgttgctgctcctacaacattggccaggcctggaatagaccctgtgaggcctgccccactcccatcagtcgtgagtaaccctccccaaccttcttcccagcctggcccctcctagcataatggttaaggaaacacagtgcccttagggttcttagattaatcctccttgttctgatgagagccagagagttgaagttttgtccctctattagtccattctcatactgctgtgaagaaatactggatactgggtaatttataaagaaaaagaggtttggctgggtgtggtggctcacacctataatcccagcattttgggaggccgaggcgggtggatcacttgaggtcaggcattcgaaaacagcctggccaacacagtgaaaccctgtctctactaaaaataccaaaaaaattagctgggtgtggtggcgcaggcccgtaatcccagctacttgggaggctgaggcaagagaatcgcttgaacccgggaagtggggtttccagtgagccgcgatcatgccactgcgctccagcctgggtgacagagcaagactccatctcaaaaaaaaaataaaaaaataaaaaaaaaggaggactttaatggactcgcagttccacataactgggaaggcctcacaatcatggcagaaggtgaaggaggagcaaaagcacgtcttacatggtggcaggcaagagagcgcgtgcaggggaactgccctttataaaactgtcagatctcacgagatttattcactatcacgagaatagcatgggaaagacccacccccatgactcagttacctcccaccgggtccctcccgtgacatgtggggatatgggagctacagttcaagttgaggtttaggtggggacacagccaaactgtgtcagtccccatgtatggaaggcaatattttaaagtgagcaaggcagcttttcttccattttgcagatttcgagaattcaggatggatcaatggagttttcattggtgggaaaggcccttgaagattcacaggagtagctggggctgggataaagtgggagggggtcggtaaatgtcccaggccagggaggaaagcaccgctggttagagataccatagacctcctgggctgggatagggtgggagggggtcggtaaatgtcccaggccagggaggaaagcacagctggttagagataccatagacctcctgggctggggaaggggcagacctggagaagctcagagccaagattgggaccctgatgggaacatcggtcaggatgagggaaggcgttctaggcaggggcacagcaggagccaaggcctggaggcaggactgaacagagtgtgttgacagcaggaatgagtcctgttggaatgatctagcagccagcccaggcaccaggaggagctgcaggaatgggacagtgatgggaaggggacttctaggggcttatagctgtattcattccccagagctgctgcaaaacattactgcaaactaggtggctttaaaaaccagacgtcgtggctcacgcctgtaatcccagctacttgggaggctaaggtgggagggtcacctgaacctgggaggttaaggctgcagtgagccgtgattgcaccagtgcactccagcctgggtgacagaacgagactttgtctcaaaaaaattaaattaaataagtggaaggagggaaagggtggggagagcaaaaaaagttcaaggtggccaggtgagggctgggctccagggatgaggtgtcccctccagattgggagcgggctggggtcaggcctgcagccccagactcagctttgttcccctttgcgcagctgactaccagatcctgtgtggaaatcaggccccgggattcctcactgacatccacacggggaagccccttggtgagtgagtggtccctgctctatccctgggcacccatccacctgggtctgcttcctcccacccctcccctcctcaacagctcttttccttacatccactcctccatcctcccctcctcctcgctccacacacctccaactccccaggaatcctgccctcaataacacttctttttaaaaaaagaatgacactatttttattaaaccattatccattttttaaaatgatagtaaaatatatgcaacataaaatttaccattcgagccatgcacagtggctcatgcctgtcatcccagcactttgggaggccgaggtgggtggatcacctgaggtcaggagtttgagaccagcctagccaacatggtgaaaccgtgtctctactaaaaatacaaaaattagctgggcatggtggtgcatgcctgtaatcccagctactcgggaggctgaggcatgagaattgcttgaacccaggaggcaaaggttgcagtgagccgatatctcgccattgcactccagcctgagggatagagtaagacttttttttttttgtctccgagaaagtatcatttgaaccatttttagtgtgcagttcagtggcattaagtacactttcactgttttgcaactatcaccatccggaactttctcatctcctcccactgaaactctgtccccatgaaactctcactccccatccccctcagtccctggaacccaccattctactttctgactctgtgaatctgacggttctagggacctcctgtgagtggaaccacgtaggatttgttgttttgtgtcaggcttatttcactgaacatgatgtcctcaaggtgcatccgtgttgcagtttgtgtcaaattgctccatgccctttttttttttttttgagatggagtttctctcttgttgcccaggctggagtgcaatggcactatctcaacttactgcaacctctgcctcctgggttcaagcgattctcctgcctcagcctcccgagtagctgagattataggcacctgccaccatgcctggctaatttttgtattttaatagaggcagggtttcaccatgttggtcaggctggtctcgaactcctgatctcaggtgatccacccacctcagcctcccaaagtgctgggattacaggtgtgagccactgagcctggccagaatactccctttttaacaacgtattgcataatttaacacctgcatcccaaatgtcaactatgcagtgtttaactgatgaattcattttcatttgttttaatcctctgaatatattctccttattttttaaaaaaatcaaaccatggcggccgggcgtggtggctcacacctgtaatcccagcactttgggaggccgaggcaggcggatcacgaggtcaggagatcgagaccatcctggctaacaaggtgaaaccccgtctctactaaaaatacaaaaaattagccgggcgtggtggcgggcgcctgtagtcccagctactcgggaggctgaggcaggagaatggcgtgaacccaggagatggagcttgcagtgagccgagatcgtgccactgtactctagcctgggcgacagagcaagactccgttgcaaaaaaaaaaaaaaaaaaaaaatcaaaccatgacaaataaaacccacttctcctccagtcatcacctcaactctgtctcttttctccctctctggacgttcttatgctttatggctggaatatttctttctagttttttcttccttcattacataataggtcccccactgaaaatatatgacattggtttctggggcattttacgtaaatgatgtaatgcttgacatgttggttacaacttgcttttttcgtccaaattgtgtcttgaagaaccggccaggttactatctgctgtgcagcctctctctttgccctgcctaaaagtgtttcatggtgcagatacatcccaggtcccccagtgatgggaacttaggtaatttccagtcccccactgatggacacttaggttgtttcagatctccttttgatggacacttggattgtttccagtcccctattgatagataggtggattgtttccagtcccctttggatggacacttatattgtttataacagttttattgagagataattcacataccacacacttcacccatttaaagtgccctgtttagtggttttgaatacattcacagagttatgcaaccatcacctcagtataagtttagaactcattttcatcacacaaaaagaacattttcatcacagtcccccattgatggacacttagtatgtttccagtcccccactgatggatatttaggttgtttccagtcccccactgatggacacttagtttgttcccagtcccccactgatggacacttagtttgtttccagtcccccactgatggacacttagtttgtttccagtcccccactgatggacacttagtttgtttccagtcccccactgatgcctgtttaggttgtttcccgtcccctattgatgggcacttaggttatttccagtcccccattgattgacacttaggttgtttcctgtcccccattgattgacacttagtttgtttccagtcccctactgatggacacttatattgttttcagtcccccattgatggacacttaggttctttcaagtccccttttgatggacacttaggttgtttccagtcccctactgatggacatttagattgtttatatataacagctttattgagatataattcacataccacacacttcacccatttaaagtgccctctttagtggttttgagtacattcacagtgttacacaaccatcgcctcaatctaagtttaaaacattttcatcacacaaaagtaaaccctgtgcctattagcagtctctccctttagcccctcccttctgcccctggcaaccacaaatcgactttctgtctctattgatttgctacttctggacatttcctttaaatggagtcatgcaatattgttctttcatgtctggcttctcttagcagaatgattttaggtttcaaccacattgtcacatgttacagggctttactccttaataaggctgaagaatattccatggtacagacatcccatattttgctctgcattcatcagttgatgtttccagtttcttgctaaatagcatctcataccgctgtcctgcttacgcttaaggccatttctttccagcagggttgctgggtcacaggaagtgtgtatttttaattgagaaaaacacacacagtctctctgctcttgtctttcctcccactcctcacctctttctggtgtgagcggatgtattttggtcacagcaagattttcttgagtgtgtgctggtttgtggccacaacagcctcaaccagattgcagggctagtgggtcccttcgctcagcatcgctggaagtcccagggggctgggctgcccctgatggcagatgccttctgcagacattgatgagtgtggggagatccccgccatctgtgccaatggcatctgcataaaccagatcgggagtttccgctgcgagtgccccgcaggcttcaactacaacagcatcctgctggcttgtgaaggtgccacctctccctgttcccagccctggggcctgggtgggatgcatgtccgccactgtgcaatctgggcgagtaactaaaactctgtaagcctccatttccctgtatgtataatgggctaacacctttccaagggcctccatctcatataaccacccttactccagctctggctgcttccagagaaaccacctgctccgaagcagtggactgggtttcacgtttgattctgtcaggatgggcttctctgtcacccccacctcatttgctgtattttcccagatgtcgatgagtgtggcagcagggagagtccctgccagcagaatgctgactgcatcaacatccccggtagctaccgctgcaagtgcacccgagggtacaaactgtcgccaggcggggcttgtgtgggtgagcagggtccctgggaggaggtgagggagctgggctctgtcacccatggggacttagatggggtatggctctgtccaggtctttctccttttctatactattaggggggtgggggatgtattgagagtgtctgttaataggatgtgatagaggtgagagctcaggtccatgcagacagcctgacgcccctggtggaagtttgagtggggaacttcaaggcagattctggcttccccattgcagtagggagagctcaggcaaacactgtggtaggagccctgggaacaccatgctctctgcacccccaggacggaatgagtgtcgggagatcccgaatgtctgtagccatggtgactgcatggacacagaaggcagctacatgtgtctgtgtcaccgtggattccaggcctctgcagaccagaccctgtgcatgggtgagacccttatcttccccctccttttcaagccaggctgcctggggtctaaacctcccctgggatggaagtggtgtttctgtccatcctagttcacaaagagatccaagtttgggtcctgagattaagatcttgggtaaatggttgatctgcctccctgtgcctcagttttcccatctgtaaaatgggggtgatatatcataccaggagtacttcccagccatcaccgccaggggtcactgcccagtcatctaggcagggctaggtgcaggggaggagtgctaggtccagctggcctctcactccccaagttccccaatgccctgggtgagctgggttgggctctcggctttgcttctgcagacattgacgagtgtgaccggcagccttgtggaaatgggacctgcaagaacatcattggctcctacaactgcctctgcttccctggctttgtggtgacacacaatggggattgtgtgggtgagtcggctcaggtggcaggctggccacaaagtgggttctcagaatctaaggaagtgaatctagaaattggccacagaaagatgcccagaaagtccccgattatttagaaattaaataacatactcctaaataatccataggtcaaataaatcataaggaaaattagaaaatattttgaagtaaaagaaaatgaaaatgaaagcataacatatgaaaatacataggatgcagctaagggggcacttagaggcaaattcatagcattacatggttatattagaaaatatcagcaactacctcataagataggtagaaggctaatatacatagtctatacatgagtgctcaagttgaagccaatgctgtcagctcaactcagttgtggacagaagtacaaggaaggtttgatcccttcaagttttgtgggtgaactggcctgcccatctcccctctacagattttgatgagtgtactaccctggtggggcaggtgtgccgatttggccattgcctcaacacagctggttccttccactgcctctgccaggatggctttgagctcacagctgatgggaagaactgtgtgggtgagtctgcctatggtgctcggaggcatctcagccagcccctgctccatgtacaccacagtttggtacttctgggtgagcatagatccatttactacccaagcatttattttaagatttaaaaaaaaaaatacccagcactttgggaggctgaggcagaaggattgcttgaggccaggagtttgagactagcctgggcaacatagtgagtcctcgtctctacaaagaaatttaaattagccaggagtggtggctattgcctgtagtcctagctactcaggaggctggggcaggagaatcacttgagcccaggagtttgaggatgcagtgagctatgatcacaccaccgcatccagcctgggcaacagggaaagatcctatctcaaaataaataaataaataaaataattataaaatcagcacatcaaacctatgtttctatgtatggggtttgttgtgtagggtgaggctgtcttgaaaatgtaactttccagaagcaaagaatagtagaagcgctaaatagataccatggaaggaatctgctggtggtgccagattaggaatcttgctacctctttccactggacaccatctgccccacctataaccccacgagagtcagataatccttccccagctgtccctgtcgtcctgagtctcagcccttgccctggagccagaattgccactgggagggcttgtcctggggccctcagtgatcacacagtgattgcaggtgttggtcccagtcccaagtgagccccctgcatcctggctggcacaaggacctttcttcctccttttcacagacaccaatgagtgcctcagccttgcaggaacctgcctacccggcacttgccagaacctcgagggctccttccgctgcatctgtccccctggcttccaggtgcagagtgaccactgcattggtgagtgtccagccccactcccgtttctggcgccagggagtgcctctctttctccatccataaaatgggaataccagctagggttgtgatgaaggtggagatgtacttaacgcagcgtcaaacacagcttcataaactattattgtcattctgattgtttctggactctgcactcaggactttgtctctagtgcccacaggcttcctcatgaatcctataaattgacatgggtgtggggtctcaccgtttctcagtgcacccaaatgtagagctcctcacttgctaactggagatcaaggaccagtctggcctaagcttcaccggtgtaatcacccatagagatgatttcatgcagtctggactaacaagtctggcctaatctcctttggtccatttatccacttggactagcctcagagagtgtgggctaacctggaccagcctgggctgagcagatgggctgctttgttcactgtggtctaacctggaccagtctggcttgagcagatgggctagcctgggctaacctgaaccagtctggcctgaatacctctgatccaggcttccatctgggctagccttgtataacctgagctaacgtggaccagtctggcctgggctcttctgatctatcctttttttgttgttgttttgttttgtttgtttgtttgttttttgtttgttttgttttgagaggagtctcactctcagctcactgcaaccgccacctcccgggttcaagagattctcctgcctcagcctcctgagtagctgggattacagtcactcatcaccatgcctggctaattgtttattttttttgagacggagtctcactctatcccccaggctggagtgcagtggcacaatctcggctcactgcaagctccgcctcccaggttcacgccattctcctgcctcaacctcccaaatagctgggactacaggcgcccgccaccatgcccggctatttttttgtatttttagtagagacggggtttcaccatgttagccaggatgctctcgatctcctgacctcgtgatctgcccgccttggcctcccaaagtgctgggattacaggcatgagccattgcgccaggcccaatttttgtatttttagtagaaacggggtttcaccatgatggccaggctggtgtcaaactcctgacctcaagcgatcctcccacctcagcctaccaaagtgctgggattgcaggcatgagtcaccatgcccggcctattctgatctattctatttgggctagcttagtacaacatgagttaaccctgtccggtgtagggtaaatatatccagtctcagttagctttgtgcaattttctttttttaaggtttaaattttttttttctattttttcttattttaatttcaatagttatgggggaacaggtggtttttggttacatggataagttcttcagtggtgatttctgagattttggtgcacctgtcacctaagtagtatacactgtacccagtatgtagtcttttatccctcacccccctcccatccttccctgggggtccccaaagtcctttatatcattattatgcctttgcatcctcatagattagctcccacttataagtgagaacatacgatatttggttttccattcctgagttacttcacttagaataacggcctccagccccatccaagttgctgcaaaggacattattttgttccttttttttttttttttttttttttttggtggagtctcactctgtcacccagactggagtggcacagtctcagctcactgcaatatccacctcccgggttcaagcgattctcctgcctcaccctcctggtagctgggattacaggtgcgccccgccacaatgcccagctaatttctgtattttcagtagagacagggtttcaccatgttggccaagctggtctccagctcctgatctcaagtgatccaccagccttggcctcccaaagtgctgggattacaggtgtgagccactgtgcctatttcgttccattttgtggctgagtagtattccatggtgtattatataccacattttctttatctactcgttggctgatgggcatttataaatatgatggctccagatttttgcgattgtgaattgtgttgctataaacatgcatgtgcgtgtgtctttttcatataatgacttactttcctttgggtagatacccagtagtaggattgctggattgaatggtagttctacttttagttttttggttttttttttttgagacagagtctcgctctgtcacccaggctcaagtgcagtggtatgagctcagctcactgcaagctctgcctcccgggttcatgccattctcctacctcagcctccagaatagctgggactacaggcgcccaccaccacacccggctaatttttttgtattgttagtagatggtttcaccatgttagccaggatagtctcaatctcctgacctggtgatccacccgcctccacctcccaaagtgctgggattacaggcatgagccaccgcgcccggccttacttttagttctttaaggaatcgccacactgttttccatagaggttgtactatgtgcagtttcagtctccaatcatgaactattcctgaccatgacctttactctggagatgccttccgggaaggacctacgtgcacacacaatgcccacctcgtgctgaagctcatactgagctctcaggaccccagccccactgcagcccctggctggacctgcactccatctgtcccttctcacagctgagtcctctccccactgatggaggtcctacttgccccccacccagctcatgtccctgcccttccagatatcgacgagtgctcagaggagcccaacctctgcctctttggcacctgtaccaacagccctgggagcttccagtgcctctgcccacctggctttgtcctctctgacaatgggcaccgttgctttggtaagtccacacagggcttagggaagagggtgggaagtggggcggggaagggtcagattgcccagaaaagagggctgtggtttcttgtgtgaccctttgggagctctgaccaggcagaggtgtctgtttgcattagcagagttatcctagtgccagcaacctcttggctatagaggtcatgtctatggagggctaacctggtccattctgagctaggtgtgtgcttatttaggttttccttgtattggtcacatgactgtaggctgtcaatgggctggttttgtccagtttgagctagcctagactactctgggctggctccgtttcagctgggctagccttgtctactgtgggctaacctcacccagcttgagccagcctgttctctcacaggtcaggggcaataagggtgagagcagagcatgcagttcacctcagcgaatatttgctgttctgggaggctgggaccccagcctgctggtgaggacttgataggtgtccagagccaaggattgggggtttggatcctcgggctttctggaatcagtcgttttgcctctccaggaaggggtttttgatccaagagtaaccaccaagtttgatctttcttcctggcatgagaacaccccaaagcaatgaagtggggtgggattccagctgtcccctcaaaaccccagggcaggccaggggcggtggctcatgactgtaataccagcactttgggaggctgaggcaggctgatcacctgaggtcaggagtttgagaccagcctagccaatgtggtgaaaccccgtctctactaaaaatacaaaaattagccgggtgtggtggcacatgcctgtaatcccagctacttgggaggctgaggcaggagaatcactcgaacctgggaggtagaggttgcagtgagctgagatcgtgccactgcactccagcctggtcaacagaggaagactccatctgaaaaaaaaaaaaaaccaccaccaccaccaacaacaacaactaaaaacccagggcagatcctcattggcccagagtaggtcacatgtccatactcaaaccaatcaccatgaccaggggcatggcatgttctgattggccactggcaggatcagcacaacccattcaccaggactggggtgcgggaggtcacaggggcaggtgggcactgccagcggctttcaatcagggtaatggagcccccaccccacagacacacggcagagtttctgcttcacccgttttgaggctgggaagtgctcggtgcccaaagctttcaacaccaccaagacccgctgctgctgcagtaagaggcctggggagggctggggagacccctgcgaactgtgtccccaggagggcagcggtgagtgcccacccctgtccaggctccctggatgatgtgccctcaccttcctctctcattcttctctcatccttccctgcacacacctgggggctgcacctaggccctgactctgactcccctccccctctccgtccagctgcctttcaggagctctgcccctttggccacggggcagtcccaggcccggatgactcccgagaaggtgagcccctcacccacatgctaagagccccttctgggccacccagatccatctccgcactgcctgggtctctgagtttcaggctccccctgagagcctgggtggccctggaccctgccagcctggggcttgggcttttgtccccttggggccttgagtgtggccagggctctggcgattgtgtggtgacagaagccatgtctgcaacgcctgccatccgcagacgtgaatgagtgtgcagagaaccctggcgtctgcactaacggcgtctgtgtcaacaccgatggatccttccgctgtgagtgtccctttggctacagcctggacttcactggcatcaactgtgtgggtgagtggccagcccttccccagctctgtcccaggcccctcccaggacaggaaggagcagagcagggcagggaagacacccccaggcagtgggtgagatcctgtccttaaccactgcctctctcccccattcactttttctccctctgtgcttcattcactcattaattcacttgctcactcattttcttgctcattcattcactcactcacttattcatttactcattcacttattcatttactgactcattcattcacttgctcactcacttactcattttctcattcattcactcattcactcactcatttactcccttattcattcacttaccaattcactcactcattcactccttggctcactcattccttcacttgttcattcattcacttattaattcactaactccctcattcattcacacgtcattcattcacttgctcattcactcacttattcatttactcacttattcatttactcacttattcactcattcactcatttgccccctcactcattcacttgctaattctctcactcattcactcctttgctcactcattccttcgcttgttcattcattcacttgttcattcaatcactccctcattcattcacacctcatttattcactggctcattcattcactcactcattcatttactcattcactcattcactcgtttgctccctcattcattcacttgcttgtttgttcactcattcatttgttccttcatttgtctccttgctcattcacccattcaatcactcatttattcatttactcactcattcctttgctcattcattcatgctttcactcacttattcagtcactcattcgtttcctcatttgccctcttgttcattcattcacttccttgctgatttctccattcactcactcagtaattcacccactcattcacccctttactcactcattcccttattcatttaaccattcattcacttactcatttatatgttttttagagatgaagtcttgctatgttacccaggctcttttggaactcctgggctcaaatgaccctcctgcctcagtttcagttactggtttaatcactccttcattcactggctcattcattcacttcttgctcattcactcactcccttgctcactcatgcattcctttacctgcccacttgctcacacattcactcattcattcactaaacacataccgcttgcctgccccatagccagactagaggtgcattcgatctggccccctccgatctgtggtggtcaacaggcaggcagatgggatgctactgaggatgggggaccctctgcaggtgctgaccacccccttactcccacccagacacagacgagtgctctgtcggccacccctgtgggcaagggacatgcaccaatgtcatcggaggcttcgaatgtgcctgtgctgacggctttgagcctggcctcatgatgacctgcgagggtacaactctgcttgcccaggacctgggccgtgtgacggagatgcctgggggagggagtggaggtcccgccctcagtccctacccagctggcacctccactggcctccccagacatcgacgaatgctccctgaacccgctgctctgtgccttccgctgccacaataccgagggctcctacctgtgcacctgtccagccggctacaccctgcgggaggatggggccatgtgtcgaggtaggcctgactaatatggtaaaaccctgtctctactaaaaatacaaaattagctgggcatggtggcacacgcctgtaatcccagctacttgggaggctgagagacaggagaatcgcttgaacctgggaggcggaggttgcagtgagccgagatcatgccactgcactccagcctgggcgacaagagcaaaactccgcctcaaaaaaaaaaaaaaaaaaaaaaaaatcctgcaatgcacacagaacagccgcccaccgcaaagaactttcctatcccaaatgttcatagtgtcaagcgtgggagaccctggtctgggactcagtgtctctggggctgtttcagggtcagtgttccaggggccatgagcagactcacagaccctgacatgggcaggggatgcaagctttgggggacaattcctgattccctcagcttcttggaggctggggctgggcaggagctgggggctcccttcctaagagggatagacatttgacagggtctgcagggaactcactcaggtcccacagggctgacgcagggtggaatccaggtccccacagccatagggtgcctggccttgactgaccatctgtctctggtcatccgaagatgtggacgagtgtgcagatggtcagcaggactgccacgcccggggcatggagtgcaagaacctcatcggtaccttcgcgtgcgtctgtcccccaggcatgcggcccctgcctggctctggggagggctgcacaggtatggggcactggagcttcatgggtgcaggaaactccttgtggaagggagaggtcaaagcaagagggttggaccgggcacggtgactcatacctgtcatcccagcactttgggaggctgaggcgagaggatcgcttgagcccaggaatttgaggcttcaatgaatgggagggacaggcagtggggggggacaggcagtgggagggacaggtagtggaggtgacaggcagtgggaggacagtgccgctgcactccagcctggacgacagagtgagaccccatctccaaaaacaataaaaatgaaaataaggctgggcacggtgcctcacgcctgtaatcctagcactttgggagaccaaggcggttggatcatctgaggttaggagtttgagaacagggtggacaacacggcgaaaccccgtctctactaaaaatacaaaaaaaaaaaaaaaaatagctgggcgtggcggcgggcacctgtaatcccagctacttgggaagctgaggcagaagaatttcttgaacccgggaggtggacgttgtagtgacccaagatcaggcaattgcactccagcctgggaaacggagcgagactctgtctcaaaaaataataataataataataataaaaataaataaaataaaaataagcaagagggcctgggcagatccaaaggggccctttggggctgtgggagaggctggctgcctgtggcctccccgcccacctgcctcacccctcccatctcagatgacaatgaatgccacgctcagcctgacctctgtgtcaacggccgctgtgtcaacaccgcgggcagcttccggtgcgactgtgatgagggattccagcccagccccacccttaccgagtgccacggtgagtgtggctggacacgcacagtggttgcaaccacctaccatgtggcacccactgcctgtccccccccactgcctgttccccccactgcctgcccccttcactccctgtccctcccactgcctgttccctccactgcctgttccccccactgcctgtccctcccactgcctgtccctcccactgcctgtccccccactgcctgtccctcccactgcctgtccctcccactgtctgggagccctccaaggcagggacggggcctgcggcactgacgggcaacccagggggttgctgagctaatccggacacacatgtccagtgctcccctgctgcccctcttccctctgtcccttctgttaaatactggaagagcgggacgctccctccatgcctcctccaacttactggcgccacaccccggaaccaaccttccccagatctcccacttctggggagctaaccccagccggtgacccactagggccatctgtcctgtgtatccaactccctcctggacacccctgtccccaacacccccaaaatacagcttgccccaaagcaagctcagtctttgcccccaaaccagcctcctggagtgaccgttgtctttcccattgttctctgcagacatccggcaggggccctgctttgccgaggtgctgcagaccatgtgccggtctctgtccagcagcagtgaggctgtcaccagggccgagtgctgctgtgggggtggccggggctgggggccccgctgcgagctctgtcccctgcccggcacctctgcctacaggaagctgtgcccccatggctcaggctacactgctgagggccgaggtgggtgcccatgccctcaggacccccagggaggcaagaaacgggggagtttgctcagggtcatgtgtctgtactgcagcaggtgctggaatgtgtgagccacactgtgtgtgtgtgtgtgtgtgtgtgtgtgtgtgtgtgtctttgtgctagcagatatgagaaccagtacgtgtgcaccatatgcatggaagaactcggggggttgagggagcagttgtgtgagccaatgtgtgtgtatgtgttctgagacagagtctcactttgacacccaggctggagtgcagtggtgcaatctcagctcactgcaacctctgcctcccagtagcatacctgtcatcccagcactttgggaggctgaagaaggaggattgcttaagcccaggaatttgaggctgcaatgagctaagatagtgccactgcactccagcctgggtgatagagcaagacctcgtctccaaaagcaataaaaataggccgggcacagtggctcacacttgtaatcccagcactttgggaggctgaggcggccggatcacctgaggtcaggagtttgagaccaccctggtcaacatggtgaaacctcatctctactaaaaatacaaaaaattagctggatttggtggcgtgtgtctgtaatcccagttactcgggaggctgaggcaggagaatcccttgaatccgggaggcagagcttgcagtgagacgagatcacgccattgcactccagcctgggcaacagagagaaactctgtcccaaaaaaataaataaataaaaataaaaagcaagagggccttaacagacccaaaggatctctttggggccgtgggagaggctggctctcccatggccagtaaagatgaggttttgccatgctggccaggctggtctcgaactcctggcctcaagtgatccgcccacctcagcctcccaaaatgctgggattacaggcatgagccaccgcgcccggcccagtgtgtgttctttgtgagtgagagctcgttccggactgcgtgggagctggtgtgtgtctgtgtgtgtcagctgggtgagaagtatacaccatgttcatctgtgaagtagaaggcagtgagagggagccagcggcctgtgtgttgtggacttgggtgagtgtacaagggcaggtatgtgagtgtctgcgtgtgagcgagcataaggacatcagtgcgtctcactgagtgtgtcactgatagtgagatgggttatccatgtgaccagcagtggcatcaacaggactggggagggccgcggtggctcacgcctgtaatcccagcactttgggaggctgaggcgggcagatcacgaggtcaggagattgagaccatcctggctgacacggtgaaaccctgtctctattaaaaatacaaaaaattagccgggcgtggtggcaggtgcctgtagtcccagctacttgggaggctgaggcaggagaatggcgtgaacccgggaggcggagcttgcagtgagcagagatcgtgtcactgcactccagcctgggcgacagagcgagactctgtctcaaaaaaaaaaaaaaagaaaaaatagtaggactggggaggaaatggctttttgggggtgtggctggggggagactcgggagtccctgagtgttggcgtgtgttcccgtgtttctgcaggagcatctaggtgtgtggctagtgtatcatgttgcatgcactgtgtgtctctgttctgcatgttggtgcactgaggaggtgtcgctgttgaggctggggaggggtgggtgtgagtccccttccctggaagcttcatgggcgtgtcctgcgggctcaggtgtcatccgcagcctgaggatggggtccacgtgggctggggtgcagtggccggtgtggaagggaggctggactttcctccgaggagacggctgctgggcagagagaaggagacattcctcggtggaggcgcgaagcagccagccagccccatttgcaccctactttttcccagatgtagatgaatgccgtatgcttgctcacctgtgtgctcatggggagtgcatcaacagccttggctccttccgctgccactgtcaggccgggtacacaccggatgctactgctactacctgcctgggtgagcccagccctctgcacctgcacccttggcccagcctggccaccttctgtgcagcccctgaactcaacttccctgagactttccactttgcaatgttaggctttcatttacaaagtggtgcccaaaccatacagacaactgagggccaggtgtgatggctcgctactgtaatcccagtattttgggaggtcgaggtgggaggatcacttgagaccaggagttccatagcaacatagcaagaccccatcgctaaaaaaaattagccaggatggtggcctgtagtcccacatgcgcctgtagccccagctacttgggaggctgcttgagctcaggagtctgaggctgcagtgagctgattgtgccactgcagtccagcctgggtgacagagtgagaccctgtctcttaaaaaatgaaaaacaaaagaaaagaaagaaagaaaaaaaaaaacaggccaggcatagtagctcatgcttgtaatcccagcactttgggaggccaaggtgggcacatcatttgaagccaggatttcaagaccagcctggccaagatggtgaaaccccatctctgctaaaaatacgaaaattagctgcacgtgctggtgcatgcctataatcccagctacgcgggaggctgaggcaggagaatcgtttgaacccaggaagtggaggttgtagtgagctgagatcatgccactgcagtttagtctggacaacagagtgagactctgtcaagaaagaaagagagaaagaaagggaaggaaggaaggaaggaaggaaggaaggaagggaagggaaggaaggaagagagagagagagaaagaaacaaagagaaaggggagaaagagaaaaaagagaagaaagaagagaaagaaagaaaaaagaaagagagagagacaaaaagaaagagaaagaaacagaaagaaagaaagagaaagggagaaagagagaaagggagaggaaggaagggaaggaaggccaagtgaggtggctcacgcctgtaatcccagcacactttgggaggctgaggcagaaggatcacttgaggccaggagtttgagaccagcctggccaacatcatgaaaccgtctctactaaaaaaaagaaaaaaagaaaaaaaattagccaggtgttatgtgcctgtaatcccagctgcttgggaggctgaggcaggagaattgtttgaacctgggaggcggagggtgcagtgagctgagattgcgccatcgcattccagcctgggtgatgaaacgagactccgtctcaagaaagaaagagagaaacaaggaagggagggagggagggagggaggatcctttcgttctcccacccccaccctgtttgggccactttcctgctgttatttcttccttttattttgcacatcctgatatttttcagttgtgttttgtagcaagcgtacatctaagtcagcgggaagaaaactctagcccgagggtcaagtctggccctccatttgttcttgtcaataaagttttattagcacacagccatgcacatttgtctgcttaccctcaatggctgctttgctagtacaaaggccacatggagtagttgtatctgagatggtgtggcctgcaaaaccaaatgtatttcccacctggctttttgcagaaagaagtgttcattcctgtgtaagtccacagatttcagatggtcggggtctggtggagacctcagtccctgaacacccccagggaatgtctgtctaaccccgccccactacccacgctgtccttccccagatatggatgagtgcagccaggtccccaagccatgtaccttcctctgcaaaaacacgaagggcagtttcctgtgcagctgtccccgaggctacctgctggaggaggatggcaggacctgcaaaggtgatgtcctttcaactctcccccactcccaccactgcatgcagtctagggccccaaagggatgcccaagacatgtcccctgcaatctcaccccctcccatctgcatggagtcaagcaccatctccgaggtctttctcttgtcacccctctgcctggaggtggcaagggcagcccctgggaagcccctaatcccccactgggccctgccctgagcctgctggaccatccgtgctgcagacctggacgaatgcacctcccggcagcacaactgtcagttcctctgtgtcaacactgtgggcgccttcacctgccgctgtccgcccggcttcacccagcaccaccaggcctgcttcggtgagtgacccttgcccctcaccgggaggtgacccatgaccccagcattagttattttgctcaccaaaaaaatatcaagttggccaggcgcaatggctcacgcctgtaatcccagcactttggaaagctgaagcgggtggatcatctgaggtcaggagttcaagaccagcctggccaacatggtgaaaacccgtctctactaaaaatacaaaaaaattagcctggcatggtggcaggtgcctgtaatcccagcaactccgagaagctgaggcaggagaatcgcttgaactcgggaggcagaggttgcagtgagctgagatcatgccactgcactccagcctgggcaacaagagcgaaactctgtctcaaaaaaaatagtatcaagcacccggtgtgtattggacattggggacatgggggtgatcagaacaaagtcgttacttccttagtgctcgcttcctggaggcatctagaacctccttcctctcctttgggaggagagaggccctctcgccttggcttatggcatcttgccttccccctgacaagtccctgctggatctccctcccagagcctccccagagcgctcctgaaatcccaggtctcacatagtcccaggaggaaatcagttcaacagctaaagccacaagggcatctgctaccatcattgtttcttagtgtctcgtggcccccagggaacacaatcttccccaaaggcagagcctagtcaagggtggcccctttcacgcgcccactaatctgcccagacagcacctactgtgtaccaggcagtgctctagaccaaagggtggcaaactccaggctgccagccaagcccggccccctgcttgcttttgttaataaagtttgattgacacacagccaagcccgcttgcttacaatcacctgtggctgcttttgcactatattggcagagaagagtcttgggacagagcctgttacagaaacagaaatggtttgtcgggccctgttatagaccctgggggtacagcaacaaacataaaaggcagggatcttccatcatggaactttccttctagcacagaatcaagactagaggcagacataacaagaaattaacagaatggtgtggttgggtgtggtagctcatgcctgtaatcccatcactttgggaggctgaggctggcagatcacttgaggccaggaattcgagaccagcctggccaacatgacaaaaccccgtttctactaaaaatacaaaaattagccgggtgtggtggtggcgcctgtaatcccaactacttgggaggctgaggcaagagaatcacttgaacctgggaggtggagattgcagtgagccgagatcgtgccagtgcactcagacacagcaagactctgtctcgaaaacaaacaaacaaacaaacaaacaattaacagaatagtgtgttcaaaggtgatgtgtgtcatgaaagaaagaaaaagtaaaagcaggagttcaggaaagaaggagagggccacagggttgttttggagggtagggagaggtttggtggtggttgtttttggttatgttgtctgtctgtttgtttgtttgtttgttttagagatggagtcttgctccatcacccaggctggaatacagcaatgtgatcgcagctcactgaaacttcaaattcctgggctcaagcaattctcccacttcagcttccctagtacttgggactacaggctcaccacatctgggttttttgttttgttttttgtttcttagagatggagtctcttaatgactctgttgcccgggctggagtacagtggctattcacaaatgtgatcacagcacactgaagcctcaaactcctggtgtcaagtgatcctcccacctcagcctcctgagagggcttcagttttaagagagggatcaggtcaagtatcaccaaaagagaacatttggctgggcactgtggctcatgcctgtaatcccagcactttgggaggatggcttagggccaggagttcgagaccagcccaggcaacatggcaagactccatctctacaaaaaatacaaaattagctagaggtggtgacacctgcctgtagtcttagctacttaggaggctgaggtgggaggatctcttgaacccaggaggttgaggctgcagtgagcagtgttcataccactgcagtccagcctaggggacagagcaagactcaaaaaaaaaaaaaagagagagagagagaacatttgaacaaagactcttgaaacaagaggcatttctgtttctctgcaacattaaagtctgtggccaggcataatggctcacacctgtaatcccagcattttgggaggctgaggcaggaggattgcttcagctcaggagtttgagaccagcctgggcaacacagtgagaccccatctctattaaaaaaaaaaaaagtaaggttttcactggatgtgtgagcagctgcatggaccagggccgtgcatcacatgggtaacatccgtggagcaaggtcacacgtgactgcttctctcactagaaatgagtttaaattctcagccaggcagatggtggtgtgaggctcaacttgatcaaaagtcacaaactttttctgcaaagggctcaagaggagtaaatattttcagctttgtagttgagatggtctctgtcgccacgattggactctaccatgctagcatcaaagcagctggagagatacgtaaatgaaagaccgtgtctgtgtcccaataaactttattgatacaacagacagtggcttggattttgtctcagggtgttcctgtctgctaatgactaaactgttaatagaagagcaaactcacatggccacagtaggccagcctgacacttggtttgctttgctagatgtaagggaaagaaattgtgggtggtggcagacatttctgtttttaatttttgagatggagtcttgctctgtcgcccaggctggagattgcagtggtgcaatctcagctcactgcaatctcacctcccaggttcaagcgatcctcctgcctcagcttcccaagtagctaggactacaggtgtgtgccaccacgcccggctaatttttgtattttttgtagagacggggttttgccatgttgcccgggctggtcttaaactcctgggctcaagcaatctgcccatctcggccttccaaagtgctgggattgcaggccacggtgcctggctgtgccagacatttcttctggccagagtctagagctattctctgtggcccctcaagtgacagctcaggcagccgcaggggccactcctacttagaagcttcatgttcccatgtctgttgttcccaagagatattcactttttgtttgctcgtttttgttttttgagacagagtctcactctgtcgcccaggctggagcgcaggggcgtgatcgtggctcactgcatcctctgcctcctgggttcaaacgattctcccacctcagcctcccaagtagctgggattacaggcatgcagcaccacatccagctaatttttgtatttttagtagagatggggtttcactatgctggtcaggctggtctcaaactcccatgctcaggtgatctgcccgcctcggcctcccaaagtgctgggattacaggcataagccactgtgcccgaccccaagagagactctacatctccatagatatgtgcttagtgtcaagaatctctgtactcaaggaagctaaaagcaggattttccaccaggaatttgttgttcattcctcaaaatcccagttcaaatgcagtataccagccatgggctcccaccattgtagcaatgctctctggccattgtaccaatgccctcctaccatcgtagcaacctggccattttagccagctcaggctgccataacaaaataccatagactgcaagtgtgggatttagcaaattcaaatccaaaaactgggccgggcgcagtggtttgcacctgtaatcccagcactttgggaggctgagttgggaggatctcttgtgcccaggagtttgcgaccagcctgggcaacatagtggacaacgtagtccccactaaaaatacaaaaattagccaggcatggtcttgtgcacctgtagtcccagctacccaggaggctgaggtaggaggctcacctgagcccaggaggcggaggttgcagtgagctgagactgtgccacttcactccagcccaggggacagaatgagatcctatctaaaaaaaccaaaattaacagttggttaaatgaagcagagcaaatccacaccaagtgaagatgtggtggccatttaaaattatgcaaataagaatagtaagaaaaatatatatatatgtgtatgtatacatatatttttaagatggaatctcactctgtcagtcacccagactggagtgcagtggaacaatcttggctcatcgcaacctccgcctcccgggttcaagcgattcttctgcctcagcctcccgagtagctgggactacaggcgtgtaccaccacacctggctaaattgttttgtatttttagtagagatggggcttcaccatgttggtcaggctgatctcgaactcctgacttcaggtgatccggaggctccctaggcctcccaaagcactgggattacaggcatgagccactgtacccagcccccaagaatagtaagaatatttaaagacatagaaagatgatcacagactattcagtttaaaacaatagcttacacacacacacacacacacacacacacacacgcacacggacaacccatacactggttggcttaaactacagagatttatttttttttccattctggaagctgggcagttcaagatcaaggtggcagcacggctggttctgtgagggctctcttcttggtttgcagacagccacctttttgctgtgtcctcacttggcagagacagagcaagctttctggtgtctcttataagggcactattctcatcataaaagccctaccctcatgaccttatctaaccctgatcacctcccaaagacctaatatccaaataccagcccactgggggttagggcttcaacataggattttggagagacacgaacattcaatccatggcaccggctgacctcacactattgtcaggtttccatgggaacaaaactcaacaggcaaccctatgtcatttttccatgggagaaggaaaagaggctttgtttatcttttactcttttaccgggcactgccctaagccttttacatgattaggttaatttaattctcgcatgcacacaaaaatgcaatgaggtagacattatcatctccatatacagctgaggacatcgaggcacagagagggtaggtaagttgcccaaggacacacagcttcgaggcggtggagatgagattctttatgtgcaggatctcaaacattggtgcctattctgagtcaggaactgttacagatctcatttcacagagtgggaaacaggcacagagagggtgagcaacttgcctgaagccacacagtggtgggactggcattgtgtcacctgacacgagttccttaaccagcaggcaaccctgcctgatctctctcctctgcagacaatgatgagtgctcagcccagcctggcccatgtggtgcccacgggcactgccacaacaccccgggcagcttccgctgtgaatgccaccaaggcttcaccctggtcagctcaggccatggctgtgaaggtacagcccagctttggctggggtctagtgtttgggggtgttggtcctgagagccgtctggtaaaccctctctccctctctctatgtctcagatgtgaatgaatgtgatgggccccaccgctgccagcatggctgtcagaaccagctagggggctaccgctgcagctgcccccagggtttcacccagcactcccagtgggcccagtgtgtgggtgagtgaaaagggctgggaagaagctgggccctccaccagaatctgctcagagcaggcgactaacagacgccaccctgcaagatgatgtgacaagcacaattatctaaagattgaacaggccagcccagaaggtagtgagttccccactgctggggagtcaaggtgcagcagaataagcatcaaaaagtgtctgagttcattccttagggcatggtggcctggaggactcagttgagaaagattctgagacctgaagtctgcaattttgtgatcacagggaaagagtgctgtgattgattagtgatgtctgccacgagtgtgattagtgatgtctgctatggatgctgcaaggggcaatggaggtgtgcatgctatgtcattgccatagctgttgcagaggccctccatttggggggctagccttctgccccccaaccttcccccatcttctggctgctctaggacctcctagcagcctctttcactgctcttttcattcctccactgcagtgcagctttcaccctctaccattttcaggcccacttgctctctcctgagacctctcctcggcctccatcctctacctccactgctctgggcaccacagtctgccccttcaggctcctggacactctctcctgtggcctttgtgatgtggctatccctgctctcccactgcctcacaggcactgccttctctgccccctccttttgtctgtcatggtgggtctttagctaagttcttcttgggcttcccacaccacacgaccccaccccccaggcaagctgcttgtcccctggggatcttggggatcccacagaccattggcctttgctggcaactcttcctcaacttgtttcctccccccgtactgactcattcattctttccccaactgtttgccaaggacctgcctttcactaggccctgagctcagatgcagaagtgagctgaaaaaccatttctgccttgagtttttcagtccagcaaaggaaacagagattaattagacccctaactaggttctcaacagaggaccattttacccccatagtacattttgaagtgtctgcgagacatttttgatcatcacaattgggatccgccatggtagttcactcttgtgggatattgaggtagggggatcatttgaggccaggagttcaagaccagcctaggcaacatagcaagaccccccatctctacaaaaagttaaaagattagccaggcatgttggtgcacacctgtagtcccagctactcaggaggctgaggcaggaggatcccttgagcccaggacgtcaaggctgcagtgcactatggttgcaccactgcactccagcctgggcaacagagtgagactcccaactccaaacagacaattggaggcggataggttttcctggtgtcaagcgggtggaagccagggatgctgttcaatgtcccacagtgcaaggaggcctcctccctagagaatgatctggccccaagtgtcaatagcactgagggtgagaaagcttgttctagatcatcccacattttggggtttaggggaagtgttgagagatgttgtgaaggagaaccacagggtttggggcagcggggctatggggccgatctagtctcagggctcactgccagcttgctgaagagtttggcattggacttgggctctgaacatacagcattccaggtggagggctctgggggtgtgaaggctgcactgccccacctctgcgtcctccctctcctcctcctttcctcccacagatgagaatgagtgtgccctgtcgccccccacctgcgggagcgcctcctgtcgcaacactcttggtggcttccgctgcgtctgcccctctggctttgactttgatcaggccctcgggggctgccaggaggtggatgagtgcgccggacggcgtggcccctgtagctacagctgtgccaacacgcctggtggcttcctgtgcggctgtcctcaaggctacttccgggctgggcaagggtgagaggctggagtggggcaagcagactccatgccccgcaagcgtccatgcacgcacgcacacacacacacacacacacacacacacacacacacggggctttgtgcatgccaagaatttaccagaagagctccttcagcctgtgcatgcaggcatttgcccacatatgcacagagtcctggacacgcagaggtacagtggcacctgtatctattcacacacatcctcacagcactcacatgtagttgtccacatggcacacacccgtaccagcatgcgtgggcacccttgtgcatttacagatcccagcatgcacacgtgtgtgtgtgtgtgtgtgtgtgcacgcgcgcatgtcccagtgtgcactcaggctcatgcatgcccacatccctgggggcacagtgccattgctacatcctggtttgcacaggtgaggaagcacgcgtcagccatctgtgagtgctcacactatacacacatccccaggcacactcagggagattcacacattcctacgagcacacatgtgcctgcatgagttattccccatgtgaacacacaggttggcacacgcacatgcccctgggtatgctcatgtccattcatccatcccagcctgtgcacgtcctctcactcctgtgttcacacctatgcccaaatgaaccaagggacacacatgcacacccttatgtggtgcacacacactcgtgcacacggagccacaccagcacatgctcagaggcatttgtgtgcgtgggcatttgcagcatgactcagaacggagtatggggtggagcggcgtggctggggaggtcccatcagcccgcctctgaaacccctccaccctgcccatcctggcccaggcactgtgtctccggcctgggcttcagccccggaccccaggacaccccggacaaagaggagctgctctcgtctgaagcctgctacgaatgcaagatcaatggcctctcccctcgggaccggccacgacgcagtgcccacagggaccaccaggtgacatgggtgctgcactaggcaggggtggccagggaatgggtgagtgtgggaaagaggctgtggacccgacttagtcatgtcagcccccccaagaaggagcaccaggctccagatcccaacaggttccccatgtcatggtgccggcttagggccttcttgtgctttctcagccctgggatttttcttggggggggtctctgggggacacatctcccggacactctgcctcactcctggtgacaagtcaggcgtcttccatacagaccctggccgggctgtgatgctttctatgggtcccttttataaaggcacttggatgcagggaaatacctgggcccctccaaccctgcctgcaccctggaatctgtcaccccctcacctcctggttggtgaaggcctcccttgggaccttttgggatttagttccaatggggccctaagtggcctttgtaccacagctctgcccatctcaactcttctgtgcatccctctgggctgttctcacaaacccttaggccaagttaagcccaagccccttccctgtctgagccttggggaggtgagtcttttctctggggaccccagcagaggctccccttaggagccccagggccccaacctgacatacccactcagcatctgccctgtacccctcttgtgcctgaggtgctcctggagttcctgaacctgccttgtctctaggaatctcagggatcttcaacacaccactcagtagccgtagggcaggcctatggctccatccctccttccctctcgggccaccccatcaaggtgtgcagagagggcatttttgccacagatgccagctgcttgcccctcaactgaagagtccctgactatgggtcagtcctgcagccatcacccaagggatctgaaagccaaaaatgtattaaacacctgctgtatgcaggtatcactccaagtgctctctgttcacagcctctcaatgtttatgacaaccctgggaggtgtagatgccactattttttttttttttttttgagacagagtctcactcttgttgcccaggctggaatgcaatggcgtgatctcggctgaccgcaatctctgcctcttgggttcaggcgattctcctgcctcagccgcccgagtagctgggattacaggcgtgcaccaccacgcccagctaattctgtatttttagtagagacggggtttcttcatgttggtcaggctggtcttgaactcctgacctcaggtgatccacccggctcggcctcccaaagtgctgggattacaggcatgaagcactgcacccagcctagatgccactattatccctattttacagatggaggaactgaggctctgagaggttagggcacatgcccaagttacagaacttgaacgtggtggttcagagattccatggatatggcacgtggacttctctttacaagcagccttggcatccatggccagccatcctgggcccctctgtcttccgaagccatcactttacattgtttcccaaacaattatcactgagcatggaaaccattaccccaaactcacccccactgcagacatttaggtcgaagcttcttcactccacagattttactgaataccactgctgggcactgtaatggagcaacagtgaacaacaacaacaacaaaaacacctgccctcgtgaggctgatattctaaaagggagacacacaagaaatcaacatgtaaaacatatcatcttttataacacatgacaaatatgatacatgataagtgctatggggaaaaacaaagtgagacatgggatagggttattgggcttgagaggctttctatattagataaaatgtgagtgtattactttgtattactgaaaggccctttttcccctctagttattttttcccccttgctaggaaaaactgtggatgtatatattatcccatagttactgatattttctgtaaacttcataagggtagagctgtgtctgtaggatttactactgtattggtaccccttggtactcaataagagtgagtgagtggttgtcagggtcccagggcagaagtagatcaagacagagaagggctaatttttgtatttttagtagagatggggtttcgccatgttggccaggctggtctcaaactcctggcctcaagtgatcagcccacctcagactcccagagtgctgggattacaggtgtgtgccactgtgcccagtcaaggccaggattttgagaccagcccgggtaacatagtgagaccccctccacctacaaaaagtaaaaatattagccagctgtggtgccatgtgcctgtagtcccagctacttgggaggctgaggcgggaggattgcttgaacccaggagttcaaagcggcagagagctgtgatcacacctctgcactccagcctgggtgacagacagaccctgtctcaaaaatagggctgtattgtgcctttgcctgcaatacccactgactgccagcaggggtcagtaagagcataagtcttaacaacattccgtgggaagaaggcctgagatctccagaactgaggggctggggaacaggaataactttcacttgaatgcaacagcaaaacactccgtcggcatgtaaatgaggccaaaccaacacagtgctccctaaaacaaaggcaaagaaaacacagatgactttctgtggggttggatacgtcacccagccctggggtagcctgccattgaggctcgctgtcttattcagggccctgtccagctgccaagaccaggaaggcacttcagaggagcttaaataaagaagggtttgtcattggcacacaaggggctctcaaagagggccagatgcaggaagcacagcggaagctatcaggcggctcttctgtctggtcctttacgctctcctctccagccctgcttggcatcccgtttctctcactgtcagctctggcattcttttaggggctggcttctgctgaaaggcccttgttcctaacaccagccatcccaagacatttctgagtgaccttagggctctgggtcgcaatgtcatctgaataatcccctggctgctgggtctctgagagcaaatctttgatacctttggcccaggctggcaggggtctgagcaaggtccctcagctgggactaggggtctgtagtgtgtaacagtggccgtttccctgcctctctcagaagcagcctcagccttatgccactgagtctacagatccagctgaccttgcggatgaacaaccagacttgagatgccaagggaagcagtattttcctccactttatttttttattgatttattatttatttatttatttatttatttgagacaaggtctcactctgtcacccaggctggaatgcagtggcgcaatcatagctcactgcagccttgaactcctgggctcaagcaatcctcccgcctcaatcccccaagtagctgagaccacaggtacatgtaccaccacacctgcccagctaatttttgtattttttgtagagacggggttcaccatgttgcccaggctggtctcaaactcctgggctcaagtgatccacccacttcagcttcccaaagtgctgggagtacaggcatgagccaccgtgcccaccctatttattgattttttttttttttgagacggagtcttgctctgtcgcccaggctggagtgcagcagcgtgatctccactcactgcaagctccgcctcctgggttcatgccattctcctggctcagcctctggagtagctgggactacaggcacctgacactacgcctagctaatttttttttttgtatttttagtagagatggggtttcaccttgttagccaggatggtctcaatctcctgacctcgtgatccacctgcctgagcctcccaaagtgctgggattacaggtgtgagccactgcgcccagcctatttattgatttttaaaatcaatttattttcttttttttggggagcagggtctcactctgtcacccaggctagaatgcagcagtgcaatcatagctcactgcagcttgaactcccaggctcaagggatcctcccacctcagcctccctagtagctgggactacaggtgtgcaacaccacacctggttaatttcttgtatttttagtagagacagagtttcaccaggttactcaggctggtctcgaactcctgggctcaagcaatctgtccaccttggccctcagccaacttcatgtcttttcgtagcacatcttgtcacttttacattttccatttatttgtctactatctgctttgctttactagaaggtaaactccctgaggggaaggatttttatctgctcattgctaaatccccagtgcctcaaagattgccaggaattcagtaggtgcctaataaacatatatatatttttgagacagggtctcagtctgttacccaggctggagtgcagaggtgtgatcacagctcactgctgcttcgaactcctgggacctcccacatcagcctcctaagtagctgggactacaggtgcacaccagtactaatattttcacttcttgtgggtggatgaggtctcactatgttgcccatgctgacctcaaaatcctggccttggccaggcacaatggctcacgcctgtaatcccagcactttgggaggctgaggtgagcggatcacttgaggccaggagtttgagaccagcctggccaacatagtgaaaccctgtctctactgaaaatacaaaaattagccaggcatgatggcaggcacctgtaattccagctacttgggaggctgaggcaggataatcacttgaacccaggaggcagaggttgcagtgagccgagatcgtgtcactgcactccagcctgggcgacagcaagactccatctcaaaaaaaaaaaaaaaagaaaaagaagaagaaacaaagaaatcctgtcctcaagcaatcctcctgccacagcctccaaaagtgctgggattataggcatgagcccctgtgcccatcctatttttttagattgagagggtacaggtttgttattaataaatggatatattgcatgatgaggcagtttgggcttctgctgatcccatcatccaaacagtgaacatagttcccaataggtagttttccttttatttatttatttatttgttttgagacagtcttcctctgttgcccaggctggagtgcagtagcgtgatctcagctcactgcaacctccacctcccgggttcaagcgattctcctgcctcagcctcccaagtagctgggactacaggcgcccgccaccacgcccagctaatttttgtatttttagtagcgactgggtttcaccatattggtcaggatggtctcgaactcctgaccttgtgatccacccgcctcggcctcccaaagtgctgggattacaggcgtgagccactgcgcccggcctcccaactcttgtctccctccctctctccctgctctagtagtcctagtgtctgtgcttcccatctttatgtccatgggtatgcaatttttagctcccacttataactgagaacatgccgtatttggtcttctgtttctgcattaattagcttaggataatgacctccagctgcatccacgttgctgcaaatggcatgatttcattcctttttatggctctttccttcactttagagattggccagaatctcctctttggccacaatccgaggaccccctacccacaccacatcccgattctcctgggctctgaccacacacctggcctttcttcccaggtgaacctggccacccttgactccgaggccctgctgaccttgggcctgaacctctcacacctgggccgggccgagcgcatcctggagctccggccggccctggagggtctagagggccggatccgctacgtcatcgtccgcggaaacgagcaaggtttctttcgcatgcatcacctccgtggcgtcagctccctgcagctggggcggaggcggccggggcctggaacctaccggctggaggtggtgagccacatggcaggaccctggggtgtccagccagaggggcagccagggccatggggccaggccttgaggctgaaggtgcagctgcagttgctttagttgggaggagcctcagtgggccccagctgtccagagaagggggattctggaactgggaaggactgatccccagaagcgatggctgaccagattgaaccccgaaactcaggaagagtgaaatgctacacgacaacctcaggcaagcccggcctctgcctgggcctctgtgccagccccgggggccccccagttactcagtctttcctggagacagcaagaagctgcaatgtgcaatccccctgcccccacagccaaggtcaggaagaggccctgtggtcaccgtgtctggccaatctcaggctttcacttctgtactgcactgtggcttgccctggcggggggcagggggttggcaggacatggcaatgggcaactggggtgggcacagggcttattcctcggagtagaagggtgtacagggggcccagactccacagtgacttgccacatttgccccccatttggagaatgcttttatatcaaaagtggagacgataataaagttattttgggttaagtctgcctgccctttggcaagttcttgaagtaagtagatgctgcccttggactgggcgaggcagatcttgtgcctggggaagcagaaggccttatgggctccccagaatggtaataatggctcacgcttcctgaccacgtactacataccagacaccattcgattttttttttattttttctgaggcagggtcttgctctgttgcctaggttggagtgcagtggcgcgatcgtggctccctgtggtcgccactttccgggctcgagcaatcctcccacctcagcctctcccaagtagctgggaccaaaggtgcacgccaccacacccagctaatttttttaaatttctttttctttctctttctttttgagacagagtctcaccctgtcacccaggctggactgcagtggcgctgtcttggatcactgcaacctctgcctcccgagttcaagtgattctcgtgcctcagcctctcgagtagctgggactacagatgtgtgccaccatacctggctaatttgtgtatttttagtagagacggggtttcaccatgttgtccaggctggtctcaaactcctgacctcaggtgatcggcccgcttcggcctcccaaagtgccgggattacaggcatgagctaccacacctggcctaacatttatttttcttagagatggggatgtccctatactgcccaggctgatcttgagctcctgggctcaagtggtcttactgccttggcctcccaaagtgctggaattacaggtgttagtatccaagtattttaccattattgaccactttgattgtcactacaacctcacggaatagatgctattaccatccccattttacagggaaaactgaggctcagagaagttaaacactttggccaaggtcaggccaggttgaaagttgggtggcctggcggggtgtggtggctcacacctgtaatcccagcactttgggaggctgaggtgagcagatcacctgaggtcaggagtttgagaccagcccggccaacatggcgaaaccccatctgtactgaaaatacaaaaaaaaaaaaaaaaaaaaagccaggcgtggtcgtgggcgcctgtaatcccagctactcaggagagtgaagcaggagaatcgcttgaacctaggaggtagaggttgcagtgagctgagatcatgccactgcactccagcctgggcaacagagcaagactccaccaaaaaaaaaaaaaaaaaaagaggaggggaggggaggggaggaagttgggcagccaggtgcagtggctcacgcctataacctcagtgctttgagaggccaaggaggctggatcacttgaagtcaggagttcaagaccagcctggccaacttggtgaaaccccatctctactaaaaataccaaaattagccaggggtggtggtacgtgcctgtaatcccagttactcaggaggctgaggcaggagaatcacttgaacccgggaagcggaggttgcagtgagcggagatcgtgccattgcactccagcctgggcgacacagcaagactctctcaaaaaaaaaaaaaaaaaaaggtgggcatgttcccaggccatcagcccccacaccaccatgcatggttccaggcggactccaattcgatggccagggtactcattgtgttaataaacacacagttagcatgtactgtgtgctgtgcgtgtcacacatcacagtgtctttggtctccaacaaagcgctatgaggcaggcagtattatcacccccattttccaggggggcaaaattgaggcttagagagcttgtggaacctgtccgggtcacccacatagtgcgcggtagagcccgaacactgaacgtgactccgtttcttctgcaacttcatcccggtccctgatcccaaaccaccagggtgtcccctaagagatgatgtgcttggttttctttctttctttctttcttttttttgagacaaactctcactctgtcacccaggctggagtgcagtggcgtgatctcggctcactgcaacctctgcttcccgggttcaaacaattctcctgcctcagcctcccgagtagctgggatgacaggtgcctgccaccacgcccgactaatttttgcatttttagtagagatggggtttcaccatattgaccaggctggccttgaactcctgacttcaggtgatccacccgccttggtctcccaaagtgctgggatgacagagtgagccacggtgcccggcccaatgtgcattggttttcatccagatcattctctgttgtgatggaaactgaggttgccaaggactgaagacagcatcatcgggtggtgactcaggcctccacctgcagaattgtcactagcgcctggtaccagagctctgtccctggtctggtcctggcttaccagtggcctccaggcagcctataagagcttgcagagggcttctgtgtccatcggctggactcaccacagccctggaatctaagtagagcaagcacagtgactcttattctacagacaagctgagaggtacccagagagtcagcaattggtttaaggtcaccagctgggaagtgcattctgcaaccagtgaccaatgcttggcccctggagagccgtctgttaggagagcttggggtggcaaagatcgcattggcttcaccccagggcagggcagcagcaacttgcacctcatcatgaaatgtaacaggcaagaaaaaaaaagaaaaaagaaatgtaacaggcaggaatgactccatcaccccccaaggtttatttaaaagttatagaaaagcatagcctgggaggggcatccttgaactgaccagagttttggagggacccagagggacacactggcatggcccggggtggacggcaagaaacagaaagtgagagaggtatcctaagtcttctctacaagagccactggctgcccaggattgctgctggtccccggagcggcaaaaggcttaaaatcaggccaactccctctttccagttgccagacgggcaggaggtggtgggggtgcagagggaggaccaactcaggtgcagggattaagacttgacccaaaagacagaggcgtggggacagctgggtctgtagggcgacggttttatcggagaaagatccggcccctcctgtgccgatggagcccagaaatgagccggctcacagtcctgcagaagcaatgagagaggccgaagtaaaattgacggctgtaaaataatagtaactatatgcatttgtctctacctccagtccctacagctcctaaaacccttgtgaatttctgagtaataggagtgctagaatcttttatgctaacttttttttttttttttttttttgagacagtctcgctctgtcgccagactggagtgcagtggcgcaatctcggctcaatgcaacctccgcctccaggactcaagcgattctcctgcctcagcctccctagtagctgcaactacaggcgagtaccaccatgcccggctaatttttgtattttttgtatttttgtatttttagtatttttgtattttgtatttttagtagctaattttgtattttagagacagggtttcaccgtgttagccaggatggtcttgatctcttgaccttgtgatctgcccacctcggcctcccaaagtgctgggattacaggtgtgagccaccgcacctggccttttgtgctaatatttggtctttgaattctgtttctgacacagagctctggatcccttggagtgtcctgggtaatggggacatattttattctaatgaggtgactcttggttggcttctgggtgggggctggtcaccagcaagaccaagccattgattagaaacttggagcttttggtcccattctccaggaaggggaagaaggttggcaatggagttaatcatccttcactcctatgtgatgaagcttctaaaaaattccctggttggctgggcatggtggctcacgcctgtcatcccagaactttgggaggccaaggcaggtggatcacaaggtcaggagtttgagaccagcctggccaacatagtgaaacgccgtctctactaaaaataaaaacaaataaacaaaaaaattgctggtgaaggccaggcgtggtggctcacgcctgtaatcccagcactttggacagttgaggtgggcagatcacttgaggtcaggagttcaagaccagcctgcccaacatggcaaaaccccatctctactaaaaatacaaaaattagtcggcagtggtggtgcatgcctatgatcccagctactcaggaggctgagataggagaatcacctgaacccaccctggaggcagaggttgcagtgagctatgattgcaccatgcactccaacctgggtgacagagtgagactctgtctcaaaaaaaaaaaaaaaaaaaaattaggccgggcatggtggctcacacctgtaatcccagcactttgggaggctgaggctggtggatcatgaagtcaggagatcgagaccatcctggctaacacagtgaaaccccgtctctactaaaaatacaaaaaattagccaggcgtggtggcgggcgcctgtagtcccagctactccagaggctgagccaggagaatggcgtgaacccgggaggcagagcttgcagtgagccgagatcatgccactgcactccagcctgggtgacagagcaagactccatctcaaaaaaaaaaaaatccctggtaagctgagggtactggcctgcagtcccagctactcgggaggctgaggcggtgagctatgtagtcctagctgctcaattaggcagtgagctacaattgcgccactgcactccagcctggcggagagagtgagacctcatctctgaaaaaaagaaagcctgaactatggggttcagggtcttgtgaccatatccgtgtgtgggaggggtggtgtactgcaactccacgggaacagaagcttctacacttgagtcccttccagtctttgcctacctaagcatctcttccatctggcttattcatccctatcctttgtaatatctttttattcttttttcgagacagggtctcattttgtcccccaggctgaagttccaatggtatgatcatagctcactgcaacctctacctcctgggctcaagtaatcctctcacctcagcctcccaagcagctgaaactacaggtgcatgccaccacaactagctaatttaaatttgtttttttttttcttgagacagggtcccgctatgtttcccaggctggtctcaaactcctgggctcaatttttttattatttatttatttatttagagacagagtctcgctcttttgcccaggctggagtgcagtggcttgatctcggcttacttcaaggcccgcctcccaggttcatgccattctcctgcctcagcctccagagtaactgggactacagatgcctgccaccacgcccggctaattttttgtatttttagtagagttggggtttcaccatgttagcctggatggtctcgatctcctgacctcgtgatccacccacctccgcctcccaaagtgctgggattacaggcatgagccaccgcgcccggccatcctgggctcaattgatccttctgcctcagcctctcaaagtgctaggattacaggcgtgagccaccatgcccagcccctttgtaatcttttacaataaaatggtaaacacaagtagagcgcttccatgagtcctgtgagctgttctatcgaatgatccaaccagaggtggaagccctgacttacagacaatcagtcagaaataaagtgacaacttgctacttgcaaccagcatctgaaatgggggcagtcttgtgggactgagtccttaacctgtggattgtgtcactacctccagatagacaatgtcagctggacacagtggctcatgcctgcaatcccagcactttggggggccgaggtgggagaattgcttgaggccagaagttagagaccagcctaagcaacatgacgaaaccccatctctaataaatatatgaaaattagccagacgtggtgatgcatgcctgtaatcccagctacttgggtggctgaggcacaagaatcgcctgaaccctggaggcggaggttgcagtgagccgagatggcaccactgcactccagcctcagcaacagagtgagaccctgccataaaaaaatattaattatatataatatatatatttatatattatatatattatatattatatatattatatattatataatatatatttatatatatttatatattatatataaatatatacattatatatattatatatattatatattatatatatttatatattacatatatgtttatatattacatatatttatattatatatttatatatttatattatatatttatatatttatattatatatttatatatttaggctgggcgcggtggctcacgcctgtaatcttagcactttgggaggccaaggcgggtgggtcacgaagtcaggagatcgagaccatcctggctaacatggtgaaaccccgtctctactaaaaatacaaaaaattagcccagcgtggtggcgggcgcctgtagtcccagctactcgggaggctgaggcaggagaatggcgtgaacccggaaggtggagcttgcagtgagccaagatcgcgccactgcactccagcctgggcaacagagtgagactccatctcaaaaaaaaataataataaatatatatatttatatattatatattatttatacattatatatactttatattatatattatttatatattatatatttatatattatatattatttttatatattatatgtatttatatattatatattatttatatattatatataatatatttacttatatatattatatatttatatattatatatttacttatatatattatatatatttatatattatatatttacttatatattatatatatttatatattatatatttacttatatattatatatatttatatattatatatttacttatatatattatatatatttatatattatatatttacttatatattatatatgtttatatattatatatttacttatatatattttatatgtatatatagagagagacacacacacacaatgtcagaattcagtagaattacaggacaaccacccggtccctgctggagaattgctggctttggggggccctggagctcttgggccactcccctggggctttactttctcacttgctgtggtgtctttgcgctgagtcacagcagtggacagccaccgaggaccctcccctgtgaatctgcggcactgaccgcacaaccacctctcctgggtcctggaggtgaatctcctgtcccagtgtgagccaatcacgagccctcaaccctcagcaaaggtgatggatgggagacagtcacatgaccaagagtccttacctgaattagctgatatcaggagggagacattcctcttactgctgctgatgggattgctaaacttggacgatgataacttggagtttccagaactcaacttctttacagcatgagggcctgctggagaaatggagagagaaataagcaagagctctgccatcatcctttgagctcctggatccagctgagcctgaagctgttgactggttatttaagccaatgagtctcccatgtgcttgagctttccatctgtaccagtggaaagtgtcctgattaaaagagctggactggctgggtgcagtggctcatgcctgtagtcccagcactttgggaggccaaggcaggtggattgcttgagtccaggggttcaagtccagcctgggcaacatggcacaacctgtctctgcaaaatgaaaataaaaaattacccaggcatggtggtgtgtgcctgtaatcccagctacttgggaggctgacgtgggaggattgcttgagcccaggaacacaaggctgcagtgagatgtgattgtgccactgcactccagcctgggtgacaagagtaaaaccctgtctcaaaataataataataataatgagctggagccaggcatggtggttcatgcctataatcccagtgctttgggaggccaaggcgggcagatcatctgaggtcaggagttcgagaccagcctggccaacatggtgaaaccccgtctctactaaaaatacaaaaattagccaggcgtggtggcgtgggcctgtgctcctgctacttagggggctgaggcgggagaatcgcttgaattcaggaggcagaggttgcagtgagccgagatcgtgccactgcactccagcctggatgacacagcaagactccatctcaaaaaataaaaataaaaaataaaataacaatgagctggattagtggagcatgcctgtagtcccagctactcaggaggctgaggtaggaggattgcttgagcctgggaggtcaaggcttcagtgagctgtgatggcgccattgcactccagcgtgggtgacacagtaagactctgtctcaaaataataataaaagagctggactggtggcacacacttgtaatcccagctacttggggaatctgaagtgggaggattgcttgaacccacaagtttgaggccgcagtgagctatgatcatgctactgcactccagcctgggcaacagagcaagaccccatctccagaaacaaaaactggacaatgactcaatcagttggtcattcacttggtgccccactcaccagcaactggctttgtttggggttcaggcaggtgtcagtattctggtctccaattccctccctcggggtctgaaccacacatgggcttgcaggcagggagggcaggccccctagatgcccagcagaggtcttgcccaccttggaaggtctgcgtgttgtggtggagctttgcaaaaaccttatttcgagcatccaggagcttcatggctctctgcacctccctgcttttggggttcccacacaccttcctgtgtctcttggggaggtagaatctgtggtgagcagaggggggtgcccaggttagggtgtaggctggcagcaaggctgtgtgtgcaccccacccccccagcccccacggccccactcacatcgcagcaggcagattgcagctcccgctcacctcctggatccggtaagtccaggcgcgccggagcacagcccacccaatggggtagtggtaggccaggcagcagtcctcaaagacacctgcaaccacacagccgcccagatactcgcacccttgcatgttaacttggcagggccagccacaggcaagggcacctgtctgcatacctgtctgctcataccacaacccttccaggcccggcagaggctgaggaacagccttaggaaagaaaaagcctcctggctcaccccttatccctggatattgggacagccagaggttggagaggacccttgggtcccggctgggaagggtgtggaaccagcaaatgaacggaccaaggccacctctactcctgctctggggaaaagggtgactcggagtgcaggtgcactgtgaggaggggccaacaccacccctccccagccaagttcttccctcctaaaaatgagctgattggcagctcagcacagtggctcatgcctgtaaacccagcactttgggaggctgaggtgggtggatcacctgaggtcaggagtttgagactagcctggccaatatggtgaaaccccgtctctactaaaaaatataaaaattaggccgggcgcggtggctcatgcctttaatcccagcactttgggaggccaaggtgggcggatcacgaggtcaggagattgagaccatcctggctaacacggtgaaaccccgtctctactaaaaatataaaaattagccgggtgtggtggtgggcgcctggagtcccagctactcgggaggctgaggcaggagaatggcgtgaacccgggaggcagagcttgcagtgagccgagatcgcgccactgcactccagcctgggcgacagagtgagacaccgtctcaaaacaaaacaaaacaaaaaacaaaaattagccaggcatggtggtgggcgccttttttttttttttttccagagtctcactctgtcacccaggctggagtgcagtggctcaatttcagctcactgcaacctctgcctcccgggttcaagcgattctcctgcctcagcctcccgagtagctgggattacaggcgcccgccaccacgaccagctaatttttgtatttttagtagagacggggtttcaccatgttggccaggatggtcttgatctcttgaccttgtgatccacccgccttggcctctcaaagtgctgggattacaggcgtgagccactgtgcctggctgatagtgggcgcttttaatcccagctactctggaggctgaggcaggagaatcacttgaacccaggaggtggaggttgcagtgagccgagatcacgccattgcactccagcctgggcgacaatagcaaaactctgtctcaatgaaacaaaacaaaacaccaaccaaacaaacaaaaaattgttttaatacaaagtaaagagctctcagtaaatgtcaatgtctagacaagcagagatgaaacacacagatgaattagacctagtgttgtcttcagggagctcccgggaaactgatctctgcagaaagggggaagcacaggcactgtggggggtgcccagaggaggaggaggtgatgccagaaagttctggggggatgagcaggtggaatgaatgagccgaggatgagctgatgagatagtggaggaagctggggtgcaattctctgcctaaatggcctttggagttctctgcaatctcacctctgccagaactaacctccagaggccgagtctgagtccctgcagagcccagcccagcaggagcagggaaagggaggactcgagccctccaggtgtctcccaaccgcggcctctgagggcaaggggcagcgcattctgttggaacctcggactgcagtgccaggcaggtagttcccaaggctggaggccaggatcgaagggctgggctgggcctggctctgatagcaaaacaatcagaccacagcccaacccccttcccaggcaaaggccaaggacttggacccatcagacccagccgaggggcaggtgggtcaggtgggggcagacagggaaggagggtgggaccctgggtctgccgcccagccagggaccctgctttggccagctgctgaaactcagaggatgtaggacccagtgtcagggctcccgtggggacaccccaggcccaggaattgtcctttggcgactgaaatcctcaagtgcttgctctgcggtagggagtggggaagaaggaaagagttccctattaataacaggaacagttactattgccgccgccagacatgaggcctagtcttttgcaggcatgagctcactggaccctcaagtcagagccatgcagtgggaattttagattcccactttgcagctgaggaaacggaggctcctaaaggtttaggaagccgggcacagtggctcaaacctgtaatcctagcactttgggaggctgaggcaggcggatcgcctgagatcaggagatcgagactactctggccaacatagtgaaaccccatctctactaaaaaatacaaaaattagccgggcatggtacacacgcctgtagtcccagctacttgggaggctgaggcagaaggatcgcttgagcccaggaggcggaggttgcagtgagccaagatcgcgccactgcactccagccagggtgacagagtgagactctgtctcaaaaaaaaaaaaaaaaaaatggtttaggagcaactaactctcagctggactgcatggagggaccaggatgggaatccactcttgtcagtctccagggccctgatctccaaccccacccctggctcggcaggattaggattctacaatacatccctggcagtaactggctttgcccacagctggaagccaccctctgctccctcacatctttaggagtcttgcaaaagactccatggggctctcgaagaaggaactggggactctccatctccccgaccccatcccaagagctaaccaaacaccaggagttcctgcatgtcaggagcgggagaattcagtggagatgggattggggagacttccggaggagataagagacaaaaggggtggggtgggggcatggggagaggggcacttggtggtaggcattgccgaacacagtaccttgggtgtggacagcgggggcccaggctcccaggaagccggccaccaggcaggccaggagccacaggttcatgctgcaggcgggtcctcctccctgggcacctggacgaataacggggccacctggggtcgtggagggaagtggtaaggactgaggaagaggaggggagtgggtactgggaacatcccccctcttaagccccaggcatatggcaagggaaggaggttgtataaagtaggaacaagttgtgctggagggaaaagctgttcatctcagtcatgttcaaggaaaagactcaccgatatccactgggtcaagggagctgatgcccgccgggctgtaggccaagctgtcccatctgcaggaccaacacgctgagcttcactctttatagacagagccccacccagccaccccctgcccgccctcctcccttcctcctcctctccacctgcactctcagcctctggaattctccctcttctacagcaagctccaacctcgacccacaggcccccttgcctccccactccccatcccaggcctcccagccagcacccctactgtctccagaaagggccttttcccctgtttccctcacctgcacacacctggtggacactggctgcctgcgaacaaggctcagactgccttgagcccccaaacaagcccttaccttcatgctccccccgccctcaagccacctgttccctggtgggtccccaacttcactccatttccctctccttccacaccatggttaggtaacttagcatgtcacagaaatcctctggttgtgatcacaggcaaatccatagaaacagaaagtaaattagcggtggccacaggatggggggaggggagaatgaaggactgactgtgagagggtatgggtttccttttgttctgaaattagatgagagtgatggttacataactctatgaatatagtcagcacggcacaatggtgcacctcccaccggtgaacaaccccaacaagaaagaaactctctaggccaggcatggtggctcatgtctgtaagcccaacactttgggaggccgaggccagaggattgcttgagcccaggagctcaagaccaccccgggcaatatagagagacctgcgtcactacaaaaattttttaaaaaattagcctgacgtagtagtgcatacctgtagtcccagccactcaggaggctgaggtgtgaggattgcttgagccttggaggttgaggctgcagtgagctgtgatcatgccactgcactccagcctgggcaacagagcaagaccctgtctcaaaaaatggaaaaaaaaacggtggccggacacagtggctcacacctgtaataccagcactttgggaggccgaggcaggcggatcctctgaggtcaggagttcgagaccagcctggccaacatggcaaaaccccatctctactaaaattacaaaaattagccgagtgtggtgggggggcacctgtaattccagctactcaggaggctgaggcaggagaatcgcttgaacccgggaggcggaggttgcagtgagccgagattgggccactgcattccagcctgggcgacaagagtgaaactctgtctcaaaaaaaaaaaaaaaaaaaaaaacaaaagaaaaagaaaaaatggaagaaatgttttgtttttggaagaaaagccaggagccccgggtagccatgccctcaggaagcaaagcaacattcaccgagaaggcatgtcttttttttttttcttctgagacggagtcttgctcttttgcccaggctggagtgcggtggcgctgtctcggctcactgcaagctccgtctcccgggttcacgccattctcctgcctcagcctcccgagtagctgggactacaggctcccgccaccacgcctggctaattttttgtatttttagtagagacggggtttcaccatgttagccaggatgggagaaggcatgtcttctttccctggggcagcaggacccagccaggacacagggactgggggagacacgaggtgaagattagggagggcgaaaggagcgctgcagaggccgcacagctgattgctttaaactttttatcgcctgcatccatagctacatctgacctctgtgggtatttatcacatcctaaactcctttctcatttctccccttccactgggagcccagaggcggcggcccctagcctacttccctgtcccaaaccacatggccgggtgagtggggcttagaggtggggccgggcctggtgggtgtggcttctagccggggacgtgactagataaatgacacttagagcccaggggcagggctgggtgggcgtggcttatggctatgggcggggcttgctatatggctccgagtcaggggcagggcagagtgagtgggatttaagacagtgggcggagcctgacagatggcgcttatggtaaggggccgggctttgtaggaggggcttagactggggcggggcttgcacggtcagccccgccccaccagagcagttaagacgcgtcgggggcaggtgctctcacccgtcccgttgctgcggccagtggcagcccacgggccggggcgctgttccagttcctccgcctcttgctctgggtgggtgaggctggaccaggacgcggctccgcgtggctgcgagcgtggggaagcggcgtggcgggctggggccagcctctccgctacggctcactgccccctaccttcccaacccgcgggccgcggccaagacggtgttacccagacttgggggaggtccccaacgtgagtctccctccctgcctcacccctcactgtttgtcccgccggcagccttcacggggaggaagggttcccagtaagggggccctccagggaccagcaagcacggagcactggggtgggcgcgctggggacctgggacccaggggttggagcaagaaacgggatgatcccggagttctgaggaccacagttgctttgagtaaaggccagaccttcacagtcggggctggactggcctcttccactcctgcagcagctgggggcattaagagtaatccgctatcggccgggagcagtggttcacacttgtaatcccagcactttgggaggccgaggcgggcggatcacctgaggtcaggagttcgagatcagcctggccaacatggtgaaaccccatctctactaaaaatacaaaaaaaaaaaaaaaatagccgggcatggtggtgcgcacctgtaatcccagctacttgggaggctgaggcaggagaattgcttgaacccaggaagtggaagttgcagtgagccaagatcttgccattgcactccagcctgggcaacaagagcaaaactccatctcataaaaaaataaaagagcagtccgctatcagcaagggtcctcttctccgccagtgtgaaatcagcacagctggggggaacaagtgccccccacaccgacttctgttctgcacctctgatgatgggagcagttgagggtggtctccatcctgtagctcagccaaattcagagaccaataccccagagcctgcagggttgggtgggtaggcaggtgtctttctagacaagcccagttggttgcagtggccaggtggtgggcaggggcgatgagatgttctgggaagcctgcaccagccaccaccacatctgccctacccagtggcaggcacctctagtgggatgaaggatgctcctgggtgctcaccattggcccaactgtgcaaaggaggagattgagggtcagagaagccaagttacttactttttttgttggccaggaaaatctaatttttatttcttaaatactgtgaagaaaaggacagtcccccaatggggaagcgccatagagcagatgactgggaggtcatcggcaaaggctcaggggcactgggagaacactatgggcagaagtgggggtcctcctgtagtcacttttgcatatcagaccccagctgcctgcagctctcctgaactctggtgcctccaggtccctgatgagactcttggcttctgatgggcccccactgccctgcatggtcacgagtcttgtagggagcaatccacaccccaggagccccgtctgccaggcctggactcctgttgtacccacagctgcctcttttttttttttttttcgagacagagtcttgctctgttgcccaggctggagtgcagtggcaggatcttggcttactgcaacctccacctcccgggttgaagcgattctcctgcctcagcctcccgagtagctgggactacaggcgcctaccaccatgtctggctaatttttgtatttttaggagagactacatttcactatgttgcccaggctggtctcgaactcctgacctcaagtgacctgctggccttggcctcccaaagtgctgggattacaggcttgagccaccatgcccagcctccagttacctctttttaaagagaatttggttatttgaaagatctttcttcttttttatgtaggcatttatttattgctataaacttccctcttagaaccacttttgctgcattcattggtttaggtatattgtatgtccatttcagtttgtctcaagttttttgttgttgttgtttctgtttgttttattttgtttttagaaacatctccctctatcacccaggctgagtgcagtggcacaatcgtagctcactgcagcctccaactcaagtgttcctcccaccttagcctcccaaataactgggactacaggtgagcatcaccatgcctggctaattatttttattttttgtagagatggggggagcgtctcactatgttgcccaggctggtcttgaactcctggcttcaggtgatcctcctgcctcagccaccaaagtgttgggattacaggcgtgagccactgcacctggcctcaagatattttttaatttcgttttaatttcttctttgacacattggttgtttaggagagtgttgttgaattctcacgtgtgaattttccagaattcctcctgttattgatctctagtttcgtatcactgtggtcagaaaagatacttgatacaatcgcaatcttacatttgtttttttgttgttgttgttgagacggagtctcactctgttgcccaggctggagtgcagtggcaccatctcggctcactgcaagctccacctcccgggttcacgccattctcctgcctcagcctcccaagtagctgggactacaggcgcccgccaccaccacacctggctaattttttgtatttttagtagagacggggtttcaccatgttggtcaggctggtctcgatctcctgacctcgtcatccacccgccttgacctcccaaagtgctgggattacaagtgtgagccaccgcacctggcaatcttacatttgttcaggcttgctttgtggtctaacatgatctatcctggagtatgtcccctgtgcacttgaggagaatgtgcgttccgctgctgtcaaatggaatgttctacatatgtcattagttccatttgatctacagtgcatttcaaatccaatgtttccttactgattatctgcctggatctgttcgttgccttttttttttttttttttttttttagacagagtctcagtttgtccaccaggctggagtacagtgatgttgttatggctcactgcagccttgaactcctgggctccagcaatcctcctgcctcagcctcccaagtagctgggactacagatatgcaccaccacaacccacaaatgtatatttttaattttgtggcctgttgcccaggctggtgttcattgttgaaagtgcagtactattcctgtattgcagttcagatctgttcatatttcctttatatatatttcctttatatatttaggtgctctgatgttaggtgcatatatatataattgttttatcctcttgatgaactgacccctttttcattctataatgaccttcttcctctcatgttagagttttgacttaaaaaatattttatctgatacaagtacagctacccctgatctctttcggttttcattttcaaagaatatctttttgcctcccttcactttcagtctatgtgtgtctttaaaccagctgcctcttgctttggtccagatgcatagtggttgcccagcaaccggaggaggagaaggaggaggaggaggaggaagaggaggaggaagaggaggaggaggaggaggaggagaaggaggaggagaaggaggaggagaaggaggatggggaggagaaggaggagggggaagaggaggagggggagaaggaggagggggaggagaaggaggagggggaggagaaggggggggaggagaaggaggagtgggaagagaaggaggaggagggggaggaggaggatggggaggaggaggagaaggaggaggaaggaagaagggtttttccaggatgtcttgcaagcccttggcctgatgttcgagaatttggttaactctaacctgaaccctaagtccctgatgtagctggctctgctggctcctggaaagtcagttctgaggggatccccaccccaggctaacctgaggcctctgtcttccaggggacagctgtagcagtggcctgggcaggggccgtggttctccagagggattcagactactggtattaccgagctcatgaccttggctttcatccttgtacttgtcctgcccctgcaggatgtgcgggggccagacagctgggaagagtgactgcctgatcctggccctgctgccttgggctagaggaggggttgcatggagagagagggtggcaggccttggggagagggtcccatagggtcctgagtccctctttgaacgtgctgagctctactcaccctttccacatctgttttctgagtatcccttatgttccagccacatgcggggccccagggtgccccagggtgacagcagtgagcaagccgacacattgcaactatcaaagatgatgatcgctggctgggcgtggtggctcacacctataatcccaacactttgagaggccaaggcaagaggatcacttgagcccaggagttcgaaaccagcctgggcaacatagtaagacccccatttctacaaaaaaaaaaaaaaattttttttttttaaatagccaggcaaagtgaccggcatctatagtcccagttactcaggagactggggcaggaggattgcttgatcccaggagttcaaggctgcagtgagctatgattgcaccactgccttccagcctgggcaacagagtaagaactcatctcaaaaaaaaaaaaaaatgatgatgttgatgtcacagatgcctcatggaacatctatgtgggaccatttgttattcattcaataaacacttattgagcaccctctatgtgcccagcactgagctgggtgctggggacaagcagtgaaggagtcagtcccacgtgctcagtgcctagtagcattgcagacaagagaagcagcaagtaatgaagcaagacattcagatgtgactttctgctgacaaggaaaaacaaattttaatttaaaaaaaatttaaaaacaattttcagatgaggatcactgtcaccaatgctggtgtgattggaagagactagggatgggctggatgccgttttttttttttttttttttttttttttttgagacagggtctcactgtgtcaccctggctggagtgcagtggtgcgatctcggctcactgcaacctccacctcctgggctcaagtgattctcccacttcagcctcctaagtattacaggcatgtaccaccacgcccagctagtggatgcctttaaagagagtggcttgaggtaacaagaaccttattaggttaaaattcattcctactttatagggaaagaacaatcaaccgaggctgagagaggttacattgcttgaccaagtaacttgactaagtcgcttgtctctaaacaaattaattaagtaagtaaaaacaggtgcccagtgatgtgcagagagctggagacagaaggcagataataccactctccaagtggccctcacagctaataggaggatttttttttcaagataatgtctctgatttgtttttggttttgggtttttttttgttttttggtttgtttgtttgtttgttttttgaaacagagtctcactctgttgccaaggctggagtgcagtggtgcgatcttggctcactgcaaccttcgcctcccaggctcaagcaattctcctgcctcagcctccccagtagctgggattacaggcacgcaccaccacacccggctaatttttgtatttttagtagagatggggtctcaccatgttggccaggctggttcgaactcctgacctcaagcgatccgcctaccttggcctcccaaagtgctgggattacaggcatgaaccactgtgcctggccgagataatgttcctgttgcccaggctggagtgcggtggtatgatcacagctctctgtagtcttgacctctggattcaagcgatccccctgcctcagccccacaagtagctgggactacaggcacatgccatcatgcccgactaattttgtaactttttgtagaaacagggtctccttatgtggcccaggctggtcttgaactcctgggctcaagggatcatcccgccttggcctcccaaagtgctgggattacaggcctgagccaccttgctctgccttaggctgccatgtctcctgatcagacattcctggaggaacatctgcatcaggctgtggggatgtgaagggcatcccacctgtctccagggggacctgcagctgaatggtgacctgaaggacaacctcgtgttagtcagagaccagcagggcaggacgctagagggaactgccaagtgcagagtatctggggcaggaggtgcgggggtggatagcggaagatgaggtaggcagggagaagctatttggagcctcacgtgccaagcccagaagggtgaccttcatccagaggccaagaagaagctgccgaaaagatttatttatttttatttttatttttgagacagagtcctgcggcccaggctggagtgcagtggcgtgatctcggctcgctgcaacctctgcctcttgggttcaagcaattctcctgcctcagcctcccgagtagctgggattacagacccgtgccatcacgcagagctaatttttgtaattttagtagagacggggtttcaccatgttggccaggctggtctcgaactcctgacctcaggtgatccgcccgccttggcctcccaaagtgctgggattacaggcatgagccaccgcacccaccctgaatagatgtatttagtcaggggagggttgtggtcaggtctgcatctgagctctgccaaggtcatctggaagatgccgcagagggtgaggtgagggcagggagattcaacagcccaggcatggtagggcatggtagtgtggacctgttgtcacagctattcgggaggctgaggcaagaggactgctcgagcttaggagttcaaggttgcagtgggctatgattgcaccacagcactccagcctgggcgacagttagactctgcctctgaaaaaaataaaaacaggatggggcgcagtggctcacacctgtaatcccagcactttgggaggccgaggcgggtggatcatttgaggtcaagagttcgagaccagcctgaccaacatggtgaaacccctgtccctaccaaaaatacaaaaattaaccaggcatggtgacgggtgcctgtaatcctagctactcgggaggctgaggcaggagaatcacttgaacccgggaggtggaggttgcagtgagccaagattgcgctgcgtgctgcactgcaggctgggtgacagagcgagactcagtctcaaaaaataattaattaaaaataaaaaaagaaagtggcatgctggacccactgggtgaaggtgggcagatcctagaattaggtctctctttctggaatgacgggggcgatctgagccgcctccttagctccctggagaatcagacaaacctccctcccactgctacctacttctcaaatgtgggaaccctggcagtccagtaggccggccatgcatacaaagggaacccaggaggctgtcagtgcctataggattagggaatctgtctgcgctttcacctctgctcctccaacccgtcttcctgtggttctttttctgtttttttttttttttttttttgagatggagtctcactctgttgcccaggctggagtgcagtggcacaatctccgctcactgcaagctctgcctcccgggttcacgccattctcctgcctcagtctcccaagtagctgggactacaggcgcccgccaccacgcacggctaatttctttttgtatttttagtagagacggggtttcaccgtgttagccaggatggtctcgatctcctgacctcgtgatctgcccacctcggcctctcaaagtgctgggattacaggcgtgagccaccgtgcctggccctttttaagacagattcttgctctgttgcccaggctggagtgcagtggcaggatcttggctcactgcaacctctgcctcccgggttcaagtgattctcctgcctcagcctcctgagtagctgggattacaggtgcgcaccaccacacctggctaatttttgcatttttggtagagatggggtttcaccatgttggccaggctggtctgaaactcctgacctcaagtgatccacctgcctcagcctcctaaagtgctgggattacaggcatgagccgccgtgcctggccaatattttctttttctttttctttttttttctttttttttgagacagagtcttgctctgtcacccaggctggagtgcagtggtgtgatctcggctcactgcaagctccgcctcccaggttcatgatattctcctgcctcagcctcccaagtagctgggactacaggcacccgccaccatgcccagctaattttttgtatttttagtagagacggggtttcaccgtgttagccaggatggtctcgatctcctgaccttgtgatccgcccgcctcggcctcccaaagtgctgggattacaggcgtgagccaccgtggcctggccaattttttgtttttagagacagggtctcactctatcgcccaggctggagtgctggtgttatcacagcttgctggagcctccaactcctgggctcagaccatctgcccactttagcctcccacagtgctgggattactagcatgagccaccttctctggcctctcctggttgttctaagcacgtggattcagatctgccagttgcccactcagtcctgggggcgaggtgctggagaggaggctggggaggaagattgggtcaccacggttcctctttcctgcctcttctctcacggcacctgctgttcccccagggctcccacctccgcttgtctcctgctgagcctttgccctagtagcgcactctgcctggcaagccctccctctgcccatctccaggcagccagcatggctgggattatgtattcagcttcgagctctgacaccctgtcaccctgggccacatgttgggaccgccctattctttcttttttttttttttttgagacggagtctcactcttttgaccaggctggagtgcagtggcatgatctcaactcactgcaacctccacctcccgggttcaagcagttttctgcctcagcctcccgagcagctgggattacaggtgcctgccaccacgcctggctaatttttgtatttttagtagagatggggtttcaccatcttggccatgctggtctcaagtcctgaccatgtgatccacccgcctcggcctcccagagtgctgggattataggcgtgagtcacctgcctggccgggactgccctattcatctctgtctgcccctgaaatcttattgtgtacgtgcctccacttcaaggccatcaaacctcatggaagggatgtacttcagtcatccctttgcctgtgatgttccccttccccaccaatagaggctgagcaagcacctcagacttgagagtggaccaagcctccttgctgcaggcccccaagtgcccaagggagctctcagcttgtccagcccttcacaggcctataaactcttctcagtcctggctgggtgcagtggcttatgcctgtaatcccagaactttgggagaccgaggcgggtggatcacttgaggtcaggagttcgagaccaccctggccaatatagcgaaaccccatctctactaaaaatacaaaaaaaaaaaaaaaagcgaaacccaggccaggcacagtggctcatacctgtaatcccagcactttgggaggccgaggtgggtagatcatgaggtcaggagtttgagaccagcctgatcaacatggtgaaaccccgtctctacaaaaaatacaaaaattagatggtcgtggtggtacgtgcctgtaatctcagctattcaggaggctgaggcaggagaatcgcttgaacctgggaggcagaggttgcagtgagccgagatcgtgctactgcactccagcctgggcgacagagcaacaggactacagagcaagactctgtctcaaaaaaaaaaaaaaaaaaaaaaaaagcgaaaccccatctctactaaaaatacaaaaatattagcatgcatggtggtttgtgcctgtaatcccagctactcaggaggctgaggcagaagaatcacttgaacccaggaggcggaggttgcagtgagccaagattgtgccattgcactccaatctgggtgacaagagaaaaattctgtctcaaaaaaataaaataaaaataaaaataaaaataaaattaaaaaaaactcttgtcaggcccccctttcccccagctttcccacttccccctacaccccacacttacttgtgtgcctcccttgttctgggctaatttcatgtgcattgttgcaatagatgcttacagtgacacattaaggtaaacaatatacttattcccattctacacatgaggaatttgtgatttgatcagggtagccaagccaagtattgttgttacttttttgagacagagtctcactctgtcacccaggctggagtgcagtggtgtaatctcagctcactgcaacctccacttccctggttcaagtgattcccctgcctcagcctcctgagtagctgggattacaggcgcccaccaccacacctggctaatttttgtatttttaggagagacatttttcctgacctcaagtgatccatccgccttggcctcccaaaatgctgggagtatagacgtgagccaccatacctggccccaagtgttttttttgttttgtttggctttgttttaaaaaaataaaataagcctggccatggtggattacagcactttgggaggccgaggtgggcagatcacctgaggtcaggagtttgagaccagcctggccaacatggtgaaaccccatctctaccaaaaatacaaaaattagctgggccgtggtggtgcatacctgtagtcccagctactcaggaggctaaggcaggataatcgcttgaacccggaggcagagtttgcagtgagctgagatcatgctactgtactccagcctgggcaacagagcagagtctgtctcaaaaaataaataaataaataagtaaataaataaataaataaataaataaataaataaaaagcaatgattttccctttgtgggtctgggggtcacctgtagccccactggaacttgctccaggctgtgagttggatttgcatctgttccatgtgacttttcattcagaggcttcagggcccatatttgtttttttgtttttgagatggagtttcattctttcccagccccccaagtagctgggattacaggcatccgccaccgtgcccagctaatttttttgtatttttagtagagacagagttttaccatggtaagcaggctggtctcgaactcctgacctcaggtgacccatcagggcccatatttgtttcatggcaaggtgacatgcaagcagagtggcgggaccacgtgatgcttcctcagcctttgtctccgatctgatgagggtcacttccatgcaggttccattggccaaaacaagtcatatggccacaccctaagctggagaatggggagtgcaccccacccacagggagcagtgatcaggggaggaagagaggaagatgtgttgtcttagtctctttgtgctgatataacaaaatgcctgaggccaggtaatctgtcaataatagaagtttattgcttacagttctagaggctgggaagtccaagatggagttactggaggattcagtacctgggtgagggctcattctctcctcccaaggtggagccttcttgctgcaccctcacacagcagaaaggtaaaaaggacctacctgctccccttcaacccccctctcttgctttttttagagacagggtcttgctatgttgcccaggctggagtgcaggggtgtgatcatagttcaatgtaaccttgactcctgggctcatgcaatcatcaagtcctcagcctcccaaggagctaggactacaggagcatgccaccacacccagctaacttttttgttttttgcaaagatggggacttgctgtgtttcccaggctgctctcagacttctggcttcaagcaatccttccctcctcagcctcccaaagtgctgggatttcaggcatgagccacctcacccagccttttctaatgagattaatcccattcatgagggcagagttctcatgacctaatcatgttccaaaggctgtaccttctaatactaacaccttgggtttttagttccaatgtatgaattttggagggacacatacatttaaacaaaggcaattgtgaacaaatgataccatccaccacagtcatgtaaagtccatgatgaatgttcctgattggcaggtagggcttctctgagggctgtttccagaacacaggtcccttccgtcttctggctctgccatctttaacatatagctcccaaggtcaccagcttggagagcttggagagtgaaccaccatgttggccaggctggtcttgaactcctagcctcaggtggtccacccgcctcggcctcccaaagtgctgggattacaggcatgagccactgctcccggcctgttccttattttttatttattgttgatattttgaatagtagaagtcaagatgtagccgactttgaaatgcttcccagccaggcacggtggctgccacctgtaatcccagcactttgggaagccgaggtggaagggtcacttgaacccaggagtttgagaccagcctgggcaacacagtgagactttgtctctacaaaaaatttaaaaattagccaggtgtggtggcacacatctgtgatcccagctacttgggaggttgaagtaggaggatcacctgagcctaggagttcaagaccagcctgagcaacatagcagaaccccatctttaaaaaaaaaatgagcagggcatagttgtacacatctgcagtcccagctactagggaggctgaggcagaaggattgcttgagcctggaaagttgaggctgcagtgagctgtgattgcaccactgcactacagcctgggctacagaacaagactctgtctcaaaaaagaaggaaagaggaagaaagaaagaaaggaaggaaggaaggaaggaaagagagagagagagaaagagaaagaaggaaggaaggaaagagagagaaaggaaggaaggaagggagagagaaagaaagaaaagagaaaagagaaagaagaagctgggcacagtggctcacgcctgtaatcccagcacttttggaggctgaggcaagcagatcacttgaggtcaggagtttgagagcagcctggcctatatggtgaaaccccatctgtgctaaaaaatatacaaaaattagccaggtgtggtggtgtgcgcctgttgtcccagctacttgggaggctgaggcaggagaattgttgaacccgggaggtagaggttgcagtgagctgagatggcaccactgcactccagcttgggcgactgggtgacagagccaaaaaaagaaagaaagaagaaagaaagccaagaagaaggaagaaaggaaggaaggagggaggaagggagggagggaaggaaggaaggaggaaataaaggaaaggaaggaaggaaaaggaaaagaaaagaaaaggaaaaggaaaagaaaagaaaaggaaagggaacagaacagaacagaatagaaaaggcacacttggagggaagtgtttctatctctaggaactggccagccccagaagggaccgtccgtccctctcctggtcttcaaagccctagatctaaagtatcataagcacagaaaattaaaaccacgattcatacatcaccctctctcttccatgaccacctgttgttttcccttccctggttccacagctgctccctctggcaacagatggataaatgccaggattgctctcaagtttcccccatgccaaagaaatccagctcccccatcccatcctgcctcattgtcccctctctcgcctcctggtcctaaacccctgcactggctcccaatttaagctgaacagccttagcccccgctccttacagctctcactctttcagctgcagaaacacggccccatgagtgtctgtatcacagccttctttccatcacctctgacgtgaggctgtttgttcaaggtggtgcccccagccctccttatctctggcatcaggaagaggcatggtggacccccgggctgatagcggaggccaggggacgccaaggcaacacagcctgatcttcctattttagctgctactgaaagggttaagggtgctgcatagggtaggtgtccatttgactgtgaatttcctttcttttgtttgtttttttgagacagagtctccctctgttgcccagggtggagtgcagtggcacgatctcagctcactgcaacctctgcctcctggattcaagcaattcacaagcacccgccaccatgcccagctaattttttttttttttttgagacggagtctccttctgccacacaggctggagtgcagtggtgcgatctcagctcaccgcaacctcttcctcctggatccaagggattgtcctgcctcagcctcccaagtagctgggattacaggcgcatgccaccacacctggctaatttttgtattttaatagagacggggtttcgccacgttggccaggctggtctcgaactcctaaccttgagtgacttatggagtcaataaagcccttggaaactggccttatattttgtgtatacagttcctgtacagggtttctgatctgtggtaagtaaagaaggtcattttctgacaggccaggaaccccaagttatcttaaaacctcaagaggagaggaattcacccaactcataggtatttcatgttacaaatccatggctgggcttggcttaaacaagtcttatctcaaattccttctatataacaaagttccatcaaagctgatttaaaaggcctgtgtagcggctaggtgtggtggctcatgcctgtaatcccagcactttgggaggccaaggcaggcagatcacaaggtcagtagttcaaggccagcctggccaacatggtgaaaccccatctctactaaaaatacaaaaaattagcaggcttggtggctggcacctgtaatccctgatactcaggagggtgaggaaggagaaatgcttgaacccagcaggcggaggttgcagtgagctgagattataccattgcactccagcctgggtgacagagcaagactctgtctcgagaaaaagaaaaaaagagaaaaaaaaggcctatgtagcaaataattattcttgctgcactctatgcaaataattaagccaaatataataaagcaaaccagtcctaccatgatttatcttttaataaaaatgggaaactgaagagtgaaaattatgtttcagaaactatagcacacctgttgttaaattctagtcttgcctaatgtttttcaatttttattattttctacagtttaaattatatgtgttacagaaatcaactcctggatacattacactcaaagcctaaagagtggagaaagcaacccctaacagcctagagaaaggtcctatcaatgtaaaaaaaaataacaaatcttaacctgaaaatcataaaagataagtggctgggcaaggtggctcacacctgtaatcccagcactttgggaggctgaggtgggtggatcacctgaggtcaggagtttgagaccagcctgagaccaacaaggtaaaaccccgttgctactaaaaatagaacacctatatggacacctataatcccaactactcgggaggctgagacaggagaattgcttgaacccgggaagcggaggttgcagtgagctgagatcacgccactgcactctagcctgagcgatagagcaagactccatctcaaaaaaaaaaaaaaaaaaaagataagtaactaagtggaaattactcatttcagtctcacccctacctcaccaaatactttttgtcatttctacatctccttttaagccaaatattaaaacctttttaatggaaattatttactatgccaccctcatgggaattgctttagtctactatttgcagaaggactatatactgtagtaccctcagggtggaatatcggacacagagtctcaattaccgtagcatttggcttagttattatcctcataccaggaataacagttgctaacaaacaaataacacatgggtcttcccaaacatgcgcctctgcctgtcattgggaaaaaaatgttgattctgtctcaaccaattaggcctaataagaaacgctgctgaaggccaggcgcagtggctcacgcctgtaattccaacactttgggaggccgaggcagacggatcacgagatcaggagatcaagaccatcctggctaagacagtgaagccccgtctctgctaaaaatacaaaaaattagccgggcgtggtggcgcgtgcctgtagtcccagctacttgggaggctggggcaggagaatggcatgaacctgggaggtggagcttgcaatgagctgagatcgcgccactgcacaccagcctaggcgacagagcgagactccgtctcaaaagaaaaaaaaaaaaaaaaacgctgctgaaaagcctaggactaatgtttttaccctttatggccatttcgtagacaactaccaaaacatctacacacaatattgctcctgcaggcaatccaagaccaaaaaactctccgtgtctcccctccaccccacaacagcaggaagtagccagaaagaacacgtcgccccttgtccttttacaactatagggtctggaatgacagagcagaagcactgtcatcttggacaaaccccaccactttaagttccagctccctctctagcctcttacatttcaaggatatcacttatcttctaactacaagcagccagaaagagcaggcagtaaaacacagataagacagctcgggcacagagggaaatagggggaaagtctgttgggtaattgccaaacttcaccctcatacaatgggccccagtaaaacagtggggccttacttaataagcacattcctttcccttcaggtgcactgaaacagggaagccaaaggcagactcccggtgggggtttttggggggcgggtatgcctgcagctgcaagaagatgtatggggacagacacgcaactctccctcccagataagcacaacaaagagacacagaagcagtccaagcctctgataaactctcccaccctgaatccttaaaactcttagtctgggctgagctcggtggctcatgcctgtaatcccagtattttgggagactgaggtgggcagatcacgaggttcgagaccagcctggccaacatggtgaaaccccgtctctactaaaaaatacaaaaattagccgggcatggtggcacatgcctgtaatcccagctactcaggaggctgaggcaggagaatagcttgaacctgggaggcagaggtcgcagtgagccgagatcacgtcattgcactccagcctgggcaacaagagcgaaactctgtctcaaaacaaaaacaagaaacaaacaaacaacccaaaaacaaaaaaacctcttagtctgtaagagagtttgcctctgactcaacttgcctggaatactcctctcaggtttgttttctctaaaataaacctgtgttgactggcaagccaacttttgtgtttctttcctctttatttcttacaggcctcccaacatgctgggattacaggcgtgagccactgcacctggcctaactgaaacttaaaacacattttcccggccgggctcagtggctcacgcctgtaatcccagcactttgggaggctgaggcgggcagatcacgagatcaagagtccaagaccagcctggccaacatggtgaaaccccatctctacttaaaatacaaaaattagccaggcatggtggcgcatgcctgtagtcccacctactagggaggctgaggcaggaggatggcttgaacccaggaggtggaggttgcagtgagccaagatcatgccgctgcactccagcctgggcaacagagtgagattctgtctcaaaaaaaacaaaaacaaacaacaacaacaacaaaaaaaaaaaacacacagacacattttccctttagcattgcttctaaaattcaaaaatgagctgtcctagggaaagggaacaaggactgccctaggacatgttgaagaatgtggaaaatgtttcatatttaaaatgttgattcattgattgattgagacagggtctcactctgttacccagggtggagtgcagtggtgtgatcatggctcactgcagtctcaaactcctggggtccagtgatccctctcacttcaacctcccaagtagctgggattacaggtgtgcaccatcatgcccagctaactttgtcatttttttgtagagacagggatctcgctatgttgcccaggctggtcttgaactcctgagctaaagcaattctcctgcctcagcctcccaaaatgctgggattacaggtgtgagtcattgcacctggcagggaagcatttcaaagtcagctacatcttgactttgactattcagaatatttaaaaatgaataagtagtaagaaataaagaacaaaggtaccatgaaacaaagattgggcccttgggtctttataggaataactttttcggggggcagggatgggggtaggctctgtcgtccagactggagtgcagtggcccgatcatagctcactacagcctgggaatcccgggctcctgggctcaagtgatcttcctaccacagcctcccaaagtgctgggattccagatatgagccaccagcctggccttttaaaacaattatttgggctgggcatggtggctcacgcctgtaatcccagcactttgggaggccaaggcaggcggattacttgaggtcaggagttggagaccagcctggccaacatggtgagactctgtctccactaaaaataccaaaaaactagctgggtgtggtagtgcatgtctgtaattccagctacttgggaggccgaggcaggagaatcacttgaactcacgaggcagaggttgcagtgagccaagatcaagccactgtactccagcctggacaacagagagagagtccgtctgaaaataaataaattaaataaataaataaattggagagaacacgagtcactttgtctgcttctccacctccctaacaaagctctctatggtataaagcttgaaggaatgtggtccacccaagccctgactctgaaacctttttccattgagttctcccatctcctaggagatgcttgccacggccagcagctctgccgggttacaaagctcatgccaggaaaggcaaatgccaggccgactgcccggcagctctccagggctgactcggggctgcagagaagaggctggtatgagtctctcgtggctgctgaaacaaatgaccagaaacagagcagcttaaagcaacccagatttatgattttacagcactggaggtcagatgtcctaaaattaaggtgttgatgaggctggttcctcctggaggctccattttcagcctttcccagcttctagaggtacctacagctctcatcttggggccccttcctccaccttcacggccagcagcgcagcctcttccagtctctttctgactgtgaccctcctgcctcctcatttttttttttctgagacagagtctcactctatagccaagggtggagtgcagtggctccatctcatctcactgcaacctctgcccctcgagttcaagcaattctcctgcctcagcctcctgagtagctgggattacaggcatgctccaccacgcccagctaattttgattttttagtagcaacagggtttcttcatgttgggcaggctggtctcgaactcccaacctcaggtgatctgcccgcctcagcctcccaaagtgctgggattacaggcgtgagccaccaagaccagcattttttttttttttttttttttgagacagggtcttgctctgtagccaaggctggagtgcaatggctcaatctcagctcactgcaacctctgcccccactgagttgaagcaattctcctgcctcagcctctcaagtagaactgggactactggcatgtgtcaccacgcccggctaatttttgtatttttagtagagtcagggtttcaccttgtttgccaggctggtctcaaactcctggcatcaagggatccatccgcctcggcctcccaaagtgctgggattataggcatgagccactgcacccggccccagctaatttttttttttttttttttgagacggagtctttctctgtcgccagtctggagtgcagtggtgcgatctcggttcactgcaacttccacctcccgggttcaagcaattctcctcgctcagcctccagagtagctgagattacaggcacgtgccaacacgcccagctaatttttgtatttttagtagagacagggtttcaccatcttggccaggatggtctcgatctcttgaccttgtgatccgctcgccttggcctcccaaagtgctgggattacaggcgtgagccaccgcgcccagccccagctaatttttttatttttttttgtagagactgtgtcttgctatgttgtccaggctggtctctaactcctaggctcaagtgatcctccctcctcggcgtcccaaaatgttgggattacaggtgtaagccaccatatctggccaaaggggctttattttacctaccacagcatccgtgggggccaaaatcataagatggggggcccacaggacacttcctgagggaggtgatgtgtgggtttagttctggaagattgcagggctggtgggggattgtgctatgcgggaagaggattccaggctgagagaacagagtccatagaacagcaggatcctaaatatctaccccagacgccacctggaagctctgtttgggaaagtacagttctcatctggggtcgatttttccccaggggacacctggcccgtgcctggagagagatttggctgtcaccactgggaggctgggggggcggtgggctgccagagagctgctaaataatctagactgcacaggaccgccccctaccaggaagaatcagccagcccgcagagtagcttagagggcgagaatccctctgtcctcatccctccggactcagaggggctttccaccaggggcagctggaagggtttattgggtgacctttggcctttctaaccctgccccccgccccccaccctgtctcccgcctttcttgggaaaagctgattttagttcctggtgacccttggcctcctcagggaacacaagcatttgtgtgggctgatggtttctacctctggaatgtgactgctccgcctggcctgggccctggaggacgagggatctaagaatagtgacgtttttccccccacccctaggcctggcccactctggcctccagatcccaggcccctcactgtgctggaagaggtggtcaggcagacaatgtccgagggaaacgtctggagcctgtgctggtcactgggccggggaatgagctggttcattcatggggcacggggcagaggtgatggatctgcggaggaggggcttggttggggtggtgggtctgcaccttgtcagcaccccacaccccccaaccccaggcctgccctgttttccctacagctccttgtccctgctgcctctgaaggacttacgtcactgatcccctcaatggccaccccttggagtcggcaggttctccttgggctgaagcaggagtcgggtgcctctcttgcctactggaaaagggaccccaagcttgggaggtctgatccagtggggcaggggccctggtgccaatgccggagaggaactggtccctgggggcctcatgtccactgggatgtcataaacccacctggtgtcctcaagacgggccctcgaaggcagggctcactgcttgttcatttggtctgaaagccttggctgcctcatgggtgccaggccccccatgctgggcactggggatgccaagggggacagatccccgcctccttcctgaaggagcctgcattgacccaggagagcagggctcacatttgctgatgtctcagtcaagagccaggccctgcactggatgcaggagctgtggttgagggcaaaacagctgtgtttctgggggacagtgtagggagatgtcagccacaggaaggaaaggcagtggggatctgggtaaataaaaccccaggggctgggtgcagtggctcatgtctgtaatcccagcactttgggaggccgaggcaggtggatcactggaggtcaggagttcaagaccagcctggccaacataatgaatccccgtctccactaaaaaaaaaaaaaaaaaaaaaaaaaaaaaaaatcaaaaattagccggatgcggtggcacatgcctataatcccagctactcaggagactgaggcaggagaattgcttgaatctgggaggcagaggttgcagtgagctgagaatgtgccactgcactccatcctgggtgacacagcaagcctctgtcactaaaaacagacaaacaaacctgggtgcaatggtataaagaggaggacgaggaaggccagtgtgtgtccagggaagcccctgtaccctggagggtggaggctagtttcagggtttggccgtccctcccacgcaggcccacccagtcctggctcctgccttctacctgctgtggctgcaactgctctggccagccaggtgacttccatgtgacccctccccaagcctgagcccccgatgtatgaaacccggtactcccacccaggctccaggccagccccatccgccagagaatggggtgtccaaaccccagaatcctggctccttgacctgtggaagacctggcaaggaatgagtgtgggtaacaagggccacctgaggtcctctgcgcaccctgctgaaaccccgtgggctgtagcacagtcatgcgtcccctggggtgcaccccagtaagagagaagtacatcaggtgctgaatgggaatgaggatggaacaaagatgaaagaccagtgagactgggcgatggctcatgcctgtaatctcagcactttgggaggctgaggcgggcggatcactgttgcccaagagttcaagaccagcccgggcaacatggcaaaaccctgtctctactaaaaatacaaaaagtagctgggcgtgctgacacatgcctgtaatcccagctactcaggaggctgaggcatgagaatcgcttgaacctgggaagcggaggttgcagtgagccgagatcgtgccattacactccagcccagcctaggcgacagagcaagactgtttccaaagaaaagaccaatacatccctttccccagcctcagttccttcctctcccaccagaatctgaagccactgctttaactgcaccattgagaatgtccctatctcccccaaatttaagcttcttaagcctcagacccttgattggatggagtacccacagatgccaccatgaacccacgatctcccacccagctgggctcctccctgcccccagagcagccccttgctgtaaaatggggtgaacagaactgaacaggctgttaccatgaggatttgagggcatcagtacagcgcttggcccagggcccgggagccactaccactctacagagtcacaggcctcctgaccataactcctatgggtgcgtgatttaccgggccagcctgcgtgctgggcgtttaggtagtttccaaccagaaggtaacttattaaagagcctaagacacgtccttctgcaggcagcccttccacaagtggcttggggtaattttcagtggtataatcacaagctcagactacgaaccctcttttttttttttttttttttttttgagatggagtctcgttctgttgtccaggctggagcgcaatggcgcaattggctcactgcaacctccgcctcccaggttcaagtgattctcatgcctcagcctctccagtagccaggattacaggcgtgcaccaccatgcccggctaattactgtatttttacagagctactgagctcgaactcctgacctcaggtgatctgtatttttagagagctactgagcttgaactcccaacctcaggtgatctgcctgtctcagcctcccaaagtgctgggattacaggtgtgagccactgggcccgaccttttttttttttatccatagagacaggatcttgctatgttgccccggctggtcttgaactcccagactgaagcaattctcctcctgcctcagcctcccaaagtgctgggattacaggtgtgagccaccacgcctggcctatgaaccctcttatatgctgggtgtgcattgtccaaagggtctttccaattgaagtggcagccacccctttggaaagcaagtgttttttgtttgtttgtttgttttttgagacggagtctcactctgtgacccaggctggagtgcagtcgcatgatctctgctcactgcaatctccatctcccgggtttacaccattctcctgcctcagcctcccaagtagctggcgcccgccatcacgcccggctaattttttgtacatttagtagagacagggtttcaccatgttagccaggatggtcttgatttcctaacctcgtgacccacccacctcggcctcccaaagtgctgggattacaggcgtgagctaccgcgcctggccagaaagcaagtgttggggtcccggcagcattggaatgatccttgctgtgaccaaccctggccaacaggccctcccttgatgcccaatacatccactcttaggctcctagaccccccgcttatcctcctgggaattgtctgtttctgatctttgcacctttggtgcttatcaatttgcatgagctcttaatagactgataacacctggtgccacagtttcaatgttcgtttcctccaaaactcacgttgaaacttaatccttgatgtggccgtgttgacagaggtggggcctttaaggggtgactgggtcatgagaattctgccctcatgaactgattaatccattcctgggttaacagatccatgggttaatagataatgggttatcataggagggcaactggtggctttgaaagaataggaagaaggggccgggcgcggtggctcgcgcctgtaatcccagcatttgggaggccaaggcaggcggatcacgaggtcaggagattgagaccatcctggttaacacggtgaaaccccatctctactaaaaaaatacaacaaattagacgggcgcagtggcgggtgcctgtattcccagctacttgggaggctgaggcggagaatggcatgaacccgggaggtggagcttgcagtaagccgagatcgcgccactgcactccaacctgggcgacacagcgagactcggtctcaaaaaacaaaacaaaaaaaaaaataggaagaagtccagtcatggtggctcacgcctataatcccagcactttgggaggccaagtcaggcagatcacctgaggtcaggagttcaagaccagcctggccaacatggtgaaaccccatctctactaaaaatacaaaaattaggccaggcgtggtggctcatgcctgtaattccagcactctgggaagctgaggcgggtggatcacctgaggtcaggagtttgagaccagcctggcgaacatggtgaaaccctctctacgaaaaacacaaaaaattagctgggcatggtggtggacgcctataattccagctactcgggaggctgagggaggagaatctcttgaacccaggaggtggaggttgcagtgagctgagatcgaggcactccagcctgggcaacaagagagaaactctatctcaaaaaataaataaataaaaataaaaaccacaaaaattagactggtgtggtggtgcatgcctgtaatcccagctactcaggaggctgaggcaggagaattgctcaaaccctggaggcaattgaaccctggagattgcagtgagccaagatcactccagcctggcgatagagtgagactccatctcaaaaatagagaaaagaaaaaaggccaggcatggtggctcatgcctgtaatctcagcactttaggaagccaaggcgggaggatcacctgaggtcaagagttcaagaccagtctggccaacatggtgaaaccttgtctctactaaaaatacaaaaaaaaattagctgggtgtgatggcgggcacctgtagtcccagctactcagggaggctgaggcaggagaatcgcttgaaccaacgaggcagaggttgcagtgagccaagctcgcaccattacactcgctgcaacctccgcctcctgagttcaagcaattctcaggtgatcagccctccttggcctcccaacatgctaagattacaggggtgagacactgcaccctgccaacccccagctaatttttattttatttttattttttgatatggaattttgctctgtcgcctaggctggagtgcagtggtgcaatcttggctcactgcaacctctgcctcccaggttcaagcaattctcctgcctcagcctcctcagtagctgggattacaggctcccgccatcacgcctggctaatttttgcatttttagtagagatgggctttcaccatgttggccaggctggtctcaagctcctgacctcaggtgatctgcctgcattggccccccaaaatgctgggattacaggcatgaaccacccagcccggacttaatttttcaaagatgttttaaagttagagtcttgctatgttgcctaagggaactcctggcttcaagtaacactcctgactcagcctccggcataggatgaaattacattcaaccctgaaaaggaatgaagtactaactccttctacaatagcacgtgaaccttaaaaacatgctcagtgaaagaagccagacacaaaataatgcactggataagattccatttatatgaagtatccggagtaaaaaaatccgtggagtcaggaagtagaccagtgggttccagggatggggagtgacaggtaatgggtacagggtttctttctggggcgatgaaaatattctggagaccgggcatagtggctcacacctgtaatctcagcactttcggaggccgagacaggtagatcacttgaggtcaggggtttgagaccagcatggccaacacggagatatcccatctctactaaaatacaaaagttagctgggcgtggtgacacgcacatgtagtcccagctactcggaaggctgaggcgggaggatcacttgaacccaggaggcggaggttgcagtgagccgagattgcaccactgcactccagcctgggtgacagaatgagactccatcgaagaaagaaagagagagagagggaaagagggatggaaggaaggaaggaagggagaaagaaagagaaagcaggaaagaaagagagagagagaaaaagaaaagaggccaggcgcggtggctcacgcctgtaatcccagcactttgggaggccgaggcaggtggatcacaaggtcaggagatcgagaccatcctggctaacacagcgaaaccccgtctctactaaaaaatacaaaaaattagctgggcgtggtggtgggtgcctgtagtcccagctacttggggggtgaggcaggagaatggcgtgaacccgggaggcgaagcttgcagtgagccgggatcacgccactgtactctaacctgggcgacagagcgacactctatctccaaaaaaaaaaaaaaaaaaaaaaaaaaaaagagaaaaagagagagagaaagaaagaaagaaagaaagagagagagaaagagagaggaatggaagggttataggtaggatccagaaagtgaactctggaaaacgtcccgagctggctgaggccagtgacccgtgttatcttgtgcgtggtgttagagaggctgcaattctgtgacaagcggtggagaggtctgtgctgccctctgggtcgctgacccccacgttgtttactggacagccaccaagaaggtgcgttaagtgccctgctcggtgcctgctttaaacaggctctcgaggtggtggcaccggtactgcctgccttgtacaaataaacgaactgcggctggggaaagtgaagtaattcctaaagttaagcctggtggccaggcacggtggctcacacctgtaattccagcactttaggaggctgaggcgggccgatcatttgagatcaggagttcgcgaccagactgcccaacatggtgaaaccccgtctctactaaaaatacaaaaaaattagccgggcatggtggcgggtacctgtaatctcaaccactcaggaggctgaagcaagagaatcgcttgaatctgggacgcagaggttgccgtgggcagagatcatgccactgcactccagcctgggtgacagagcaagaccctgtcttaaataaataaataggccaggcgcggtggctcacgcctataatcccagcactttgggaggccgaggcaggcggatcatgaggtcaggagatcaagaccatcctggccaacagggtgaaacccccatctctactaaaaacactaaaattagctgggtgtggtggcacgtgcctgtaatcccagctactcaggaggctgaggcacgagaatcgcttgaacccaggatgcggaggttacagtgagccgagatcactccagcctggcgacagagtgagactccatctcaaaaataaacaaataaataaagtaagtaagtaagtaagcctggtatttctgtgcctgctttggggccagtctctttgagacagaactgtgcacaaggtagaacggccaaagtgtcgtggctgcaaggactctgcacacagcacactgtggccacctgcccctccaactctgacctcatccaggaagcgaactccaaactgctgctaacctgaaaataaactcaactgcctgagaaaaaataaagcctctaatcttctatgaccgatctcactggcgcttgagatggcatcagattgaagttgggcctcagaagaacacagggcttctagaaggttcttccggctttttggagcttgcccggcttctgttttcagagtgggcagtgaactggggtgggctatgatgcttcagctctgtgtgggggctgacaagtgaactgctcgcctgacaggcacacccatttcttatgatgtccccagaataactccatcccatatatggaaccctccagaattctgagagagaatggctttcccccacatctgtctctaattgacctggctgccaccttctccacatttcactggtcacccagggtcctgctgaccccacatcttaaacatctggaatcagcctccttctctccagaaccctccagcactcctccggccaccagtccactttgccgtctctctttcagttgtctagatggcctccctggaggcctcccccttctcatgttgtatcttctacttgccccaggttcccgcggaaagaaggaaaaaaggaaggaaggaaggaaggagagagaaagagaaagaaaggagggaaggagggaaaagaaaagaaaggaaggaaggaagggagacagaaagaaaggaaagaaagagagaaattaagagacagagacggccgggcaccatggctcacgcctgtaatcccagcactttgggaagccgaggtgggtagaccacctgaggttgggagttcgagaccagcctgatcaacatagagaaaccccacctctaataaaaatacaaaattagccccgcatggtggcacatgcctgtaatcccagctactcgggaggctgaggcaggaggaaaattgcttgaacccaagaggcagaggttgcggtgagccaagatcacgccattgcactccagcctaggcaacaagtgcgaaactccgtctcaaaaaaaaaaaaaaagagagagagactcacgtaagtctctcagttttaaactctttcagttaaaagataaattctttgtttgtttgtttgtttgttcaagacagatctcactctgtcgcccaagctggagtgcagtggcacgatctcacctcacagcaacctccgactcctgggtccaagcgattctcctgcctttctcctgcctcagcctcccaagtagctgggattacaggcatgtgccaccatgcccggctaatttttgtacttgtatttgtatttttatatatattgtttgagatggagtttcactcttgttgcccaggttggaatgcagtggcatggtctcagctcactgcaacctccacttcccgggttcaagcgattctcctgcctcagcctcctgagagtagctggaattacaggcgcccgccaccaagcccggctaatttttgtatttttagtagagatggggtttcaccatgttggccaggctggtcttgaactcctgacctcaagtgatctgcccacctcagcctcccaaagtgctgggattacaggcgtgatccaccgcgcccggccaataaattttcaatgcccacccccttttagttccttgcggctactgtaacaaataaccacaaccctggtgacttaaaacaactattttattttatttattttaattttgttgttgttggtggtggtggtggtttttttttgtttttgagatgggagtctcgctctgttgcccaggctgcagtgcagtggcgcaatctcggctcactgcaagctccacctcccgggttcacgccattctcctgcctcagcctgagtagctgggactacaggcgcccaccaccacgccccgctaattttttgtatttttagtagagacggggtttcactgtgttagccaggatggtcttgatctcctgacctcgtgatctgcccgcctcagcctcccaaagtgctaggattacaggcgtcagccaccgtgcccagctatttattttaattttagacagggcctcactctgtcgcccaggctggaatgctgtggtgcgatcatggctcactgcagcctcagccttctgggctcagttgatcttcccaccttagtctcccaagtagctaagactagaggcacatgccaccacgcccagctaattttattttttgtacagatggggtttcaccattgcccaggctagtctcaaactcctgagctcaagcaatctgtccacctcagcctcccaaaaatgctggaattacatatataagccaccgcatccagcccaaagcagcacatttttattatcttacaatcctggggtcagaagtctgaaattagttcttactaggttctaaaatcaaggtgtgcgcagggctggttccttctagaggctccaagggagaatccatttccctgcattttccaacgtctagaggccgcctgaattccttggcttgtggccctttcctccaccttcaagccagcagtgcagcctcttccaatctctgattctgaccatcctgcctccctcttataaggaccctgtgatgccattgggtcacccacatcatccagaatgatctcccatctcttttttttttttttttttttgagatggagtcttactctgttgcccaggctgaagtgcagtggtgcgaccttggctcacggcaacctcagcctcccaagtagctgggactacaggcgtgtgccaccacacctggccaatttttgtatttttagtagagacagggtttcaccatgttggccaggctggtctcaaactcctggcctcagatgatccgcccgcctcagcctcccaaagtgctgggattataggcatgagccaccatgcctggcccatctcaaaatcttcaaccaggttgggcacggtggctcatgcctgtaatcccaacactgggaggctgagttgggagtatcacttgaggccaggagttcaataaaaccagcttgggcaacatagtgagaccccatctctatttttttttttttttaattagctgggcattatgtctgtagccccagctactcaggaggctaagccaggcggatcacttgagactaaaagttttgaggctgtagtgaactgtgatcgtgccactgcactccagcctgggtgacagagcaagaccctatctcttaaagaaaaaaaaaaagacccttaagcctgccgtgtgaggtaccatattcatgggttccagggtatcaggacatggaagtctctgcgggggatccaccagtgttttctgaaaagggcttcacagcaaatactcggggctttctagggcacacggtctctgttgctgtgtaccctacatgacataatgtgcatggtctgatgcaaaataaaaacctggggcccttcaatcataaagaacttcagaacagggacagtggaagggcagggccccgtgtgaggcagtgtgcacatccatgaagcgcgtcctgtgcaccacttccgcctctatgacagctcaagagcgtcccctggccacacacaaaggagaggcgtggctgtgttactgtcaaactttatggacgctgaaacttgcatttcatgtaattttcacatgtcacaaaacgctactgttatttttccaactgtggaaaaatcattcttggctcacgggccgccggaaaacaggcatgggctgaatcgggctgttgtgggctgactacgtgggctatgggatcacatcagatcttctctgcccgactttccagggctcctcaaggccagtgccacctcactgtgatctcccctccgaaccggcacccctgctccctgaatgatcctccctgacaaatttgtgccgttactcctgtcggtccctctgtctggaactccccacctctcttctctgcctagccgacccttcctcatggattaatgtggccccaacactgccctccatgggaggccgatctgtgcccgtcccttgtcacgttgggtggatttatgtgtccacgtgtccatcgttgcctcagggcagtgatgtcctctagaacagggacttgggctcagtcagcttctctgtctcctgacctcctggactcacaatagcttgtgctgaaggaacagacagggactgagagggacagcaagagtaccccgaactaccgtggccgattcctactccccaggatcaagactatgcttctcatttaaaaaaaaaaaaaaagcaaaacagagccagatgtggtggctcatgcctgtaatcccagcactttgggaggccaaggcgggtggatcacttgaggtcaggagttcgagactagcctggccaacatggcaaaaccctgtctctactaaaaatacaaaaaaattagctgagcatggtggtgcgcacctgtaatcccagctacttgggagcctgaggcagaagaattgcttgaacccgggaggcggaggttgcagtaagccgagatcttgccattgcactccagcctgggcgacaaaagcaaaactccatctcataaaaaactaaaaataaaagtgtaatctgctatcagcggaggttgcagtgagccaagattgtgccactgcactctagcctggatgacagagacagactccatctcaaaaaaaaataaataaataaaagggcaaaatcagataagaacttcctatctcacaatcagagcaggcaaataaagatctttgagaccaagcagacctgggttttgtttttttagaaaattttttttagagacagggtcttgctgtcacccaggctggagtgcagtggcacgatcacggctcatggcaacctcaaacttctgagctcaagggatcctcccacctcagccacctgactagctggacaacaggcacatgccagcacgcctggttaagttttttttttttttgagatggagtctcgctctgtcgcccaggctggagtacagtggcacgatctcggctcactgcaagctccgcctcccgggttcacaccattctcctgcctcagcctccccagcagctgggactaccggcgcatgctgccatgcccggctaattttttgtatttttagtagagacggggtttcaccatgttagccaggatggtctcgatctcctgaccttgtgatcctcccgcctcggcctcccgaagtgctgggattacaggcgtgagccaccgcgcccagctgcctggttaagttttaaaaatttttgtagagacagagtcttgctttgttgcccaggctggtctcaaactcttggcctcaagggatcttcctgcctcagcctcccaaagtgctgtaattacaggtgtgagccccagccacctgcccccggttccaaagattgtaaaagtgggttatttaacttagttctcacagtgccctcaggaagtgcggttgacccttgaacacacactcccccaaaacttaaccaccaataatagcccactgtcgactggaaggcttactcataacatacacagtccattaacacatattctgtattttatttgtatcatatatttttatgataaagtaagacagagaaaacaagatgtactttaaaaaatcattaggaagaggccaggcaaggtggctcatgcctgtaatcccagcactttgggaggccaagtcaggcagatcacctgaggtcaggagtttgagaccagcctggccaacatagtgaaaccccatctctactaaaaatacaaaaattagccgggcatggtggtgggcgcctgtaatcccagctactcgggagactgaggcaggagaatcacttgaacctaggaggcagaggttgcagtgagccaagatcataccactgtactccagcctgggggatgcagcgagactctgtctccaaaaaaaaaaaaaaaaaaatcattaggaagagaaaatatattcatctttcattaagtggaagtggatcataacggtcttcatcttcatcatcttcactcggagtaggctaggaagaggaggaggaggggttggtctcgctgtctcacaggtggcagaggtggaagtaaatccagctgtaagtggacctgtgcagttcagacccaggttgttcaaggatcacctgtactgtgatcacccccattttatttattttattttttgagacggagtttcactcttgtctcccaggctggagtgtaatggtgcgacctcggctcaccgcaacctctgcctcctgggttcaagcaattctccagcctcagcctcccgaggagctgggattacaggcacccgccaccacgcccagctaattttgtatttttagtagagacagggtttctccatgttggtcaggctggtctcgaactcccaacctcagatgatctgcctgcctttgcctccaatgtgctgggattacaggcgtgagccaccacaccggccttattttatttttatttattggaaacagagtctcactctgttgcccagactggagtgcagtggcgccatctcggcttactgcaacctctccctctcaggttcaagtgattctcctgcctcagcctccagaatagctgggattacaggtgtgtaccaccatgcctggctaatttttgtatttttagtagagatggggttttaccatattggccaggctggtcttgaactcttagcctcaaatgatctgcccacttcagcctcccaaagtgctgggagtacaggtatgagccaccacatctggcccacccccattttagagatgaggaagctaaaactcagagagattaaatgactcgcccaaggtcacactgctggtgagtgcagaccctttcacaaaaacaaaaaaaaaaaagaaaaagaaaagaaaagagctattgatgctgggtttggtggctcacgcctgtaatcccagcacttcaggagaccaaggtgagtggatcagttgagctcaggagttagagaccaggctgggcaacatggtaaaaccctgtctctacaaaaaatacaaaaatttaggtgggcacagtggcacacacctgcagtcccagctacttgggacgttgaggtgggaggatggcttgagcccaggaggttgaggctgcagtgagccaagatggcaccactgcattccagcctggacaacatagtgagaccctgtcttaaaaaaaaaaaaaaaaaaaaaggccaggcacagtggctcacgcctgtaatcccagcacttcgggaggccgaggcgggtggatcacaaggtcaggagatcgagaccatcctggctaacatggtgaaaccccgtctctactaaaaatacaaaacaattaaccaggcgtggtggcgggcgcctgtagtcccaactactcgggaggctgaggcaggagaatgccgtgaacccgggaggcagagcttgcagtgagccaagatcgcgccactgccctccaggctaggcgagaatgcgagactccgtctcaaaaaaacaaacaaaaaagctattggtgatctaaagatctaaagaaacaacattccagtagcaatgagcacttccagtaccccagatcctggttttcaatatcattctctactaaaaggaaccagggcccccttggagacatggctgcttctaggacgaagggcagaaatacacaagataggcctgcagcattttgtgttgccacaaagtttaaggaactgcttcgaataaaacgaacaaacaaaaaaaccactgaaaaacacattgatggggatatgtcaaagggccacaggagccaaattaaagagtggtagacggccaaagctggaacaatttgaccgacaaaatacagtagtattgggttataacacaaagcataaaataaacatccaggccaggtacagtggctcatgccggtaatcccggtaatcactgccttgggaggccaaggcaggcggatcatctgaggtcgggagttcgagaccagcctgaccaacatggagaaatcccatctctactaaaaataccaaattagccgggcatggtggcacatgcctgtaatcccagctacttgggaggctgaggcaggagaatcgcttgaacccaggaggtggaggttgtggtgagccgagatcatgccattgtactccagcctgggcaacaagggcaaaactccatctccagagtaaaataaataaataaataaatatccagcattccatcctgatataattcaatgacctagtaagtgggggagagcgagataaatctcccacgtggaaggattctagaaaacttatgtttcagctgtggacaagcttaaaaaataataataatttatgtagggccagatgtagcgatgcaaatcataaccctagaactttgggaggccaaggcaggaggagtgcttgaggccaggagttccagactagcctgaacaacatagtgagatcccagctctacaaaaaaatacaaaaagtagccagatgtgatcacgtgcacctgtagtcccagctactagagaggctgaggtggaaggatctcttgagcctaggaagttgaggctgcagtgagccatgatcacaccactgcactccagcctgggcaacacagcaagactctgtctctaaaattaaaaaaaatttatgtagacagtctacccttaaataaatagagtataaccttccacaacttaggtgtgggctacgcatagtgacttccttccacagtattaaaaaaaaaaaaaaaaaaaaaaaaaaaaaaaaggactgggcacggtggctcatgcctctaatcccagcactttgggagaacaagacgggtggatcacctgaggtcaggagttcaacaccagcctggccaacatggtgaaaccccgtcactactgaaaaatacaaaattagctaggcatggtggtgcacacctgtaatccccacgctggagtgtagtggcacaatcttggctcactgcaacctccgcctcccaggttcaagcaattctcatgcgtcagcctccagagcagctgggactacaggtgtgtaccaccacatccagctaatttttatacttttttagtagagatagggtttcaccatgttggccaggctggtctcgaactcctgacctcaagtgatccacctgcctctgtctcccaaagggctaggattagaggcgtaagccacagtgcccggccgggaccctgtctctttaaataaataaataataaatttgataggatgtatccttgatatggtgtgattaaattgatactttattaccttgatcttgctgccaaaaacgtgtatcttatgagaaaaactccagataaattccaaaagagggacactcttaccaaaatacctgaccggcactcctcaaaactgtcaagatcatcaaaaactagggaaatctgagaatctgtcatagccaagaagagcctaatgagataagagaactaaaagtgagatggactggccaggcgcagtggctcatgcctgtaatcccagcacattgggaggccgagcaggtggatcacttgaggtcaggagttcaagaccagcctggccaacatggcgaaaccccgtctctactaaaaatacaaaaattagccacgcatgatggcaggtgcctgaagtccgagctacttaggaggctgaaacgggaggatcacttgaacccaggaggtgaaggctgcagtaagccgagatcgcgccactgcgctccagcctgggtgacagagcgagactctgtctcaaaaaaaaaaaaagtgagatagtctcctgggtgggatcctgggagagaaaaaagatactagggcaacacaaaggaagactaaataaactctgaccttcagttaatagcaaagtatcagtattggtccattaactgcaacaaattatcattattaatttgttaccaatatgttactcatttgtaactaaaatatgttactaatagagaataatggtaactctgtttttttgtttgtttttaacacagggtctggtggctcacgcctgtaatcccagcactctgggaggccaaggcaggtgaatcacctgaggtcaggagttggagaccaacctggccaacacagtgaaaacccatctctattaaaaatacaaaaattagctgggtatggtggtgggcgcatgtaatcccagctactcgggaggctgaggcaggagaatcgcttgaacccagaagacgcagataggagtgagccaagatcacaccactgcactccagcctgggcgatagagtgagagtcggtctcaaaaaaaaaagaaaaaaaaaaaaaaaaaggacagggtctggctatgttgcccaggctggtctgcaactcctgggctcagagatcctcccactttagcctcccaagtagctgggattataagtacctgccactgcaccaggcctggtaactctctactactactttggaagtatttctgtaaatctaaaatttttcttttttctttttttttttttttttttttgagatagggtcacactctgtcacccagaatagagggcagtggtgcaatcacagctcactgtagccttgacctcccaggcttaaccaatcctcccacctcagcctccccagtagctgggagcacaggtgtgtgccaccacacccagcaaattttttaaatttttactagagatgggggtcttgctatattacctgggttggtctcaaactcccggcctcaagagatcctgctgcctcagcctcccaaagtgctgggattacaggtgtgaaccactgtgctgggtctaaatttttctaaaaaataaggtctttttttttttgagacagagtctcactctgttgcccatcaccccaatctcagtttaaaacgtttccttttcccttttttttttttttttgatatggagtttggcttttgttgcccaggttggagtgcagtggcgtgatctcgtttcactgcaacctccacctcccaggttcaagcgattctcctgccttagcctcccgagtagctgggattacaggcgcccactaccatgcctggctaatttttctatttttagtagagatggggtttctctatgttggctaggcttgtcttgaactgctgacctcgtgatctgcccgcctcggcttcccaaagtgctgggattataagcgtgagccaccacacctggcctatttctaggatttcacaggaggatgtccataaagcatttgccatgaaggacccacttaattcagaggacttgtcaacactataccaaccctatgctgtccactataggagcgactagccctatatggttatttaaatttgaattaattaaaaacttacgctcagtttttttttttttttttgacatggggttttgctctgttgcccaggctgaaatgttgtggcatgatcacaactcaatgcagtctcgaactcctgggcttgaggaatcctctcaactcagcctttcaagcagctgagactaaaggcccacaccatatcacctggcttatttttttatttttggtagagatgggggcttgctatgttgcccaggctggtcttgaactcctggcctcaagttatcctcccactttggcttcccaaagtgctggagattacaggcatgagccaccgttgtctggccagaaagtcagttctttaatggtaccaaccatgtgccaagtgcaaaaaaaaaaaaaaaaccctacaaaacacacatggaggccaggtgcaacagctcatgcctgtaagcccagcactttgggaggccgaggttggtggatcacctgaagttgggagttcaatactgacctggtcaacatgatgaaatcctgtttccactaaaaatacaaaaaaattagccaggtgtggtagcaggcggtcccagctacttgggaggctgaggcacaagaatcacttgaacccaggaggcggaggttgcagtgagccgagatcaaaccactgcactccagcctgggcgacagtgcaatatttcatctcaaaataataataataataataataataataataataataataataataataaataaaaatataaatataggtcggacgctgcagctcacgcctgtaatcccagcactttgggaggccaaggcaggcagatcacgaggtcaggagatagagaccatcttggctaacacagtgaaaccccgtctctactaaaaatacatgaaaaaattagccgggtgtggtggtgggcgcctgtattcccagctactcgggaggctgaggcaggagaatggcgtgaaccagggagatggagctcgcagtgagccgagatcacaccactgcactccagcctggacgacagaacaagactccatctcaaaacaaaacaaaacaaagcaaaaaatatatatataaacattagccaggcgtggtggtgcatgcctgtagttccagctactcaggaggctgaggcagaagaatcgcttaaacccaggaggcagaggttgctgtgagctaagatcacaccactgcactccagccttggcaaaagagtgagactctgtcttaaaaaaaaaaacaaacagaaaaaaacaaagagagaaaaccccatggagccaggggctactgaattggacggtgctgatatggaacatgcccattatcgtgggaagctcttctggacagcactgcggcagacaatgaagaatgtaactatttgttcagtgctctcacctcttttgggtccctctgcgaatgacagctcttcagccttcccaaccatcctctttcaaacagcaacccccacattccccatgctctttccccaatttacttttcttcttagcctgttcaccacttgacatggaaatcacttggtttctcttctgactccccatctagcactgcacagtctgatgcagtagccactggtaacgcgtgatggttgagcccttgaaatgtagccagtccgactggagatgtgcggtgctgtgctgtgctgtggagtataagatacatactagatttcaaaagcaggcaggggccaggcgcggtggctcacgcctgtaatcccagcactatgggaggccagggcgggtggatcacttaaggtaaggagttcgaggccagcctgggcaacatggtgaaactctgtctctactaaaaacacaaaaaattacccgggcatggtggcaaatgtctgtaatcgcagctactcgggaggctgaggcaggagaatcgcttgaacccgggatggggaggttgcagttagccgagatcccgccactgcactccagccttggcaacagagtgagactctgtctcaaaaaaataagaaaaaaaaagcatgcaggaaagaaaaaggacacaaagtatcttctattttggaaagataacagatgcaaaacatcctgtattttaaaatattgactacatgtttaaataataacatattcaacctactgagttaaataaaacacattacaactaacatcacccgtttctttttacttatttttaaacatggctaacaatgtaccaatttaaattacatacctcgctgacaaatctgtggcttgcttatactgtttttttgagatgtaatttccctctttcacctaggctggagtgcagtggcgggatctcggctcactgcaacctccactttccagtttcaagcgattctcctgcctcagcctcccgagtagctgggattacaggctcctgccaccacgtccagctaatttttgtatttttagtagagactggggtttcaacatgttggccaggctggtctcgaactactgacctggtgatctgcccgcctcggcctcccaaagtgctgggattacaggcgtgacctactgtgcctggcctgctttgtttatacttctattgcaccgtgatgacccagaatgctggctactataaaatttaacaattaaatgttaaatttaacatttaattgagctaggtgtggtggcacgtgcctataatcccagctacttgggagcctgaggcagaaggactgcttgaggtcaggagttaaacctgtgggatgattgcacctgtgaacagccactgcactccagcctgggcaacacagtgagacccaatctctaaaaagctttcctaggccgggtggtggctcatgcctgtaatcccagcactttgggaggccgaggtgggtggatcacttgaggccaggagtttgagaccagcctggccaacatggcaaaaccccatctctactaaaaccacaagaattagctgggtgtgatgttgcacgcctgtgatcccagctacttgggaggctgaggcacgagaatcacttgaatagggaggcagaggttgcagtgagctgagatcacaccactgcattccagcctgcacagcagagtgagaccctgtctccaaaaaaaaaaaaaaaaaaaaaaaaaacttctaagaaaatatgattaaaaaaagaaacaggctgggcaccgtggctcccgcctgtaatcccaacactttgggaggccaaagcaggaggatcacttaagtctagaagtttgagaccagcctaggcaatacagcaagacctcatcgctacaaaaaaataaaacattagccaggcatagtggcacatcctgtagtctaagctactcaggaatctgaagccggaggattgattgcctgagctggggaagttgaggctgcagttagctgtgatcataccaccgcactccaaattgggtgacagagtgagatcctgtctcaaaaaaaaaaaaaaaaaaagaaaaacaaaattgtaggccaggcgcagtggctcaagcctgtaatcccagcactttgggaggctgaggcgggcagatcacgaggtcaagagatacagatcatcatggccaacacggtgaaaccccgtctctactaaaaatacaaaaattagctggttgtggtggcgcagcgcctgtaggcccaactacttaggaggctgaggcaggagaatcgcttgaacctgggaagcggaggttgcagtgagcggagatcacgccactgcactccagcctggcgacagagcgagtctccgtctcaaataaataaataaataaataaaaataaaaagactattattttcagatcataaaaaaaaaaaagaaaaaattaggcagagtgcaggcatgcctgtaatcccagctctttgggaggcggaggcaggagaatcgcttgagtccaggagttcgagaccagcctgggcaacagaaccagagcccatctttacataaaaaaaaattaaacatgtagcttgcatgtatttctactagggcattctaggccagcgctggtttagaatgttagcccaataagaccaggtattttttttctgctcactgcccatacagtgattgacacacagtaggcgctcaatgacattttaatgaatgaatgagatgctgagccttcgggaactggcttgctcaaagagccagcaccgatgaagcgctgaccacgttccatgccccgcctcctcagcgcaccagagaaggaaactgaggcccggcaaggtgacgtcagctcctgcccaacggcacgtagtgcggaaacgtcggggccgggattcgaacccaggttctgtacccgtaaccccggcgcgctgacctttcctaccttaccgggcggcggcaggacagacaggtgcgggacacacggcgagcgctcaaccagaggcgccgctcctcagccaccgccttccgtcagcctccgagggccggaacccagttcgccccctccgcggccatcgctggctgcccgcgtctccgccggccgcggagcacttcgcaggcggcgccgaccggaagtcccgcctctcccgcgcgccccggagcgccgcgacagctacgccggccaatgagcagcgcgccgtggcggacgtcggccaatgggctcgcgcgcggggggggcgtgtccgggccgcgggccggagcgggtcgtgcgcgctgaggaggagccgctgccgccgtcgccgtcgccgccaccgccgccaccgctaccgaggccgagcggagccgttagcgccgcgccgccgccgcctcccgcccgccccggagcagccccgggcccgcccgcccgcatccaggtgaggcggtggggggccttcggcggcgcccgacggggtaggccgcggcaggcctgagctcgcctggcctggccgcggggcgcccgcgggcctgcaccggccgaggcccaggccgcgccggaccgggggaggggacgcgcgctggggccgcggcgggcgggtcggggcgggccggtgtgggcgccggctacaggccccggggccggattcctctggcgcctcgagggacgggcgagggggatacggcgtgggcatgcgccggggggccgggctgcacggccgggggccccggtcgccttggaagcccgggctccgggggcgggagagtggggccagctacgggggagcgccgggaacgctttgagcgcgcagaggtcacggcccacgggcttgctcccccgggaaatcccacagattcttttgtggtcgttgtcagagcaccgcggccggtgcgaggtcctttgagaagtgtgcaaacccttcagtagatacacgggagtcctgggggaaaaaaaaaatctaaactgcatctttttttgagcgccatctctaacaaagctgtttgtggggcgtgggacgttaggatttgtaaaatatgtgtgtgtgcctgttggaaacacaagctgcacacagttgaacaatgggggatggatgcccttccttccttttccggtgctctgggctgcggggcttgttaaaatgggttttggtccctactgtgtgcagggcaggtggagaagaacttctgcacaacttctgcatgggcttcccgtggtgggactgagcccccttgctagaaagtgttcatctaagatccggatggccagaaatgggaagatgaggagaatgatctgtctagagcagggtttctcgacgttggccctactgatgtttggggtcagatagtttttggttgtggtggtagtgggggcttccctgtgcaatgtaggaagttgagccgtattcctggcctctacccactagatgccagcagtatccccatgctccaagtcgtgaggatcaaaagtatctccaaacattgccagatggctcgggttgcgggggaggggtctcttccactctcacacgcacaggtgagaaccattactgaactaaatgctcttcctccaaaagttctaatgccctgggagatgctcccaagacctcgaacaagcttgactctgttgagccttagttttcttatctataaaatgggaaggacaaaagtgtggtgcaaattgaagagggtggaaatcccgttgcgttgtgcgtggtctgtgcctggtaggcactgaataaatgatgttgtacatagccaccagtatttattgaggatttactatgtgcttgacactttgtggacgtttgtctgcagtccttgaggcaggtgatgttataatttccattaatttccattttagagatgaagaaactgaggcttagatgggtcacttgatgtgaccagtctcatgcactaaagtggctgcgccagggtttgaactcgggccctctgattcaaaacccttactcttaaccactcgattgtactgctcctataatcacaaggctccagggcactccagttgtcatcgaatattttctgtgtgcaaagttctgtgctgggatctattatcaaattctgcaacttcgaggcccacaaagaggttgagatacacgaacgtctcaaatgtggaaggaaataatactgtttatgttgatgcattggttttgagcagacagagtttcagtctggatgtgttgagtctgagatcatggtgctatttcttttttttttttttttttgagacggagtctcactctgccgcccaggctggagtgcagtggtgcgatctcggctcactgcaagctccgcctcccgggttcacgccattcttctgcctcagcctcccgagtagctgggactacaggcgccggctaccacgcccgactaattttttgtacttttagtagagacggggtttcaccgtgttagccaggatggtctcgatctcctgaccttgtgatccgcccgcctcggcctcccaaagtgctgggattacaggcgtgagccaccgcgcccggaccatggtgctatttctttttttttttttttctttttctttttttttttttttttttgagacagtttcacccttgttgcccaggctggagtgcagttgtgccatctcagctcactgcaacctcagcctcccaagtagctgggattacaggcagccgccaccacgtccagctaattttttgcatttttagtagaggtgggatttcgccttgttgagcaggctggtctcgaactcctgacctcaggtgatccacccgccttggcctcctaaagtcctgggattacaggtgtgagccaccgcgcccagcccatggtgctatttcaagtaaaagaaatgagagaattatgaaaaaactttatgaaaatttcttgcctctctcactctccgcttcccatctcttccctctttccacactccagcaggagttctgttctgtaaatgcacatctaattgtatcccttctgatttaaaatctttgtgcagaaaaaagacacgttttcttgacctctctggtggcttaaaagataaagctagaagcccttagtttggagtgccagttccttcacaccctaaccctccccgcccctgcacgtagaccccaaactctaaccctccctgcctgttgcagcctccacctggagacagatctcttccacctggagatcctttgcttatgctccatggctcagcccagagctcactggccgtttgaagcctcgtctgactgccactcttcctccacccgcaccggaatcaactgttccctccttagtgttcccatcccattcagtttattgaatcgaattcaaggctgaatggcgagagaagcgcagcgcccggctggcgcccctaggtggcagtagcgaggcggtgcggccgacccgagctgtgggtcaggggaagaccaacggaagccagcctgtgggagggaagtgaggctcgctccctcctctgaacgactctccctgctccgctgctgtgtcctgggcccccgctaggctctggagagtgtgcatgatgtgtgtaggtcatctcagcccactctgatgagtgctgtgagaattatgccctggctgatgtggaagcccagaaaagggacctgggtgggcacaggagagcccagaatgcttcctggaggagaggaggcagtagcggtggggaggagctaaccaggcaaagacaatagggtggggctttttaggatacagccaagcccggaggtgggaacatcgcagtgttcagagaacatcgtgtgttcaaagaaccacgtgggttctttagggacaagaaggctgagatgggtagtggtggcaggagtgctcaggtgtccactgggcagagggcttggctgttaccctgcaggtaggccaggggtggctactgagcagttttagttcactgctcaccctggtggagaggctggggggagacaaggagaaaccagtcacaggctgttgcagtactgaggtggccccgtaatggctgaaccgcttgagggtcaggactgggactgcttctatattttgtatgcctgatgctttgctctgtgcctggcacgtggttgatattttgtctgtgccagggaaaggaaagattggcagactactcagaagcgactggatccaggtacctgtcaaacagacatctgtggctgggtgtagtggctcacacctgtaaccccaacagcttgggaggccaaggtggaagattgctcaaggccaggagttcaagaccagcctgggcaacatagcgagatcccatctctaaaaaaaaaaaaaattttttttaagagtgagacgtttatgtcaggggaaggaatcacaggagagggaacaatcctgaacagctcgatggccagactcatgtcaccatgaacagaaacaggcagactcaaggaaggggagtgactaggaggaagaagatgaagctgggtttagagacactgagtttgcaatcccacttaggagtcggtctagcaggaggtgacaggaatctgaatagggatggtggcagagaggtggcaggacggtgagagatctcacatgtcaaactggcaggacatggtgcttgattaggtccaagggctagagagaggtggcttgggggacaggtggggctatgccaccaaatgaagtaattcagggggcggaggcggtttgaagagagggcaaggacaggaggagaggagatgaaggtgtttgtagctgcagacagggaggttggggagacatacattcgccttgattttgttcatgaagtgggactagagacaggtactcactgtaccaggcactgtggagcaaggggtgacatccccagtggaggaagctgaagctctgggaaggggagcgacttctgcacagtagttcagctgatgagcaggagacttagtgcccagctcgggcctgccaggctccagagctcagggttttttcctgccatgccctgttgctttgcacttctgtgtgagatccctgcagtggcctttggccttgaccagccagaaagaagccagagcccttagcagggctgtggggtgcctggactgggccacaggccagccacacctgacctgctcctgccccgggcttctcagcctggctgaaagggaattgtcacttagctggagctgctccagccaggcatcctgcccttctgtgggccatgggcaggggcttggaagaagctggtgccatgtccacctgagaccttgccttgcatggcatttataactgggtcaggtggtgctttgggttttttctggcagcagagcatttcctgaatgacctaagccttttttacctggaagactcagaatgttgcatctggaaaggaccttaaacattattgggtccaagccctgtcagatgatgtgtgaagtgtcaagattgagcctgaagatagatttgactgttctagttttgctctggctcaagtggtttagaatacctgctccgtcatggtgcaatgaaagtgattctcatgcttgcctggtggaaagcagcctcactgcttcactctttttctgtcacacataaagacacacacatctctctcccctggatatgcgctagatgatcgacggatgtgaacaacatcactgatgtcacatagacaaccaggattgtttaaaatagtgcattggagtcaaaaaccttcagagatcatccaaacaagacttctcccagaggccaggcaccgacggtgactctcacctctaagcccagtgcttgggaggctgaggtaggaggatcacttgacgtcaggagttaaagaccagcctgaacaacatggcgagacacccccccgcccccgcctctacaaaacataaaaaagcggccaagcgtggtggctcatgcttgtaatcccagcactttgggaggccaaggcgggtggatcacctgaggtcaggagtgccagagcagcctggccaacgtagtgaaaccctgtctctactaaaaatacaaaaattagccgggcgtggtggcaggtgcctgtaatctcagctactcgggaggctgaagccggagaatcacttgaacctaggaggcggaggttgcagtgagccaagatcgcaccactgcactccagcctgggtgacaaagcaagacccccctctctgcaaaacataaaaaagcttagacagaactacatagaggacttagtaggactacgtagtgacacgcacctgcagtcctaggtacttgggaggcttaggtgggaggatcacctgagcctaggaggccggggctgcagtgagccgtgatcatgcctctgcactccagcctggtctgagagccagcagcctcctgtactgctgtgtgacacaccctggctttgcctggggactcttagatggcaatggtataacctgggccctcaaggttctcaccactgacattggtcattgagtgtaaggcaaataatgataggagtggttgggacagtaacaaaggtttacagcaatggcatggaggcactgagaactagagtaagtaacctgttgtcctgggggaaggtggccttttattttttatttttttgagacagtctcactctgttgcccaggctggagtgcagtggcgtgattttgactcactgcaacctctgcctcccgcgttcaagtgagtctgctgtctcagcctcctgagtagctggtactacaggcatgcaccatcacgcccagctaatttttgtattttcagtatagacagggtttcactatgttggccatgctggtctcaaactcctgacctcaggtgatccgcctacctcggcctcccacattgctgggattacaggcataagccaccacgccaggccaggaaggtagctttttaaagatgagccagcctggtgtagtggctctcacctataatcccagcactttgggaggcccaggtgggaggatgacttgaagccagcatgggcaacaaaatgagacccctgtctctaaaaaaatttaaaaatcagccaggtatggtggcacacaccagtagtcccagctacttgggaaactgaggcagtttgaggctgcagtgagccgtgattatgccactgcactctagtttggcagcagagcaagaccctttctcaaaagaaaaataagtaaaaatagaagtgagctgggaggccaggcatggtggctcacacctgcaattccagcactttgggaggccaaagtaggaggatcacttgagcttgggagttcaagaccagcctgggcaacaaagagagacccccatctctttaaaaaaaaatactaattttaaaaaatgagctgggaagtgaaggagaggacactagtgccctgcagagggaacagccaaagcagaggcctgtagcatattggcaagaagctggagtgagcgggaagggagggtggcgactgaggctggagaaccacctgggtccgattgtgaagggccttgccagtttgacagttgcattgtcatgacaacttgaggcctggccctgccacttattaatggcatgcctgaccgtgagcatcatcgtgtgaccgccgagcctcaatgggtggtgaccactgacagggaataccagaggggtgagcatcttgattgcaggacagtgcaggccttgcacctcgagagacagaagtggctacgacttgggagtcagtgataattgagtggtgacaaggcccagttgtggttggagcttgtgggatagaagctgatttggcccaggattgatgatgcagatttggagaaggtcaagggaagggcctccagagagtggggtgggggcccagaaacgtcatgaaactgctttgcagggcaggttgttggtttctcccgtgttactagttgaccaagaacttgacctgcaggggctgctcagccttgactcagagtgtcaggaggaacagggccgcaaagcagaagttctctttttaaaccttttaaaatttatttttattgtggttttgttgttgtttttgaggcaggatctcactctgtcgcccacgctggactgcagtggcacaatcatagctaactgcagtattgacctcccaggctctagtgatcctcccagctgagccccccgattagctgggattgcatacaggtgtgcatcaccattcctgggtaatttttaattttttttttttttgtaatgatggcatctctctgtgctgcccaggctggtcttgaactccaggcttaagcagtcctcccaccttggcctctgaaagcgctgggattaaaggcatgagtcgccacactcagacaatttatttttaaatttgcatgtaggaaaattcattttttcgagtagagttctctgagttttgacaaacggataaagttgtttgattaccaccataataaagattggaaagttcgctctcccacaaacagaaatactccctcctcctgtccctgtgtaatcgacttttcccctcactccctaaccccagcgaccacagatccatccctatggttttgccttttccaggaaggcacagaaatgatgtggcaagatgtgtttgagattcacacaagtagcatgaattggtgataccttttattgccaggtggtattctgttgtatggtgtatcccagtttatccatgaatggcttgaagaatatttgggttgttgtagttttggatgattatgaataatgccgctctgcacatttatatacagatttttgtgtgaatatagattttcctttctattgccttaatactaggagtaggattgctggatcccatgctaagtgtatatttcaccataagaaactgccaatctgttttccaaagtggctgtcacatttcacatttttgcattcccaccagcagtgcatgaatattctggcttctccacatccctgccagcacttgacattgtctgttttgttgctgttggttgttttttgttttattttgctttagccattctaataagtgggtagcggtgtctcgatgtggttttaatttgactaatgatgttgagcatcttttcatgtgcctgtctgccatccatatatattctttggtatagtatctgttcaaatcttttgccatttttgaaaccaggttgtttgctcattatgttgtttttggtttttggagatggagtctggccctatcgcccagtttggagtacagtggcgccatctcggctcattgcaacctctgcctcccaggttcaagcgattctcctgcctcagcctccccagtaactgagattacagatgcccaccaccacgccttgctaattttttttttgttgtatttttgtagagatggggtttcaccatgttggccggactggtctcaaactcctgacctcaggtgatccacccacctcggcctcccaaagtgctggaattccaggcatgagccagcacactagcctgcttctgttttgagagcttaaaaaaaagtgttctgggccaggcgtggtggctcacgcctgtaatcccagcactttgggaggccgaggtgggcagatgggcagatcacgaggtcaggagatggagaccatcctggctaacacggtgaaaccccgtctctactaaaaatacaaaaaattagctgggcatggtggcgggcgcctgtagtcccagctacttgggaggctgaggcaggagaatggcatgaacccgggaggtggagcttgcagtgagcggagatcatgccactgcactccagcctgggtgacagagcaagactccatttcaaaaaaaaaaaaaaaagggttctgggttgggtgaggtggcttacgcctataattctaatactttgagaggccaagatgggaggatcacttgacaccaggaattcaagaccagcgtgggcaacatagtgagaccctatctcgacaaaaaataaaaaattagccagaaggctgaggcaggaggattgcttgaacccaagagtttgtggctgcagtgagctatgattatggcattgcacttcagcctgggcagtggagtgagactttgactcaaaaaaaaaaaaaagtgttctgactacaagtcccttttgcaaatgtttactccagttggtggattttaattctcctagcagtatctttcacagagcaaaagtttcaaattttgatgatatccagtttatccatttttttttttttttaacgaagtgggcttttggtgttgtgtctgagaaatctttccccagcccaatgccacaaagatttttctccaagaaattttatgtttttacattttaaaacagaggtcggcagattttttttgtgtgaagagccagatggtaaatattctcagcttttttggccatacggttgctactacttaactgtgttattgtagtacaaaactatctatagacagacaatacataaacaaatgagacaagctgtattccaataaaactttatttataacaacaggcaatgggccagatttgtaccacaggccatgatgtgtgtttcaggaggtccacttttcccagacctagaggataccacactgtggacagtaagcctgggacagccattgtccatctcaccgtccatgaaagcagaatgagggaaaaagcaaagtagatgcctaactcttagagaaagggcgaggagaaggaaaggtaaaggaaaaaagagaaagaaagaagggaaatgcttgaattacattttgagcaagcttcaatgtgcattttaattcttcagtgttaacccttgtggtctgtttggatcagcttccagcaaatgtttttgtctgtttgtttgtttttgagccagtgatctattctaaaatctcgtggccacagatggtgtaacagacacgtggagtttctcatgattaaagtctataggtcccgagctgctactgaaagttgaaatttagccatttcccattaacgaatatttagaattctatccagttttatactcttatgaaccatgaggtagtgccttccttgcactttttgttttgttttgttttgagacagagtcttactctgttgcccaggctggagtgcagtggcgccatcatggctcatgcagccttgatctcctgggctcaagcgatcctccctgcctttgtctcccgagtagctgaaactataggcatgggtcaccatgcccactaaattattttattttttgttgagagtcagggtctcacgttgttgtccagactggtcttgaactcctgcacttgcgtgattatttctgtagaaagatcctgcagttgtgagtcagaaggttctaccatctcatactcagatcagtagcaggtgatcttgcgctggattttattccatgtgactggcagaaaatagcatctggttttcttttgcattttcctcattgttcacgaagatgaagttcagtgtctttttctggacttacgagccatttgaatttaaggcctttataaattgctgctcacatcctttgcctacttccctcttggttacgtctcttcttttatcccttaccaatttgtagatgttccgaatcaagttttcccaacctcggcagtactgacatttggggttagataattcttggttgtggggccgtcctgtgccctgaaggatgctttacagctctctgacttctacccaccaggtgtcagtagcaccccctcccccgacccctggccctgaccaagtcacagtaaccaaaaatgtctccagacattgccctgtgtccccttgggggcagaatggcccagtgtgaaaaccacaggtctaaataatagaatatgcagtgaatcttttctctaggctactcctcttcgtctaggtctgtgatgccttttgctgtacagaggtttttaatttcatggagtctcacttttcagtctttttttctatggcttttgatgctaacctactttttaaagagcagggagcataggacatcctcaaataaaagaaatgttaggaaattgtactgattttccacattgtctgagactagtaggagggtagggaagacctggatgtttctaccaggaagaaagaaaccagacctaattcttccctcggcgttgattcagggagtaggtaggaaatctccacatgagaggtgtgttcagatttttatgtaactgctggcaaggctatttttaaagaaggccaaaggcgcatgaccgtgggcactgggtgttcaaacataacagaattgagcaacagggatctggggaaagggatgggctctcaccgagacctccaggcgggtggccatccacagggatgactacctgtgtgtttagaggcagggatgaggggcctctgagaagtgagcccagtgtgcggcgcactttcagcagggcgggctcggcatacttggccgcattgatctggactcttctccaaagtcatcactggctctgatgtttatcactgaaaggaaagacttcagcaactgagaaagacatttcaaagcctgcaaactgtgaagaccaagttcctctgactggtagagaaaccctcacctctttccagctcactcactgtgtctttgggaataaacaggtgcagaggaccattgcctacctgccccctcagcagcagggtgtccaggggtggggttcaggtacaccccacaggctctggacatggggagaaagcaatcggaaatctggaattctctcgagagacaacccaaaggcttttttacaggatcttaaattgtggtgctggaattgtttgtaggtctctccgaagccctcttagtgaacttggagttgttctgttttgtgtccatagactattttttagagcagttttaggtttacagaaaaattgtggagaacactcgttctgtagcattacaatgaagtattgactgaataaaattttttttaaatagaaagaagccggacacagtggctcatgcccgtaatcctagcactttgggagggtgagatggaaggattacttgaggccaggagttcaaaattaacctgggcaagataccatctctacaaaaagttttaaaaatcagccgggcgtggtggcacatgcctgcgttcccagctactcaggaggctgaggtgtgaggatcgcttgaggatctcccaggagccttggctgctgtgagctgtgatggcgccgccacacccattattagcatctcacattcacatggtacctctgttattcttggtgaatcaatattgacacattattagtaactaaagcacgtaattcagattagagttcactctgtatattgttcattctgtgggttttgacaaacatgtattgtcacatccaccactatatatcatgcaaaatagtttcactgccctaaaaccctgacaatcccgtgttccactatttgttgtcccccccacgccgacctgcatcgctggcaaccattgatctttttctctgtagtgtgcctcttccagaaggtcatagagttggaatcatacagtgtatcacttaacagtatacatttaaagttcctttaaatgtctttcctagcttaatagctcatttctttttatcatcaaaaaatatgcccctgtgcagctgaaccacatgaatggagtctgttcattcattcacccattggaggagatcctggttgcttccaggttttggcaattatgagtgaagccgctgtaaacatccatgtgcagatttttgtgtggctgtaagttaacatgcagcatagaaaagaatctctaagtgcagggccaggtgctgtggctcatgcctctaatcccagcactttgggaggccgaggcaggtggatcacctgagttcaggagtttgagaccagcctggccaacacgacgaaaccccgtctctactaaaaatacaaaaattagctgggcatggtggcagacgcctgtaatcccagctactcaggaggctgaggtaggagaatcacttgaacctgggacgcagaggttgcagtaagccgagattgtgccactgcactccagcctgggtgacagagtgagactctgtctcaaaaacaaaacaaaaaaaaaaaaaaagaaagaaagaaaatctctaagtgcaaatgcagttactagttttgccttcatatactgcaatatgaacattttgaatttacttgctctttttctcttggcagatttttgaaaaatacaatgtctaatggttatgaagaccacatggccgaagactgcaggggtgacatcgggagaacgaatttgatcgtcaactacctccctcagaacatgacccaggatgagttacgaagcctgttcagcagcattggtgaagttgaatctgcaaaacttattcgggataaagtagcaggtaaagaaatggaggcgttttagtaaaccgggtattggtggccatcctttgggcactgtctcctttgcctgtgactctgtggcattcctcagtgcaggataactacagccttgaaacgatggctgtgaagtttcatttttatttcaaactctgtccattgctcttgtataagatcggacataagttcccaaaagaggaaaaattcattgtaagacagagagcatgtacaaaataagacagtgggaggagaggaaggaaccagagacagggcattctgagagctggaaggggctggagaaccacagcctgacctggcttggcctgggcagattgattgggtcccacgtgtggaagggaccctggcgagtgtactgtccagggcaggtgcaggtaggcctgcccctgtctgtccaggcccccactcttggtcaggcccaggtcagcagaacaccgaggaccttgtggacagcccttcgttatgtttgggctgctctgtctactgtcaacaccatcaacttgaacttctgcaccatgctgagcttgaactctcagaggggcaggagcctggcagctaaaagccctgctgttccactccctcacagtgggacttctaagcctttgtgtccccatccggaatgtggagattgtggcttctacatcctggtggtccctacctcgtaggtgtttgcagaggtcctggcacttgtgaaggccttccttacagagtggcctccattctgagagcatggcttcaaggactcgggagagaattacggacagaccatgtgcggagctctcctcctcctcctctcccaatggcccctcttcctcctcttccctctacccacccctacccccctgccttcctttctgtctccgccctgctttaggaagccaaggagcggccagtcctctcggggctctgtctgccaccctggatttggggactgtgattccctatactgaaaactcacttcaggctgggcacagtggctcacacctataatcccagcactttgggaggtcgaggtgggaggatcacttgctcagaagttcaagaccagcctgggcaacatggtgaaaccccatctttacgaaaaatacaaaaacttagctgggcgtggtggcccgcatctgtggtcctggctatttgggggcgctgaggcaggagaattgcttgagtctcgggggttgaggttgcagtgagctgagattgcaccttaccaagtaccacttggtactaaagtgtcttctacactttagcctgggcaacatagtgagaccttgtctcaaaaaaaaaaaaaactaatttaaaagttgaatgctgggcacggtggctcatgcctataatcccagcactttgggaggtcaaggcaggcagatcacctgaggtcaggagttcgagaccagcctggccaacatggtgaaaccctgtctatactaaaattcaaaaattagccaggcgtggtggcgcacgcctataatcccagctactcaagaggccgaggcaggagaatcacttgaacctgggaggcggaggttgcaatgagctgagattgtgccactgcactccagtgtgggcaacagagtgagactctgtctcaaaaataaaaagttaacaaaagtttctattatgaaacatttcaggcatacatgaacatagagtgatgtgttgaacctgatgtacccatcattgcactttatcttcaacatttccccagtaaccttaagacacctgacccccacatgactcccaaagagcctgtctggccgctctacagggaattagctcttcagatgcaggcactgaataagaaagccttctctccttccaactccaagagtctgatttaataaacgccttctcaatggggattttacacagtatacaaacttgagcagtgttagaatgttctagaagccagcatctctctcctgctccaggagaccatcctaaataagagaagggttttaaaattctcctgtgccactaacaattctcacctttttcctctttctggtggaagggaattttccttgatattcctgagcaccagagatattgcaagcattcccatggaatttgcagttattctcctgcaacctgacttctttgtctgttcccttgtggttttcacaggaatgtgagctatgctaaaggaacacctagatttggctcagtctggagagaactggttttgagaatcagtgaaggctgcaaaagtgtaatttggaaattatttcagttcggaggtgagccctgtcttatctttggacagtagttagtaactggcgcaccaggagttgtggagtggctgggcctgggctttcatcttggcccagcctcttgttagcagcccttcaagtgactggagctttacggagaacatgctgcaacctggctttgctcagcctgccgccagtgtgggcaaacctcttcgctggcagggcccggggcacggcgctaggtctcaccacccctctccccagccaacggctttctcccagcctcccaagacagcctctcacccggccaggcaggcaccccggcgaatctgatccctggcctagctcagctcacaacacgggtgtctccgagccccacagcagccatttccccgtgtttaccctcctcggtcctctgaccacccccttcaccctcagctgatgaccacctcccgcttcgcagtggaactaatagcgtctccagctctccagccccgatcctcccttcccttcccttcccggcttcccaagagcctcaggctctccaagtgcccacttttcctgggcttcgagtgtcttgaaaggaattccttccagacttccagcttcctctagctcggagttcctccacatctgtggctcctgatgtcagggctggacgccgcactggacactgcagggtgttgagcagcatccctggcctccacccacgtggtcccagtagtgacatcccagtggtgaaacccaaaaatgtcctgacattgccgcatgtcccctgggaggcagagtctcccctagcgagagccactgctgtgtgtgttggcctcccacccacatactgtcctgttccctgtctccacctccttccagaagcatcctctcccattggctttcaggagcacctcctcctcccacctgtctaactgcccctgaggccatgccccatctgtctttagcgcctttccccagcctttgactcagccggttatgccagagggttatgctcagagggttatgtcattctcctcttcttccaaagctgacactcacggtgggcagagtcacctcatggctcccagctgccctctgtctgccacctcctttttgaccagaaggctgtcctgagctccagaagccctcggccccttaaattcagtatattcctaactgacctgactctccctaaagccagccactcgtttccagttgtccccaccttagccgatggcaccaccatccacttggtagctctgctcagaaatctaggcgtgtccttggctctcatcctcctgggtgttgcttcagtccatccctttcccctctctcctcagccaccattctagcccaggacaccactgctggtggcctgcactgtcgttttggcctcttaactggcctcctatgctccctgaagaccactgtcctcactgcagcagaggggcctgtttgacagcccgcatgtgaccctgtcactcccctcctcaaaccgttcaggtcctggtcgtgtttgcttaaggaggcctcccttggcccaagtgtcagatgctccgctgtgggttcctatggcacctgggccgacctgcactgtggggtttccacctggcactgagctggagctttctggtccagcacatgagtatctctcctggagggaggagctttgttaatctccgtagccctagacatagccagtcggtgtttgcagagtgaaggaaggaatgaatgaatgagtggtgctggggatgggggagagtgcagatcatcattcagcaaatactggttgagtgccagccatgggctgggcactggtggcgggaggaaggaggggcgtgatgatggctgggaggaagggactgccccatgtgctgctctcaagactcggaatgtttctggctggcctggccctggtccctatgttggggatatggcgttggttggttgttggctgttccacccacaaacaccagctaaggaggccactgcagcgcccggtggtcctgcccgctgccttcctgggcagccctgccccagtgtctggtctctccacagtggccccatatgtccctcgggggatcagaaggagtcagccctctaccctcatggatgacctgtcatgccggagccaccaggctgcagccccattcacggcttctgtcttgctgtatatctctggtcgggttaaagcccacaccgctgcccaaggctttaaccacatcccggaggagggggtgtcccaagagggtagggacacccctgggcgcctgccccctctccccacttgctgcaccctcccccccccccggcaccccccggtcaggctctactcttgggcgcttgtgattctctgaacactgttccctctgcaggaatgtccttccggactttcccagcctgatggcttttttcttaatatgagtcatgtttgctcctcacagaaaaaaaaacttaagcatgagccaagcagaaacaaacaaacaaaaaatcacccacaatcataccgctgttagcttttgggcacatgtccctccaaatgattttctttacgtattcatggccataagcagccacgtacttctacagaatgggctcttctctcaggctgtggataaacttcccttcctgtatctggacatttttccacttcgctgaacatctcgcgatcccatcatcatcggtcgcatagtattctgcttcccatttgttgatatttgaaagccctgctgacataaatgtcctggcacaaatctttgctcactggttatttccatagaaagtcttcctgccggtgaagcggcagatgggagagcgcaccttttaaaggctcttggtccctgtcgctaactcgctctctaggggacgcttagttcacccttccttctgtccagccctgctatccgctagccttggcaggatttctcacctttgccaccctgtgagggacgagcgacatccgatcagggtgattcctatttcgagtgaagttcatcactgtttctatttagtggttgtttgtactacttttgtaaaatacccttcttgtccttcgcctgtttcttttcttttgcagacctttgctgtttcttatttattgctgaattaattcagtctccacctccagtctctgtctctcagtgaggtcttcccttgagcctttaaagagagaactcacgggacctgccctcacggtgcagaggagggcttcacccacagggcactcgccccctcagccctgcaccccgtgtcaggtcagggcgcttccagctgcaagaagcatggagggatggaagcattgtgtctggcagcataagacaaggaagcagctctccagtcttaaccctcatccaaagagagggagaaatgtgtttggaagttcgagagcactggccagtgtttgcccagtgtgggcggtgtatgggtgcccagtaaggcaaccatggtgctccccgcagaggcagctttgtcttctccaggcagcagctttcagggtacagtccctgggccagcagcagcatcaggatacttggggaaatgtgactctcagaccctgccttgtggccagaaagggtgaggaggctcttcctccagttgagggaagtgagagccgggcatgcactggcctctgggacagccctgcatttcactcccgggttctgcatcctgcattcctccctgccagtctccttcctgcttccccgtatctcccacccacaccctctccatcccatctcccatcccaggggccccgtttgccccccgagcactgacaccaggcaggcccaccacggcctgtgcaggagccaggcccctctgagcttggctccctgtcctcctgctccctcgcaaaccctcaggcctcctgtctcagggctgatctcccatctccaggcaggggctttggcaagctctgccactggtgggcaggaggagcatctgtaaggagtttggggatgtggattcccacacctgcctgacatcctgggtcccgggatggggtaggggtatctagggagccaagttgttgccttgaactccagatgcccctggtgcaggtggcttgtggaccctgcctggagaaacagtaacttgggggcccgtttgcacttctcctctggaggcctcctctcctctgcataaccatgggaagccccatgcccctcatgcactggaatcactagggagctttaaaaaccactgaggaggctgggcgcggtggcgcacgcctataatcccagcactttgggaggccaaggtgggaggatcgcttgagctcaggagtttgagaccaacctgggcaacatggcgaaaccccatctctacaaaaaattaaaaaattagctgggcatggtggcgtgcccctctagtcccagctacttggggggctgaggtgggagcatcgcctgagcctaggaggcagaggttgcagtgagccgagtcttggcaacagactgagaccctgacttaaaaccactgaggccaactggcaacccccccacctcctccttttctgacttcattggttgggggtgtcgcctgggcagtcagtggtggcttagaaagctgtccagatttgtttctattggaggcaaaggtggaggtgggtggtcaggtgctggacaaagcccttccagtgatggcctcacccagcgggtggaaaccagggcaccttcatccctcacctgcctgccttcctgctgcctccaggcacctaccacagagaggagagcagattctggggatgaagccaggccttgactcacaaggctcagcctgtagggagatcaggggcctgcccccactacctgtcctctgggtggggcattcctctactgccctggcctgtgcacatagcctgcatctcccatctggattagatcaccagcccgctggctccacactggctctgccctgctgccagtggccacttcctaggcccttgccacacgggccacctctactttctgggaatacactggcattgtctctgcctcggagacttggcacctgctcttctgtctggaatgctcacgtcagccacgcagaggtttaaaatatctcctctgcgacgggccctcctgacccctgtcttaatgcttgtcagtttctcaccaccatgttgtctgacttgcccccagggatgtgatggctttcatgatggcagcgaccgtcctctgtcatgcatcactaactcccagccaagcacagggcctgacacatagtaggtgctcagttaatgcgtcagctccttgaggacagagaagagcttgaccatggaaggtgacgggcagcccaggggtgtgcgactccctcggtgatgttggcaggtgtgggcatgtgtggtgaggaagagcatgtggcagagacaagggccaaaggtgggtcctcagggcccatgggtctccatggaatggacagggagtgaggagcctgaggagggacagccagggagacggaaacctggtgtggtttccacatcctggaggaggggtgtcccaagagggtaggccctaccctgagctgccgaaagctcaggggacacatcctgaaacggtccccagggcagtgaccatcctaggggaccagtcaggatcacccagcacctgggagatgaggaagcagggacttggtccaagcagggaccatgtttctgtgttgagaggaaccggctgtggctgaggacacaggaacgggcattggtgctcgagtccctatcagtgtgtgactttctcaagcagcacttaggctgcctgaggcgccgcagccaaggaggcaggtggtccaggcttgtttatggagcagaaagatggggcccggatgcagaaggcgctgagcacttcgagagcaggtgttcaggagtgaaaaaaacccagccaggctggcgtcgtggtcaagaatccatatcacaggaatccctgaccccagaggctgtcccctctggtcctgcccttgccatcccgagtccctcccgtggtgtccagtgagtgggtattcgcttgtacgtgtgctgagtgtgtcacaaagggggtgcagggacacctgccagtttcacactgccatctggagcacttgcagaggccctggcagtcctgacctggctgcactgctccgttgcttgttctccaagctgcgatcccaattcgctccacacgggcctggtcctacggtcttggtgctctgggttctcactttgtccagggccccagagctgagtctcttagccctgaggagttttattagaaatacgagtctagaggatctgattttggttttgttctttaggaaagagagcgccccatgcagaactaactgcacgtcatttctatagctgctacgtcagggccatgccttaagtgtgggctgggcgtcctgacttccttccgcggagggcagtgtggaaaggggtgggagtcactttacagccaagaaacctggcaaactgactgcctcggcccagtgatcacggtcagcaccagcagccataagtcacgttgacggcctgtgcccttgacatcgtgtgacgagaagggcgctccagctgtgacagactccagcaaacccaatcgagagtctacgggatgtccgaccagtcctcaaaaccgtcacagtcacgagaaacaagaaactgtcatagtcgagaggagcctgaggggatgtgactgctaaatgtcacgtgggatcctggatgaggtcctggggcaggaaagaacatgagggaaagactaaggaagcggctggggcgtggactagaggtaatgggaacattcatcgtcaccagcatttcatactcacttgcggtggtacccataggggaaactgggagggggccatatgggaacttggtattatccttgtaatttttctgtaaacctaaaactgttctgaaaaataaaattcattttaaaaagaaagtggcaaacctgggttaggctctctgctggatttgtaatcttgctgtcggtgagatggatctggatgtccctggcccagctgccaggaggatctctgcctcagtggggctccaggccacctcctgttcggtgacctgctcgttgtcgcgctctgccggctgggggaatggagcagtgctgggtgaggctcaggcccacagcagatgttcagcagccttgcaagtgcatggataagctgcgggagacggggattgcgctcttccctgtgcctcctcacttcccctttagtgagagcatttggccaaatgtcctgtgaagctccttctgaaccctgaccccagaggctgtcccctctggtcctgcccttgccctcccgagtccctcccatggtatccagtgagtgggtgttcacttgtacctgtgctgagtgtttcacaaagggggtacagggacatctgcctgtgaacctggttctcccccactgtctggcagggctggggattctcagcccctggcctctccctggactcttctgccccacagcggggtcgggctggtctcaggcttggaaaggtaaatggaactggtggtgggtggtgccagcaggccctcctgctctggacaaggaagtggcagagaaacagcagtgacacaaactggggtcccaccagcctgtccactgccgtggccttcctcatcctcaccacccaggccccacagagcggccggcacccacgggactggtctttcagaaagatgctgtccgtagcacagtatttttaaaaaatactcctttgtaaataacttttggggttattttaattacaaaagtaaaacctcttggccaggctcagtggctcacatctgtaatcccaacactttgggaggtcgaggtggggccgaggtgggaggattgcttgagcccagaagttttagaccagcctgggtgacatagtgagaccccatctctaaaaataattttaacaattagcttgggcctgctggagcgggcctgtagtcccagatactctggaggctgaggtgggaggctgtcttgagcccaagaatttgaggtggcggtgagctgtgatcacagcgctggactccaccctgggtgacagagcaagatcctatctctttaaaaaaaaaaaaaaaaaggaacctgtgttcattgcagaaaatgtacgtgtttgccaaagaaaataaagtttgctagcacctgtaatcccatttcccaaaggccaggcagatatagtgcttcccgacctccctgtccctcactcgcagacggttggcttaccaatgtcttcatgttctcttgcacaggacacagcttgggctatggctttgtgaactacgtgaccgcgaaggatgcagagagagcgatcaacacgctgaacggcttgaggctccagtcaaaaaccattaaggtaaagggatctgatcaccaccgcatccattcctgccctgggcacaggtctgtgctgagccccgcccagcctcacagtcactctccaagggactatgagcacagccgctcctcgggggctcccatcagataccctggtcaggtgtatctgacccaggccttacatgagtgtctcaggacccactccccgcccagggtgcccccaggttgcgtcagctcccaggcctcccctgtcgtctctcctgcctggctctctgtgttcccatccctggacagctccatccacccccagcctgcccagtgctccctctgcgctccttggggccagttgtaacccttccctcacccagcacctcactcagcacctactgtgtgccccacagtgaccaaaacagacaaattcagtgcccccgtgggtcgggggtgcagacagtaaacaagacagaggatagccatgtgtgaccggcagttgccgtgtgtggaggcttcacagcggcaggtgacttgaggaagccaactgtgcagcagcccaggggcagcacctccagcagggccatagtggcttcctgggatgagttgcaggtcctccaggtcacacagatggatttcctctgtcctcatcatctgacccgcgctctcgtgcactggggctgtcaaccccgagccccacttacccccgtccccacgtgtctgccttctggctcctgggttcgtgggcagctcctgccacctgtatcaagcctcgtgtctttccgacctttgctccctggtctcctgtcagtcctgggtactgctgagccttccctgagcctcccgtgccccaggcaggcccctgcaactgggcttcctgcagcagccactgcacccacccgccctcagtgcccgccttcacaagatacccacagacgtaagggcttcccggccagaatcccctctcttgctccaaggccatttggaatgaggtggtcctgtgtgagcctgtagatctgctagattcccctgccccagagaaaggtgctccctgagtcacatcaggcaccctgaagggtccctcttggacctgccaattattagggcctcctggggagctgtaacatatagattccatggtcacaggggggcctcctgagtcactgcagggtgggcctgggagcctggatttttgcctgcccaccaagaggggttctgtgacctgacagtgacagcaccttcagccaacagctggcctctgtccctgccttcagactgccccatgatcttggttactcagtggccaaaccctggctcagcagcagctctcccagacctgccccatgccgcatggacgtggtgtgcagtgggctccctgagggcaggcgcgccactcctgcctcctcgtgtccagtgcaggtcctcagaggcaccttccccggtgggggctggtgagggcagccaagcgccatgggattccacctgagcaggggcagcccttcctcgcctccagccccaggtggcttatccttggccctggactccccatctaggaattctctcccctatttagaaaatgtgtgaaggttcttgtttctgaggcagccaggctgaggtgtggagcagaacgcttgattattcctgcacagctgttccgtttactcagatgcaggagccgggtgcccagtgtgtaaacaggactgtcttgcctctctaggattgatgttggtgggaaaggctggagtggctgcctgagtttggagccagagcctcacgggaccccaggggcccaggcctgggcaggtgtccctccctgtcatcccggccatgcatgcagaagcctgcctcaccttcggcggccctgccctctgccggcagagtctgcttctcagtggcttcacaccactgtcctagttctgcagaaacaggccagcctcatggggacgtgacagccctaagtaatttctccccaggtctccccgaggctccctgggcctggctcctctagcagttcccccggcgcagccctggggtcctctgtgctccaagtgtgttcattccgcaaacctttactgagcccctggccagtgtggtgctgggccagatacgttgatactgagggacttcggatcccctgccatccccagtttaaaggtgactgatctgtgcagtgtgataagggcctggatggagttgtgcgttcaactgatcctggattttattgcatcttggtctgatgccacctggtgtcctgcagttctattctgacaccagtcacccagagttagcacagccccagcacatttaaggccacggtccccaacaagaccgccctcacctcagatgccagtcaccctttgggggaccccaggcccctgcacttttgaccagctggctacaaattcagggttcccgccaccccttcagggtgcatgactcactagaatgactcctggaactcacacttctgatgacagtttgtttataaaggttgcaactcagggcctgccaaatgaagagccacacagggagggtcccaagcacagagctcacatgtctgcacctggtgggatcaggtgcctagtcctccctgcatgtgacctgtgcacctgccaggaggctccgtggagctttggtgtctgccgtgtttactgggctcattacgaatgcatgaccgattgactctttggccatgtgatcgaactccatccccagcacccctttcccctcccccaccctggaggtcaggccggtatcgcccagctcacagccccagccgtctagtcacatgcttggtctttctggtgtcggagcccatcctgagccatcacttagcacaaactcaagtgggatccaaggccttatggtaacaaagacagaaattccaggagttttacaagcttcctcctaggaatctgggacagagaccagacaaatcctttatgacaatacgggctagggccaagccctctgccaggtgctgggggtcactggcccatggtccatcctcggggagcccagttgtgcccaccattctctgtaaggtggtcccagggtgggcttaggagcctataatagtggccagtgccagaggaggctccctcaagaaagccagagttgagatctggaggaggagagggagttagccagaccagggtggagatgagggtattctgagcagcaggacctgcaggggcacaaggcaagggccgcatcctagaggagacccagtggccaggcacatcatgggaactgcaggctggccccaagcctctgccccgctcctcccttgcaggcagggcctcctggagccttgtgctcatcctgggctctgaggccccagccctgcacagagagcgcagacgtgccttgccttcaccccgtccgctctgtcctctttggtcctgatgtcattcccttggtggcagagtggagaaggaggagtcctgtctcctcatccctatctatctttttcccatagtagcagcccaggcagccacagtgggagtggtcctgcatggaggcgacaggctgagcatgtcccagatgcagctcagtgtccctgctgggatgctgcacagtctctgtgtgcagctcttcatcactgctgggtccctgtgtgccacacacagccagtgcttatcaaaggctgacggggccagaccttccatcctgtatctcacgtgccctctccacagccccataaaaaatggtccccagattcgggttgaagaagctgatgtttcgagtagtgaaacagctctgccaaggtcacggagggatggaggggcaaagccagggtgtgaaaccgggtgctgtatgtggctacaggcacttaacattgtcacctggaggcttccccagcacattgtgagatccaagcctcaggaaccagaacagcagaactcctgtcacccacagaagccggcgccggggactgcagtgcagataggcaggcgttcttcacagcagtggctactgcgcactccactcacgcagcagcggtccccagatgcctgccgttcacctgaggctgctctgagtgctttggatatggcaggagacacacaagtctggccctcacagagtctgtttgcaaagttaaaagttaaataagtaaaatagatgccaggcagggtggtgcatgcctgtaatccagggcatttgggaggctggggcaggaggatcacttgagcccaggagttcaagtctaacctgagcaacatagcaagaccctgtctctacaaaaaaaactaaaaaaaaaaaaaaaaaatgtagcgtgtcaggtcatgatcaacgcagtcaagaactaaatagggacaggaggaactgggcgttgatgccagtggagggatctgtggcaagctgagtggtcaggagtttgctcagctgccatgacaaagccccacaggccaggttgcttcaacagaagaagggtatcaactcacagttctggaggctggaagcccgagaccaaggtgtcagcagggttggtttctcttgaaggcactgggaagggatctgtcacaggcctctctcacagcttctggtggaggctggtggtctctggcactgcttgctttagagaagcatcaccccagtgtctgcctccatcttcacacagacttctccctgtgagagtgcctgtatccacatttcccgcctttctaaattgaatttatgttttcaaaaaaaatactttttttttttttgagatggagtcttgctctgtcactcaggctggagtgcagtggcgcgatctcggctcactgcaagctccgcctcctgggttcacgccattctcctgcctcagcctcccgagtagctgggactacaggcgcctgccaccatgcctggctaattttttgtatttttagtagagatggggtttcaccatgttagccaggatggtctcgatctcctgacctcgtgatccacccgcctcggcctcccaaagtgctgggattataggcatgagccactgcgcccagccaaaaaaaaatactttttttttttttttaaagacaggacctcactcagtcacccaggctggactgcagtgatgtgatcacggctcactgcagcctcaaactcctgagctcaggtgatcctcctacctcagcctcccgagtagctgggaatagaggtatgccccaccacgaccagctaattttttttgtagagatggggtcttgccatgttgcccaggctgaactcttgggttcaagcgatcctcccactcagcctccaaaacagtgggattactggcctgcgccaccacacctggcctaaatttccctcttttataaggacatcagtcacatttgattagagatcaccctataccagtgtgacctcgtcttaactgattacatccgcaatgactgtatccaaatcaggtcacgttttgaggtcccaaggggttaggacttcggcatatgaatttggattgtggggtggggggaacacgattgaacccctcactggatgaattcttgagaatgggcagccagaaaaagacctgattgaggccaaagagcaagcgatgttgggagcttaggaaagagggttctggccgaggggccggggagccccaggtcagtgcacgcctgctgtgcgccagctgttctgattctagcctgactgaacatgacagtgtccagagagaagaggaaagcagagttcccatggtccttggagacacctgtccttgggaggcatcagagctttccccagcatttggctctagggcacttctcctctggggcttcatccagggacggcagtaggtccagtcagtgccagcctcagctccgctccactggcgccagggtcatggtttggcaggcccccaaatactgccccagtccagacaggtctgcagggagccagggcaagcccggacactaggggaggctgggggccaaggcagcctctttttctctggggacagcactggcagcccctgacccacatcatggggtgagcaagtgtccccagagctcctgtccacaggctgatggaggtgccccgggcctgggagcagcacggcttccccagagacctcatgggctccgtagtgacatgctccctcgattcccaccgctaccaggcagagctggcctccagccccacactcctctcctcgtggggctgtcctgttcccctgctgggccgcccactgccctatgagcaggggcaatgtctgttgttccttctctggaacatgataggagcttctcagaggatgctgtgtgtgtgttctcagcacgcagattctgcccagtgactcctgagtggcggcttctccctgcgttctggtctcagttaccttggctcatcagttctgtgcccctcactcaaagggaatgaacttcctttcgcacaggttcaagtccccacccttctcgggaacacatctcctgctccctcctccatatcccagcctcctgacgaggctgtgagtcctgccaggctgccccttcacaggcagaggggttccactgtggtccttttcttccttctgggcccatggggtctgcacggccgtcagcgccaacctgagaaagcaccgaagaccttgtcttgcattggcctccgggctcccctcaccaccctctccacacgaatgatgaatgtaccattttgtcaaagcacccagaaggttctcttcagttttctttgattttgcaaaatataaatccaaaaggcattgagtcgtttaatattgaacacttgagtggatttgagtacaaactcggggtcctcccagaactcacagcccctgtcagggcttctgtggcgagcttgctctttggcaggggagtctcctgtgttcccagtagctcccagcttgcttgcccgctgcagcacgggctgctttcaggcaccaggacctctctggcaccggctcactgtccagcacatcagagaggtagccacacacaagctgcgggccctcagttgctgggctttgtgacataggagtcacgcctgcctccttgaggatggtgagcacccagtgaggaagcactgccaggcatcctggctcacggcccatccctcagtgagcttgccaccatgcggctgcaggcggtgagcgtcagtgatgataatcgttccctgcatgatttctaacacacagtgttggcttttcctaacccagcattcaacaccctcctcaatgctttggccacgtgcctgtactaatctcggaaagtggttgtgttcccaaggtgtcgtatgctcgcccgagctcagaggtgatcaaagacgccaacttgtacatcagcgggctcccgcggaccatgacccagaaggacgtagaagacatgttctctcggtttgggcggatcatcaactcgcgggtcctcgtggatcagactacaggtaccagaggggccccagacgcgtggggagggtgttctctaggtgggggctgggttttctagggaaggcagatcaccgtttgattttaaatgtcattagttattccgcaaacgaggacagcaccaaaatgagaagacgttggctttggtttgaggaggctgaggaggtaagatggcattaaaagaagctggggatatctgggcgtggtggctcacgcctgtaatcccagcactttgggaggccaaggtgggtggatcacgaggtcaggagatggagaccagcctgaccaacatggtgaaaccctgtctctactaaaaatacaaaaaattagctgggcatggtggcgggcgcctgtagtcccagctactcgggaggctgagacaggagaatggcatgaacccgggaagcggaggttgcagtgagccgaggtcttgccactgcactccagcgtgggtgacagagcgagactccgtcttaaaaaaaaaaaaaaaaaaagctggggattaggccagcatttcatgtacagtgaaaacgccaagagattctagcaccttccctcaggcacccaaatgtgctggccttgcccatgaatggggtgaaaaggacactgcaggccgggtgtggtggctcacgcctgtaatcccagcactttgggaggccgaggtggacggatcacctgaggtcaggagtttgagaccagcctggccaacatggtgaagccccatctctactaaaaatacaaaaattagccaggtgtggtggcaggcgcctgtaatcccagctactcgggaggctgaggcaggagaatcgcctggaccccaggaggcggagattgcagcaagccgagattgcgccactgaactccagcctgggcagcagagcgggatttcatctcaaaaaaaaaaaaaaaaaaaaaaaaaaaaaggatactgcagccaggtgcggtggcgcgggcatgtcatcacagctgctcaggagactgaggtgggaggattgcttgagcccaggagttcacagctgtggtgagccgtgatcgcgccactacacttcagcctgggcaacagagcaagaccctgtttcttaaaaaaaaagaaaaagaaaaaaaaaggctgctgcacatttgtccactgtggctttcgttgcaggcatttggggtgcagtagtctgatggcccaaatccccagaattcggatgcccctctctggggagcacatctaaagtgcacagagcacatggcagcgaattcctctaatgggcaggcaatcctggccactttgctggccctcccagtccgtcttggcactggatgtgggctctgggctttgtgtgatgccgtcaggcagagatgagcaggggacatgtgcacgcccacggctgtgctccggccctactgcctggcccgcctgccgcactaggctaggaactagtgccccaccacatcctttgccaagccctgcacgtggccccgcctgggggacagggagctcgggccaccctgaggggatttaggatcgctcagctctgtttggggcaggagcaggagtctgctaactaaccagcagggaagaatccactccctgagcctagtgaggcccatgcgttgtatgggtggttttcatattcttcccacacagactgtgtgtgccgcaccttggctgtgatgttgaaataacaccgagtagttgggccacagaaagtcatgctctgaggtgacctctttttgagagaacagcagcactcccccagcagcccagagcctcgcctttcatgtgcacacaggtggggccttcctggcctgcaggctagaggggcatgcacattgtcctgcgtcccctgagctgcgtgctttggggtgggcggccttatcagtctctcttcctcctcctttccggctgtaggaaccccacctggcatgcactggccctgccgctgccggccttcgttcccgctggggcccgaggaggggaagggcccctttgcacttcatgggggccctgggagcttcctgtagcctagcacagactcgcgccctggcaccgggcagtgccgaaggacagggctcactcgcacggccgccgccattctgcctttgctctggggagagggtcgggggatgccagttactcggtgtaaactcccctggtctgcaccagaagagtctcctgtggtccctgaagtcctctcacttaagtgccagctgagcgaatgatcctgtcagtgggccagtgtgtgggtttattgccccccattctgcactggggcatctgagctggctgtgcagggcccagggccgggggaaccaacctcactggcccacagtccactcccctcctcctctagaccccacatgcactgctctgcctcggcctgtctgtgtccagtatggccctgatgagggaagcctgtgctccacttggagcccccaatgcctgagaacatgcctccagccacccaactctcttggggccttccctagtctctcaggcacacacgggccacaggcagggggaactcacctctgcacacagctgctgggggcattgcttcctttccctctgcaagatagtgtctcccagggtgttgggggcaccttagtattgcgcccccagggtcggctgtgaacctcaaggtggcctaaggaacctttgtcatctttgcagagcagtgagggaggcagagagaagggagccaggagggtctcccggctctgcttcccaccccaggatgcagaattggtgggaaggtgaggctcccatcccagggctgtagctccctctgctggagacagagtgtgtgtggcaggccagcctgtgtggagtttgccttcctgtgacgggctttttagtgttaaatagatgaggatggccgggcgcggtggctcacgcctgtaatcctaatactttgggaggccaaggtgggaggattgcttgagcccaggagttcagaacagcctggccaacatagcgagacccccaactctttttttaaaaaaagagaaaaaaaatcccaccctgagctgacagagcttaattttttgtattccttcgcttctatatccaccttaattgtgaactttatagtgtattcatctggagattatgccgtttcttggactctgctgttaaattctaaaaaacacaagggggccgggggccgtggctcacgcctgtaatcccagcattttgggaggccaaggtgggtggatcacctgaggtcagcagttcgagacctgcctggccaacatggcaaaccccatctgtactaaaaataggccgggcacggtggcttatgcctgtaatcccagcactttgggaggccaaggtgggcggatcacgaggtcgagaggtcgagaccatcctggccaacatggtgaaaccccgtctccactaaaaatacaaaaacttagccaggcatggtggcaggcacctgtaatcccagctactggggaggctgaggcaggagtatcgtttgaacctgggaggcggaggttgcagtgagccgagattgcaccattgcactccagcctgggcaaaaagagcgaaactccatctctaaataaataaataaagtaaaataaaataaaaattagccaggcatggtggcaggcgcctggagtcccacctactcgggaggctgaagcaggagaatcacttgaaccggggaggtggaggttgcagtgagctgagatcgtgccattgtactccagcctgggcgacagagcgagactccatcttaaaaaaaaaattaaaaataaaaaacactaggggaagaaaaaaacaaaaaatgcagagccatcttcagaaagtatacatccattaaataattgagtgaattgatatccccctctgctaaacagcatccctcctgccccccttactagagctttcttcctttcactcaggcagtttgcatttgaaagccactctacaaccccagacgaggaagccacacttgcacacgtgccttctctccgctgggccgcagggtctttagaaacagaatgaagccatctgcttggagccagcttccctacgagccggccagcgtcagctctcagtcgtatttgcctaaagttcgattttcatttaggtttccaagactgactaagctgtcattcgtgtcgtgagagactcaaagaaaacagcatctgtcagggttgtgttttcaggtgttccttctgagcagcagctcagaaatgagcttgagccccagaatattcctggcacgtgtgcgtagcgctaggtctgaccttactaaagctgctgtctctgtgctcacggggggcctgcagtgtcgcgattgtgggggcagctggcgggaccctctgggaagtggtggagtaaggtgccgtgtgaggcgtggagacaggacatggggacagttgggtgcccgctggacaggtcacccaaggccccgggctgcctggctttggtcgttgtttgttaccatgcaccagaggcctttgcctggagaagaaacctgacttaagacaccctttgactggaagtctttctttttccttaagaggtgagatcttactgtgttgtccaggctggtcttgaactcctggcctcaggcgattctcttgcctcagcctctggagtagttgagaccacaggcatgagccttggcctggcttgactaaaagtcttgagaaccagggtgtttgggttgggctgtctgtgacggcctctcccactgggacacacccgtgactcccgcctagtgatgtcactctcagactggcctctcagctgtcacctctcccacccctgggccttcccctgactccatcatgtccttgcccccagagaaggagctagtgcgctgctcagtgtgccctcatccccatccccctcatccagtttccagcccgcttcccaggttcctcaagggacgggctactcatgtttccctcccgggcctagtgtatggacaggcaggggtgcaggacagccatgctctccttccacccgccttgctcagcatctcacacccatgcccagctgaccaatgtcccccatagcaggacggtcctcaggtctcacactgctccgtccagggattgggtttagccgggaacccgggactggcccttgggtggctcagttgaggtggcaagagaagatgccctctgggcttggctgctggggccctggcccttcccatacagggaccccaggcctgcctggcgagcctgtggataggttcagctctgctgtatgagcctgggcagtgttctggcctcatttgattctgatggcaatttggggcccacgggaggggtgtaggaccttagagtggagtatcccaagacaggagtgaggtgacagcagcagcatggagctggcagggggtggccacaggaccctactccctcctggcatgaaggagaaggcatgcaggctgagctgggcacctttgcagcaggctcggccacgaggcctgctgtcacagcgggcccagagacagcagccaggagagtggcccctgagcccagggaggatctctcagacgcagtccccactccaaccctgttacccaccaaccacacaccacacccacgcacccactctgtggcggacacctggcagctaaatagtgacggtggatgtgctgtttcctaatgttgctttcttccaaataagaggcctgggtgtctattggggatgtctgtcaccaaaatatctttgggcgccaacactgtggagtcatggcttcagccgggaagaaagtctgaagctttaatcttctgttagtcattggttttctttactccatccatttgttttcacttttaggtttaatttttgtttatttccttaaccagacttctagcctggcccacagtagactgacctgacttttgcttttcagttttgaaagtcctagcgtttttccccctaactccgtttttgttgatttgttgaaaaggtttgtccagaggggttgcgtttatccggtttgacaaacggtcggaggcagaagaggcaattaccagtttcaatggtcataaacccccaggttcctctgagcccatcacagtgaagtttgcagccaaccccaaccagaacaaaaacgtggcactcctctcgcagctgtaccactcgccagcgcgacggttcggaggccccgttcaccaccaggcgcagagattcaggtgggtcgggagggtgcgcgctcctgaaagccatacttagccccgctggcaggcgacggcacagccacagaatagaaaccacggggatgatagactgatcccgtcagagagcgcgtttcagaatcattctgcagctccacaccacaacctccatcagaaaggtgtctgtaggaaagccgtttacttccgattgggcgttgtctttcatgggaatcaaaacagtgactccaggctggacacagtgacttatccctgtaatcctagcaccttgggtggctgagagaggaagatcgattgagcccaggagttcaagaccaacctgggcaatattgcgagaccccatctctacaaaaaatacaaagctggccaggcatggcggtgcgctcctgtagttgcagcaactcaggaagctgaggtgggaggattgcttgagcccaggaggttgaggctgcagtgagttgtgatcataccactgcactccagcctgggccacagggccagaacctgtctttttttgtttttattaaaaaaaaaaaaaagacagcaccagtccccaccagttgctgtgagcgtgagcacttagagcttcagcacgcagttcctagtaacagcagaacggagccgcgagctttaaagatggtttcatgcccagtgtgggggagcacacacctgtaatctcagctctcaggaggccgagttaggaggattacttgaagccccgagtttgagcagcctgggcaacaaagtgagacccctgttcctacaaaaagtaatgaaaaaaactgggcatggtgatgctggcctttagtcccagctactcaggaggccatggtgggaggatcgcttgaacccaggaggtggaggctgcagtgaactatgattgcaccactgcactgcagcctgggtgatagagtgagaccctttctctaaaaaataaatgaataatgaacgtctcatatctgtgggagaaaagatgctgccttaggtatactcgggtgagagtagatcttccagcattcttagacatttgatcagcagccctaaggcaaacctttttcaaacacctgcctcgtggagtcatttgtattggtgaatgttgtatgtatgcattctgtttataagccctgtcctagaggggaggagttttcccggattccttagtctttccatcctgaaaatggttctggctgccaggatgaagtgggatagaggcgatgagagtcagggccttggactccaggatgtggtgtgctgtcgcctcagaaacagcagaggtctcagtgtcagggctgttttgtttttgtcaaaacctcaaggagtggcatcgagggcttatctcaggtatgacaaggatagatttcccttttttttttaatttttaatgtttttattttttgttgagatggggtctcactgtgttgcccaggctggtcttaaactcctagcctcaagtgatcctcctacctcagcctcccaacgtactgggattataggcgtgagcccggccccatcgttgttttaacagtgaagctgggtgggcgctgcccagtgccacacatgctgctgtgagaggtgttattctcatggctgagttacccagcattctcagcctggctcaaattccaaagctggcctgccttccttgaggtttctggcttgaagacaaggctggggaagcttctctggacggaatggagctgaattttaaaatccagctctagaaatcccatcatacagtcggtcctgctcttgatggggcgggctatatgggcggtggggttgggtgaactgctccttagcctggaaggaaaacagggaaggttggaggagacatgggactctggtcccagtaatgaggacaagaaaagaaaggggaaaccggagaagtggacatttctggtcgagcaggaaaagtgagtggcagggcaaccactaagacaaagtgatggaaggaagtggggagggcgggagagtctggagggaaagattcgctcaggaggctgagagaagaggaggaagaaagacccagactgcagtgagtttgcagtcagtccctatcacgtccagaaaagcccagagataagggatggaaaagaattgggttggaggaagagaggagaagatttatgactgtcaagaccagagaaatcagcaggagaaaaactaccaacaagagtaattcctaagaaggccgggcgcattgactcacgcctgtaatcccaacgctttgggaggccaaagcaggaggatcacttgagcccaggaatttgagaccagcctggacaacatagaccctttcttcttagtctttccatcctgaaaatggttttacaaaaaatgtaaaaattagccagcatggtggcacacacctgtggtccagctgctcaggaggcaggaggatcacttgagcctaagagtttgagaccatactggacaacatagtgagaccctctctcaaaaataaagaaaatcaccgttgggctagtgagctgccccatggcagctggtgtcctctcgtgtctgtcgagagggtgaatctgtttaacagcgcttgaaggcactcgtttaccccggctggggcctgcagggctgcgcttggctgatagggccatagcctgaagcccagttttattttggagcaggtaatgcttctctgcatgcatcacgcagcttcacagatgccggcttcacaaatgtatgctactcagatattcccaaactgaccctcagacctttacttttttaatgtgagaaagttccagagggaaacatagctttaggaactgttttgtcatataccttaatccttattacagcatctgtacattttcagaaggctttattttattttagtttagtttagtttttgttttctgaggtttttgtttttttcctagagatggggtctctctgtgttgcccaggctggtctcaaactcctggcctcaagtgatcctcccaccttggcctctcaaagtcctgggattccgtgcttgagccaccatgcctggcccagaaaggcttattttttatgtaaataaaagtatcactgtggaaagagccccacgtgtgtggtcaagtttggtgagcctgccgttgctggtgtcccagggcccttccctgtcccttgagttctcagtcctcagtggtttggcccctgaccctcaggggatgttgagctctagccacagagggttggttgcctggtgcttgggaaggaattcttgtgccctacaagtggccctggcaaaggcgtgctctaaccagagaccactgggctgtcaacgcttgggggcgggtcatgataaggggaaggtgcaaaatttggaaaaaggagttcagcccctgcacgtaccccacagtacgaggagagtttcctccagggagaactgaggctgtcagaggcctgcagagcatttctaccttcaacggaggaccaggagaagcgcccatcatctaaaatgtggggaaccgcaggaacccctaaacagaaaccccgacatacacagtgggaggagtggagggcaccaaccagcccctcagagtcagctccctacagaacagggtcccgcccctccactactgtatttaattcctcccagggttttgacccatgcaggtgtctcaaccgtgagcacctcgtggctgcgcagagcgggatggggcccagcggccatggtcagcatgcgtccaggccttgccccatccccaggccgcctgcgctgaccgtggcctgacgcttgctctctgtctgccaggttctcccccatgggcgtcgatcacatgagcgggctctctggcgtcaacgtgccaggaaacgcctcctccggctggtgcattttcatctacaacctggggcaggatgccgacgaggggatcctctggcagatgtttgggccgtttggtgccgtcaccaatgtgaaagtgatccgcgacttcaacaccaacaagtgcaaagggtttggctttgtgaccatgacaaactatgaagaagccgcgatggccatagccagcctgaacggctaccgcctgggggacaaaatcttacaggtttccttcaaaaccaacaagtcccacaaataactcgctcatgcttttttttgtacggaatagataattaagagtgaaggagttgaaacttttcttgttagtgtacaactcattttgcgccaattttcacaagtgtttgtctttgtctgaatgagaagtgagaaggtttttatactctgggatgcaaccgacatgttcaaatgtttgaaatcccacaatgttagaccaatcttaagtttcgtaagttatttcctttaagatatatattaaacagaaatctaagtagaactgcattgactaaccagtccctctggatggtggtgaacctgaagcatgctttaacctctaagactgtctaacacgcgtttcattcaatgtctccacagactgggtagcaaaaaaatcaccttttagttttagtttttaatctaaagatgttagacagatgctgagtgtgcgttttctcaaccgcttcaacattgtaagcgatgtatgctttggttgacaggaagttccttttccaggcaggtcccgttgccacctcctgctcactcagtcccgggctctgccgagtggtcctgggaatggcggcgggcccgtccagcgtgggccaccactggggccgggggccacgggctgcatgctgggcgggccctccagagaaggacacaaacgtgtttcgtaagcccaggcaccaatgggaatggaccaaagagtttcagggaaactccagtatattccagagtcagatctaagctccaggcacgcctgaagatgtgttgctactctgacatcccgagtttctgtccacacattgcatgcacagcgccccacacattggatactgttgttcacgataatttctcccgttttccagagcatttaacatagcttggaggcgtaaaatggctctgtattttaataacacagaaacatttgagcattgtatttctcgcatcccttctcgtgagcgcttagacctttttctattttagtcggattttgttttggaattttgcttttgtatgaacactcagcagaaaagtacttacttcttgccagttatctattaaccaaaacctttgatttgtagttttaaagattaaccctcaaagttctcttcataactgccttgacattttgggttgttctgttctgttaattttcttttgcttttttgtgttttttgtttgtttttacttttgcatttaagaccattaaatttgattttgttttgctcg

SEQ ID NO: 38392 - DNA, 4914 bp, Homo sapiens
atgcgggggcggggcagcggcgacgctgggtgtgtgggcgcagatggcggcggcgcacggcgcctgagcgggccggggccatgagcgccgcccggccccagttcagcattgatgatgccttcgagctgtccctggaggacgggggccctgggcccgagtccagcggggtcgcgcgctttgggccgctgcacttcgagcgtcgggcccggttcgaggtggctgacgaggacaagcagtcccggctgcgctaccaggtgaaccgcccggcccacctaaccccctgcccccggccggacgggaccccaggccgggccccaaaggcctcaactcggggaagcatctgcctagaggccccagctgaagcgcgagaccgcccccccgccccgcggacgtgactcttgatccagagccctgcccaggccctcccggttcccataccgggccccagccagccgggaagagcccagtgcccgggcccgggagctcatccctcagctccagctggggaacccaaccggattccccactcatcctggctactcgcacctggcccccgctgggttgggggagctcctctgtatctgaaccagaccttgccccacacgcaggagcatcccctgtgccccaggccagctaagctgatgggaacccgcacgcctttctctattctgaaagccctctccctaatcccaccaccacccctaagagctggagctcctctcacatgaccagtccttgcccaccctttggctcccactaaaccagaaaaacccattttcccagaaaacctccaccaaccctaggctgcttttcttggagacctggaccagaaccctgtgccttgaacctgggaactctgggcctggcctttcctggcaccccaattcccaagctcccattctaggccactgaatgagagctccaccctaacccaaagttgggagctctcctttccctgggatctatgcaggctcctgctccccaaagccctggcatccacccacctcctacctggtttctgtgaatcaccaaacccgttctgcggggagggcagagggccaggtgaacagctgccaggcggccaggcaaatggttgtgtaggcctgcttttctcttcccgggagggagtgaggaagggccccagcccagcaacccccctgagacctgtgttctgcaacagaacctggagaacgatgaggatggagcccaggcctctccggagccggatgggggagtcggcaccaggttagggccaggtggggacccaaccctgtaccccagccccagctcctatccccagggaccctgctcagtcacccaccccacttcactcactctcttccatcccgtcctattgattcctagcctgaccctcactttcctcacagggtctcctacactgtagggtcaccctaccctagtgcccagctgtactcacctctttcagaaacccccagtctggtctggcccccaccttcatacaggtcacctgtcctacagaatcccctagctcatccccagcccctgaattcatgctcacccaccgaggcctctcagggcccactatcctgcaaggggccagccccagtccctgcaccatgccctgcacttcatcaggactcctgtcccaaagcaaccccgtccttgcctccctgcccctcactgggcgcctgtcctggcagggattccagccgaacttccatccgcagctcccagtggtccttcagcaccatcagcagcagcacccagcgctcctacaacacctgctgcaggtgagcctgcccgcctaagcccccagccgagcagccctggctccacccccacagcctcctgcaccccctccctccacctccttcacattcaccctgctctcctgccacccagctggacccaacaccctttgatccagaagaaccgccgagtggtgctggcctccttcctgctcctgctgctggggctgggtgagtggccctgagggttggggtcaagaggggccccgtgggaggctctgccctccttttgtacaggctctgcctcccccttgacactgagcctcccagcatcctgaggaggcagctggctgccatcatcacactcccattttacaggtgaggagacagaggccttgtgacctgggcacacagccaggaaatcacacatagctgaaaatggaacctggcttatcactgcaaagacttttccttttttaaaaaatttaacctgtttaaatccattagaggacagaagagtagcagctaccatttattctgtgtctactctgggcaaggtgcagggcagttttattttcccatcttacagaagtcctacaagtgaggtggtgcccagaagccacgtgtaggggctcagggatgccgagtgcccagccagtgcagagccgcagggcacctggcacttccccttgtctggcatctaagcactgacaagcacccctctcctacccattgctcagatgggggaacttttggtccagagcaggcagatctcacaccaggtgttctttggctcccaggcacctcgttctttggggtagaggaggcagagtccccagaaaggatccagggttggggtcacgagtgatccataagaagggactaactgtggctgctaccctggctcatctctccgcttctccaggaaggccaaggctccccagccagccaggcccctggcacagagtctggcctctgctcagggtgtttgagtgtgggggagggggctgccacttcccagcaccgctgtacactggccctggtagtgctgccaagttctttcatttttcccctcaacccagcaaggcaagcctggggctaccagagcgccttagagggcctttgtagggtgcagggagtgagtttcagcccccatcataccctatacccctttatttttatttatttattttttgaggaggagtcttgctctgtcgcccaggcaggagtgtagtggcgcaatctcggctcactgcaacctctgcctcctgggttcaagggattttcatgccttagcctccagagtagctgggattacaggcgcgcgccaccacacctggctaattttttgtatttttttagtagagatggggtttcaccatgttggcctcaggtgatccacccacctcagcttcccaaagtgttgggattacaggcgtgagccaccacgcccagccctttttattttttagagacagggtcttgttctgttgcccaagctggagagctgtggtatgatcactgcagcctcaaactcttggactcaagccatcctcccagctgagcctccctagtagctgggactacaggcatgtaccaccatgctcagctaatttttttttttttaaaataataatagagacaaggtctcactatgttgcccaggctggtcttgaactcctgaactcaagtgatcctcctgcctcagcctcccaaagtgctaggattacagccatgagtcaccacgcctgggctgggctaatttttttttaaccttttatagagatggggatcttggtatgttgcccaggctggcttcaaactcctggcctcaagcgatcttcctgccttggctccctgaagcactgggattacaggcatgagccaccacacctggcccaccctttttgaagtagtctgggcaatgcacaaagcagtccatggtggccccccagtcccccaggcttactaccccccttgttgcagagcccaaagtccagctcctcattcccccatcactcttctaactggggacccaggactcctgcactgccctgttcttaccccctatatcccaatcacctgtactgttagctttcaggttcttattggttcctccactaaggacgggccatgagggcagggaccttatctgcccttcagggcggaattcccagtaccaggcacgcagtaggtgttccataaatgtttgctgaatgactaaaagcccaccccaaggaacaaagaaaaatctctcctttcacacacttcccagggcctgctcagtgccttgctctggaaacagagcttggtgagcttcctggggagggtctctgcctagggcaccttcagctcaggtggtgggtgagccgggctgggggtgggagcccccgccctcaccactgctcctgcccccacccccgcggctccgtctgtgtgcagtgctgatcctggtcggcgtgggactggaggcgaccccctctccaggtgagcgaccctcccgcccccacaggcagaggacacccctgtcttgtgtccacgggtccacggcaagccctcccacctcccggcagtacacggctccttttcagctgggagtgaggcttgcccgggcagtcagcggcagcccggaaggcctcgaagcctccgccccctcgccctgaccgggctctggtccctcccgcaggtgtctccagcgccatcttcttcgtgccgggcttcctgttgttggtgcctggaggtgcgagcgggcaccggggcggaaggggcgggggctgtggggcggcactgggggcggtgttgcggggaggggcggggcttctgcgctgacaggccccgccccgcagtctatcacgtgatcttcatctactgcgcggtcaagggccaccggggcttccagttcttctacctgccctacttcgagaagtgatcgcggcgcagcgtggaccccttgcgcccatgggggcgcccctcttgccctgttccgttcccctcatctcaagggaagaggccctccaggaccctcgaaaccccagcccctagggagtttgctcaggaagttcggggcatgcaggcctggccctgggaaagccgcccgtcgcctgctctgtgccttaacttattctcgggccgtgcggctgctaggttgctgttattttgtgctaataaaagagtaattaattcc

SEQ ID NO: 38393 - DNA, 16578 bp, Homo sapiens
tgcgcgccgcccggccaggcccgcaaagaggcctccgagcgccatggctgcgcccccggcccgcgcggacgctgatccttcgcccacgtcgccacctacggcccgagacacaccaggccggcaggctgagaaaagcgagaccgcgtgcgaggaccggtaggcgtgggcctcgcctccactccactggcgagcgggaaggggctgcagatccggccgagctgggcgggtggtccgtccccgccgcgagcccaagtcccccactcccggaggccaggcggcggcgccccgttctcccacgtgccgggtggaaccccgcgggcttgaagcggccgggaggacggacctggcccaagccggcaggctcctcggggctcggggaaggagtccgggtgcgcacccccagcgttgaccttggtctctgcccccggtgggtggggccctcggcctcgagcgcccggcgggctgtgtgcctgctcgactgtgcgagttggtctatgttgtcggctcggggtgtggccctgcccgacccgcgaggccagggcttaggatttggaggtgctgcggcgcacggtgccttcggattgcctcgcacgcgcgtggcaccttcgagcctctgcgggggctttgcaagagcatgaagtggggaagttgtgggggtgcagcgggaggaacccgcccccaccccggttcgtcaccccgagtggcccctctgggagccgggccctgcgcggcgcctttggggccgtggccgtcagggggcggtggccacgcagtgcccggggctgcaagagggcgctctgggcgctgcccctcccttccgggtctgaagtgtcccttggggagcccgcggggtccccaggaaggggttgttcccactcaggcgcctcttgcctgggttcaggctgtgactcctgtcagaaacgctgtgagccaggactccctcagagatgggctgcgctggatgccgcagggggaagggtgtcccggcacagggtcgctcctctccaggagctgctgagcagaaagagctttcccctggccctgcgtcccttcaggtccacaccctcccagtgggcagtgactaggaactttgcatggctggagtctaatagggcctgagtctgttcctctgctggttccaaagaggcgttgtttttttgttttgagatggagtctcactctgtcgcccaggctggagtgcagtggctcgatctcggctcactgcaacctccctttcccgagctcagttcaagcaattctcctgcctcagcctcccgagtagctggaattacaggtgtgcgccaccacgcccggctaatttttttttgtatttttagtagagaggtattttgtcaggttgtccaggctggtctccaactcctgacctcaggtgatctgcccgcctcggcctccgtgggattacaggcgtgagccaccgcgcccagccaccaaagaggttttgatttaacccgaggtggggcaggccaacgctagataagcactgagagctcttgagaaaggcactcctggatgacacaggttggtggcagcagccatctgggcctgccctgtgcacagacggtgggctgggcacggtggccctcgctgtgtcccacgaggcagagactgttgttatctttctttggtgtggttaccaagggacaggagggaagctccaggcagtgaggatagattgcagcacccttctccaggggccccggtctgccctggaactgcctcttgtcttaggcacatttcttgcactttgtgtcctgatgcttgtgccatcgaggacttcctctgccccagcctagggcttttctcactgttccccgagcgtgtccccaacgttcctgcgtctgcccctcttcaacctctgctgctgcccttagtgttccagagcaggctccagcttggaggtctgtgcacgggtggaggtctgtccccagggctggggttcctccaccaccgttccagtgcctcctgccacatcctcccggcaatcagtctgtccatcttgcctgttgtttattgtctgcttgccactcgtgactctgtcctgggcacctgcccccagagctggcccgtgctggtgcaggaacaggtcctttgtggtgttagcagtgactcctggctgcggttgagatggagtctggggctgtggaagtggggagcagagggaggctgcccatgatctgtgcagggcaggtcctgctgagggaaggtttcctgagtggtggggtgggccagggcaagcccccaacccccagtgctcatccagcctgagaaagcagccctaatgactctccctgagtcagtccggcaccagtggggtcaggcctgcattggctcctgtgggctagctcctccctgctccctcctccccccagcctcattttagttatccagcaaacttcccttaaacctgacctgtcaggaggtgccgtgctacaggcacccagcaggaaggtccgtgggcgatggtgaccccaggggtggtagaacaggcctgaaccacagcaagggagtgcccgagccttcctttctccctgtgtgctctctcccgtggctgtttcctcagtgtcggtttcacatgccctgcgctccctgctgctggacgtttgcttctggtttccttggcattgtggatggttcgtgaggggcagccctgcctccaggtctccacacatgcctgtgcttatttttcttcctttcttttttttttggagatagagtcctgggctggagtgcaatggcaccatctcggctcactgcaacctccgcctcccgggttcaagcagttctcctgcctcagcctcccgagtagctgggactacaggcgcccgccaccacgcccagctaattttttgtatttttagtagagacggggtttcaccatgttggccaggctggtcttgaactcctgacctcagatgatctgcccgctcagcctctgaaagtgctgggattacaggcgtgagccactgcacccggctgcctgtgtgtatttcttttgttttgttttgttttgtttttgagatggagttttgctcttgttgcccaggctggattgcagtggcgcaatctcagctcacagcaacctctgcctcccgggttcaagcaattctcctgcctcagcctcccaagtagctgggattacaggcatgtgccactacgcccggctaattttgtgtttttagtagagacagggtttctccatgttggtcaggctggtctcaaacgcccaacctcaggtgatccacctgccttggcctcccaaagtgctgggattacaggcatgtgccaccgtgcccagctaattttgtatttctagtagagataaggtttctccacgttgaggctggtctcaaactccgaccttgggtgatccgcccgcctcggcctcccacagtgctgggatgacaggcgtgagccaccgcgcccggccacctgtgcctatttcttgacgatgacatcagttatggggcctgatcaccgatgaggcatctgccttggactttatgagctgacccacctgtaatgaacctgctgttagtccttgaggaggaaactgaggcaagctgtggctccgtggaggggactgagccacattcgactgtgctgtggcccagagtaggatggctgaaggtgagggaagggcaaggggtgccctgaagtgactgaggcagcctccagcaccacgggcctcagacagccccacctgcaaggaggaagccttaggcagaaggtgctctgggcagcgcttaccccagcgcggcatcagcacctgtgggtggcgtgggaatgggagttctctggaccggcccagctcaggaagttagaacctgggaggaacaccagtgaataggaccagggcaggctacccctccccaccgtgagcggcccctccctgccgtgggctgctgtggccgagagcagccccgtggaggggcatgttggggaccacgtggcctgcagcgaggcgacgtgattccagggtggggcctggtggttccattcacagctgcgtgcctgggctcctccgtccctcgcctggccagcacagtgctggcttccccaggcctgtagccttgcctcttggccggctagggcagccagggtgcatgcccatgccaggcaagaccagtctgcgtccactctgctgttcagacagcccagccagtggcatggcccccaggagcccggactctgcgcccctgctcaggacagcctccgcctccccgaccctgggctgtctcctgcccacttcccaagtgagggatgtagccgcctcctgggagcagaatgaggagaggaagcacctgtggacacagacagatgggccggtcctgcctctgaggcagctcccaggagtggcctactattgaggagtatgacctccatgtggagtcttcccttttccctgagcttctggcagcccctgcctcagtactagaagctccaagagaaacccatggtaggaggaagctgacacccatggctgacctgtctgcccctgggagagagcttagggctgccaggacttctctgtgcacatccttgactgactctgcggagggtggggccgaaaccctgtttctgtgggcggggaggtggctgtgtcccctgtgccctgctgagccctgggcggggaggtggctgtgtcccctgtgccctgctgagccctgggcggggaggtggctgtgtcccctgtgccctgctgagccctgggcggggaggtggctgtgtcccctgtgctctgctgagccctgggtggtgagccctgggtggctgcaggtccctgcaggatcccccgtgagtgggggtagggcaaggcagttattttcagatggtgccagagggtggagtttcagatttgtttatgcctgtcggaagcactctggggctagggatggggtgcccagctcagcactgacgttcaggacacctggccaagaggcgcctcagatatccttgtcctgctgcggggggttcactctgtagccccaggcaggccggggtactgtagctttttccaggggatccaggaggggtgcaggcacacggcgcacagtggtcctccgcaggcctgcggtcctaggctggccgaatgtgccagcccacacacaggagggggcagttcacaccgagggctggcccgaggattgtcagggccacaccaggcaaagccagcgctattaatatcaggcatacacaagcccccagctgggtgatcctcttatgcctgtggccttggcctctgaggacggcagtgagtgctgttccctcagtacggtggaggcttcaagggcctcctagctgctgtgcctctgctgacatttggcaggcagcttctgccagccaagggtctcaccccagccacccggctctgcacccactgtgctgcccacaggagtggtcctgcccatggaagggccagttcaggtggccggagctcctgagctgccctaggggactgctgtgggtctgaggtggtgatgtcccccacggctgcctgcgcctgagcccccacgcatccacccctggggccactctgctgttcaggagcacccacccgtgtcctcgaccatgagcagccccccagcttaccctggcatcaggatctcagggtgccgggcccttggagcagaaggcaggtgagtctcgactggaggtctctgccgtgaggggcacccacttgtgctgtggtcctggccactcagacctgtgtttggtgcatgtctgtggatatcaggaatcaaacaggctggcaggtgctctcgggcaccgggcagagcccagggtcgaaggtgccattttgcttgaggctgttggtctgggcgcgtctctcttgtgttggttacggcttggaaccctccgggttggaattaaccttttgttgttgtggccagaagcactcctgtccatctgtgcacaggaagtgaggtttgctgtgcaactttctcctctgtttttatttatttttaatattctaaagttttttgtgtggagaccgtctcaccatgttgcccaggctggtcacgaactgctgacctcaagcagtcctcccactgcagcctccaaaggactgttcaaggcatgagccaccacacccggccaactttcctgtcaaggggtgctgcttgtgaaccgtggggtgaggctttgtccttggctctgagacagaccagctttggagaaggtagtggggctgggctcggtgcagactcagcctgacgccgtcacaggcctgcggtgaggcgggcttctggcagatcgtcctggcctgcttgtgaccgttccgctgcatgggcaccactcccagcagaagggccagcgcctggctgtcagcagcgtgtgcctcaggagggatctgcggtgacggggttgttacttcagtaggatgaggaagagtcacaaatgcggggttggaaggctcctgctggagaggactgagcaccaggagactaccaatggggagcaggcacggtgccagcccggcctctgccgtctggtgtctgtccctcaagttagtcccagctttgtgcattagcgggctcaccctcggaatccagggtgcatggcggaagtgcaggcagccgcaagggcggtgctgggagcttcgctggggagcctctttgcaagtcagattgtgtcggggcttcctccctgaggttgaagacagtgggtgattccctgcagatgctggggttaggcatagaggggaggggccgcctggatttgttctctgcccaccacggcctccagggccaccagagcgtttctgtctgctgggaacctgctgctgaacctaagcaggactgccccactgtgcacagctgcgggccatccatcaccacctgctgggaggggtggccccgggggtgacccttgcaggcccttttgtttactgctggtgcgttggtcatgtgtgtccagggccgctgggaggtcgtggcttctgtttgctgggtcccgtcttccttcttgactgacagcccttcaggcagacctgagtggggtgcaggtcccattccagctgcagcccccgcatgcggtctcggggaagtgccgtggcacctgctcccccttcagggcaccgtgcagtggtgctgtcccccgggccgccctcgcctggtcgtcttggcgcctggccttgttgtttgtgctcagccctgctgctgacgtcaccactcagctccagaacgatctccggagccgaggtgaggctgagtgaggctgcctggctgattattccccgtgctcactcccctgatggtggcatggaaacaggcagacctgtctgtctctgaggagaggcacagcgcgttttccccgtcaggtgcagacggcgggtctctttgctgctttaaatgctgccacactgttctctgggcccaggagagctgtcacgtgtcgggctgggctccctccttccactgccccctgtgtgtgcacacggacactgtcctcctggctgtgggtgtcacgggtgcacggggaggagtgcccaggtgggaatcagtgttcccacgctggagatgccaccttcaaagacagactacggtttggtttatggcaacaaagtggcacctgctttaaaaacattcaaatgtgacagaagttgctgttccaaatcttggtggccagagagtgatcatggttagggctggtgtgtgcacacgcttccctctcacacacaccccctcccttacacgccccctcggtctcacacacaccccctccctctcacacacgcccctccctctcacacacgccccttccctctcacacacgcccctccctctcacacacgccccctccctctcacacacatcccctccctctcacacacgcctccctcctcacaccgaggcgcatggcggtgagcgtccttcgtttcctggattttatacagatggaatcatctctccttccagcttgcttttctcccctgaccatgctctgaggatgccgttccctgtccgcacctgtgttctgtgtcgttttcgggcgtaactggcatctgtggagcgttccatttcctgtggaactccggagcgcggtggacagactgtgccgctgcaggaagctacaaagaggcggtcctgccgtttgcggagctttccctcttgcccccgggggctctgccctgcacagacagtgactgtggttctgagttgctccccatgtgagtgggccatgacctgcagggccaaggtgctgacccctgagagcttcccagggagacctgaaacatggtgctgaggccaccacagccagctcggtgtctcctgggcagtggccacaagtgccttctgccggacctgtgtcttgtctcatggcatcttcacaccaggctctgcatctgagcctctcagaacagactgggcaggcgccacgttgatgcccccccaaccccccagcagggcactcggccatattgagcctccccagaggctgcccctcccagggctccatggccagtcacggccccctgcccacttgaggttgtaaactgacggagaagttggcaggcgcctgagtgccggtccagcacgtgcagtgcatgtagatgccacacagcctaggcctgtgtcttcctcccgttgatttcccccttgcagactttaggggctcccccttaccctgggcaggctcacggcagcccagacaggtggcagcactttcctctctggtgtttgccagatgccggaggtttctgtcttggggacccaggaggggccacagcaagaatgaatggggttccaataaggctcccagcgcagggtcccccatccggcactctgacagccagagaggccaggccgaggcactgtgctgggcctgctgtcactgcaggagaatcaggtcctggctgagccctctgcctctctccctgagcccttcagcctggtcctgtctggggacctcaccctcggtgtgtgcgcacaacctggtctggtctcgcctccacccacacgccgccctcacgtctccttgggcacccagccttcagcatggcagcgatttggctgcccagagagtgtgccgggttgcaagggaacgtggtccattttggggtctcacctgcctttcacaggcccaccttgagtcccctaggggacagagcctggcccagccagtgcctgtccacacagcaggatgagcatggccccaagatagcgcctctcctccttcccttgtccttgtttgctgttcctctgtccttgctgtgtggacagtgatgatctgaggccctgtgccaggctgagcacttgggtctgtgtgtcctgtggcccagctgcaggcaggaggcagggttttttttttttgaggtggagtctcactctgtcacccagactggagtgcagtggcacgatagctcattgcaatctccacctcccgggttcaagccattctcctgcctcagcctccctagtagctgggattacaggcacccaccaccgcacccaggtaattttttttttttaatttttagtagagacgggtcttcaccatgttggccaggctggtctcaaactcctgacctcaaatgatccacctgcctcggcctcccaaagtactgggattacaggcatgagccaccacgcccagcccaggcagagttcttatgtacccccaatgagcctgcccgcctcagccatgcctgttgagggggtggggggggtgccctgtgggccggccatgccagcgggtacctgggaggtgggcagctctgggccacatccgagtacatccctctctgcagcagcaatgcagagtccctggacaggctcctgccacctgtgggcactgggcgctctccccggaagcggaccaccagccagtgcaagtcagagcctcccctgctgcgtacaagcaagcgtaccatctacaccgccgggcggccgccctggtacaatgaacacggcacgcaatccaaagaggccttcgccatcggtgagagcagcgggggggtgggacctgctgccggacgcctgcctccggctcccctccagtgcctgtggagcaggagaaggaagccgggcaaccgcaggcagcggcagcgggatgggcacctctgggacctatctgtgccggcagcctgcctgttcctcacagagggtctccactcccgccggcaggcttgggaggcggcagtgcctctgggaagaccactgtggccagaatgatcatcgaggccctggatgtgccctgggtggtcttgctgtccatggactccttctacaaggtgggcccccgcccagctcccccgaggacccctttgtcctctccctgaccctggaccccctgcaaaagtaggtccctggtctcagccccagcgtggctgctcctgggaggcctagagcccctgtccgctggcattgggtgagggccctactgtgcccacagctgctccacagcctcccccaccaggtgctgactgagcagcagcaggaacaggccgcacacaacaacttcaacttcgaccacccagatgcctttgacttcgacctcatcatttccaccctcaagaagctgaagcaggggaagagtgtcaaggtgcccatttatgacttcaccacgcacagccggaagaaggactgggtaggccagggccctgcagagggggcctcggggggctgcaggcacatgagccaggctccgcaactcctgggtttcttcacagaaaacactgtatggtgcaaacgtcatcatctttgagggcatcatggcctttgctgacaagacactgttggaggtaagcacccgccgggaatacccaccccgctggtatctcagccctggccgccctgtccatgaggtgtgcgtcctcctgccctgtccccaaggcctccacactgtataggcctaggccagccactccctaccccaaccccaaccccaggcatgccacagctgggtccatctgccggccccaaaaggcagagcgtggctgcctgaggcagtggttcctctccaccggctgaggcctgtgcgcatacctggagtgtccttggcgttctcgtcccttgccgtggtcctgacggacaggtgaggacccagggctggtgtgtttgagagattttgctgtagctcaagggggccttcaggacacagctgagtgtgactcaggttggcctgatcccagggcccaggtcctgccccttgtacaggcccagaggactccatcatccggcacatagcagcccccagcctccacaaggcctcttcacgggccaactactgtgtgctgagcatggggacagaccctaaactcgccacgtcccccattccccagtgtgttggtgcaagttaccccaagcaaagtaaggagatcacatgtgcccagccccattcctgcctgattccttagccagccaccatgccatgcctcttcacctaagcccctgacgggcagcaccgcatccccagacacccccacctccccactccttcccacctgccagggtgccctggggaagtggctcgggccaggcccacggaccaggtgcagacacccccacctccccactcctccccacctgccagggtgccctggggaagtggctctggccaggcccacggaccaggcggcctcagtgcaggggctggtcccagtgtctccatgcccactgctggcatctggccactcactggcccgctgtctccaccagctcctggacatgaagatctttgtggacacagactccgacatccgcctggtacggcggctgcgccgggacatcagtgagcgcggccgggacatcgagggtgtcatcaagcagtacaacaagtttgtcaagccctccttcgaccagtacatccagcccaccatgcgcctggcagacatcgtggtccccagaggtgagcctgctgggctgcctgttgggtgggtgtcgggcaggccaacggcccagcccccggtcacccgcccccccatcccgccccagggagcggcaacacggtggccatcgacctgattgtgcagcacgtgcacagccagctggaggaggtgagcggggtcccacgtccccacggcctagcccccagcccctctacccacttctccgctgccaccacccccagtggcctggtcacctcatccccctgcgttcactgtcccctgccaggtgccagccctgagtgtcctgagcctgcttggccagtcagattgtccagcccagaccccatcccgttgtgctgtgcagggcctgggttccctgaggaagctggggtgggggtacaggtgctcaggacccagccgagggtgcagcccgctcagcacacccagcctgagcttttgggaagacaggcatgacctgctggcccaggattgtggggtttcactgctgagtcccacgccaggccaggctcctctctttctcagggggtcaccccaggagcgacacccccaccagaggtcccctgctccctgaggcattctatggctgggccttggagcctgagtggctctgaacacactccctaccaggatgttgaaggcctgaggcctgcagaacagagcccagggtcctggctctgattgccccaacgcagaactgcaggtctggcccaggtggtccccaggttacaggcattagaagcttgccaccccccatggctggctgtgtccccgcgggcctgcagcatgtccattcctgggtgggggtggcctggccgcctgccctggtcactgacgcgccaccgttcccttgtgtcttcctgtgttgctgccacagcgtgaactcagcgtcaggtaagacttgcacagctgtctgcacagatggaggcacttccaacacctccaaggagctctggggtctgggctgtgatccagccaggcagctggctcttccccagtcacagaaggggtggtgtggagtggtcccagccctgcttctgcctccccttgctggcagatgaggacactgaggcacagagacgtgaagtagcttgcccagcgtcacggagtcctgaccctgtcctggccagactttgctggaggctcccctgactcctgagtctgtctatgggatttgaccccagagagcacagctgtcctcctgagccagcactgccaggcctctggggcagtgactacagacatgtcccagcagccagggagcctgctgtacctcctgtgcccagcctcacggaccagtcagctttccctggttgcaggtggagggcctcgcgcctgtcctcccacccacccgggtcctgcttgccccagctctgtcctcgcagcccgcacagctctgccagcaggaactgggcaactgcagcaagaagcttgggctgggccggggccgcatcccactgtccctccccaagggcaggcatgcaggggggtcagccacaagggacctgcccttctccctgccttctgtgggttgggaggctcctgactgagccacctggagggagagccctcacattcagagccctccaaagagtttgccaaatgttggaaatgcctccagggcccgtccaccagccgtccagcttccggtgcctgcatgagtctccgcttggccctctcctcggcctaggaacccgcaggtcttgtcccgtcaggttcctcctgaagcttttgttctgagaggaaaaactttccagggtttcaaacttggaaaaacacctgaacgcagccagacacattttccgtcgtctggtcagccaaggaagtgttggcctgtggctgcactcacttccttcagccccaggaagccttggtcgggggcaggagggagggtcaggcagggctgggggcctgaccgcccacactcctcctcaggcctgcggggaacgccctgctccccaactaagcagccttctctttgttctcttccttctctctgtaaacccccgtttcctgccttgttccctccctgaacatgctcttcacctggcaagcagaggaagctacgttgggatatgtgagcagtgtgctccgtggtgctgctgtgtgacccgccttcccgtagccccttgccccgctgctcccgctaggccctctttcctgctcctgccccgcccctttccctgccgctgtcacgcctcttttctgccctgccacaccccatttccggccccgcccctttccctgccgctgtcacgcctcttttctgccctgccacaccccattcccggccccgcccctttccctgccgctgtcacgcctcttttctgccctgccacaccccattcccggccccgcccctttccctgccgctgtcacgcctcttttctgccctgccacaccccattcccggccccgcccctttccctgccgctgtcacgcctcttttctgccctgccacaccccattcccggccccgcccctttccctgccgctgtcacgcctcttttctgccctgccacaccccattcccggccccgcccctttccctgccgctgtcacgcctcttttctgccctgccacacccaattccgtgccctgcctctttccttcccctgccacacccaattctgtggcctgtcgctttcctcttcctgcccctgcatcaccccctttcctgccccgccccattccctgcccctgtcatgcccctttccggctttgcctcctccctgtcccacctctttcttgcctccaccccgcccttttcctgcccgctcctagacctgctgctgccccggccatccccaggcttgggcagcggggcgggacgggacagccaagagacactgagccagctttgccccccacccccctctcttgaggggccgcgcaccacctcggggaggagccagggcggggcctgaccccacaaagctttagttcccccggggagaggctggggacaagctacccattctggggtatgacacctatcagcacgtgtgagcccgccctgtgcccggcccacttctgcttcctcttagcgcaggaggggtcccgcactgggaggggccctcacagcctaccccgctagctttctgcctgatggtgagcttgccccgttgttcgccgccatctttcgcctttgcctgacagctcaggtagggcgacgtctccccccagctcagccccaggcagaagtcaggcccgctctgcacctcgtgctgtgcctggcccgtgtgttcccctcacagtgacgcacagccgtcctgtggggagggagggctctgggaaaagacccccttcttgagtgttccccatcggtttgtccccagggctgcgctggcctcggcacaccagtgccacccgctgccccggacgctgagcgtcctgaagagcacgccgcaggtacggggcatgcacaccatcatcaggtgagggcccacctggggacggggcggccccgggcgcgtgctcccgctcaactgttggccccacagggacaaggagaccagtcgcgacgagttcatcttctactccaagagactgatgcggctgctcatcgagcacgcgctctccttcctgccctttcaggttcgtagcccgtagcccgcgaggtggagggtgggtcttggagccggtgcgagctccctgcgctcaccggagtcctcaccctgcaccccacaggactgcgtcgtacagaccccgcaggggcaggactatgcgggcaagtgctatgcggggaagcaggtacctgcctgggcacacctgggcgcgggacaggctgctggggcgggatgtgggcgcttagcctcccctccccgcagatcaccggtgtgtccattctgcgcgccggtgaaaccatggagcccgcgctgcgcgctgtgtgcaaagacgtgcgcatcggcaccatcctcatccagaccaaccagcttaccggggagcccgaggtgcctgggggcagccggggtgatgagcccgggggtagggggcagagggagctcacagcaaggggacgcagggagccccacctgcagcctgacccctgctgcccgcagctccactacctgaggctgcccaaggacatcagcgatgaccacgtgatcctcatggactgcaccgtgtccacgggcgcggcggccatgatggcagtgcgcgtgctcctggtgagtgagccctgggtaggcggggcaggttcaggcagaggtgggatttacctgcccaatacactcggtaggaccacgacgtgcctgaggacaagatctttttgctgtcgctgctcatggcagagatgggcgtgcactcagtggcctatgcatttccgcgagtgagaatcatcaccacggcggtggacaagcgggtcaatgaccttttccgcatcatcccaggcattggtgaggctgcccgggcccttcagccgcacatgagggcagggtgggtggccctgggaggccccaccacactggacccccccccccctttttccagggaactttggcgaccgctactttgggacagacgcggtccccgatggcagtgacgaggaggaagtggcctacacgggttagctgcccagtgagccatcccgtccccaccaccctcctcctgcctcctgacccaggactgctgaatacaaagatgttaatttttaaaatgttactagtataatttattctatgcattttataaaataaataaagctttag

SEQ ID NO: 38394 - DNA, 1662 bp, Homo sapiens
aacctcacgaggccttacgtgcctagagcggttcctctccgtggcgccctaccgccttcggcgcgaaggtggctggtgcgtaccgtcccgaaccctaggagccgaggtgagcgccgcgaagacccccgacattaagaagtggtgtccaccgcagcccccttaagccggataccctcccccaccccgaggagcaagcctgccttccgccacgcgccgcccgtcttccgcgcccgcgcagaacctcgcggctgtgcccgcctaaagccacgcccatcctctcttggccacgccctcagagactcctcccctgtcgcccagatcccacccgcaggaccccaaaacccaatgatcctgcagcagcccttgcagcgaggcccccagggaggggcccagcgcctcccgcgggccgccttgggggtgacttggggcctggacgccaggtgcgtgtaggggaccagggtgggcctgaccaagggccgcaggagctttggctgggtgctcaggactggtctgcaggatgaatacggggtggggcgaatcggcggggcttaggcgtgagctgagatgggactggggctgcggctgagggtcgagacttccgaggtaccctgctggatggtccaggagagcggggaccggcaccagctgagacaggaatgggcttggggctcctggctgatgctgcaggcttaggcgggcagatccttgggaaggggccaagagggtggggtgcaccaggctctctttttttcccagctcccctctccgaggagctgtgcccatgagcaccaagcggcgcctggaggaggagcagtgagtttgggggcagggagggactcccaacaagatctctgtcacctctggtccccaacaggctgcctcctgtgtcagtatcccagcctgcctctctgccatctctccccagggagcctctgcgcaagcagtttctgtctgaggagaacatggccacccacttctctcaactcagcctgcacaatgaccacccctactgcagcccccccatgaccttctccccagccctgcccccactcaggtaggttcctccactggccaggccttctgcagaatcacaggcggtcctcacagctgacctcaggccctgcctcatcgtgccatttttagctctagctgacctctgggttgtttcccatcttggctctttggaaagtgctgggaacccaggagcccctggggacctggacctggtgggaggtgctcagctaggccagcctcagctccatgccctgacagtcatttcctcttctaggagcccttgctctgagctgcttctctggcgctatcctggcagcctcatccctgaggccctccgtctgctgaggctgggggacacccccagtcccccctaccctgcaaccccagctggggacataatggagctctgagtgctggtggacagtgcccctcccaccttccttcttccccacaacagaagagaccagcgactcccgcaaagggacaaggttcctccctctcctgcagagtaggcatctgggcaccaagaccttccctcaacagaggacactgagcccaacggagttctgggatgggaggggtgggagcatgggaagggaggcatcccacccccaagaagaactgaataaagattgctgagcaaaggaa

SEQ ID NO: 38395 - DNA, 9311 bp, Homo sapiens
actttttcactgagtcagaccgttgaacaccgtggacacactgtcttgcgtttccgaatatttcctagaatacggacgtttcctaagactcacgataaagattttctgatcgtctctccaaaaccttgccaccaatttgcactcccacgaatcctgttaccgtgactatctcgccatgccctccctagcactgagcgtgatctctagtatcattttccatcgttgctaatttgaacatgagcagatggagtcctattatttggggtcattaatttcgtagcaagtgcagttgaaggtgttttgcatgttcattgtgcagtgcgcgccgtagtctgcacagtttggccggcaggtgggatgaagggcggggctggcggagcgcgcccgccgcctggtaggccagttcggagcggagccaacgctatcccgggccccacggccagggggcgctgcggcccccccaatcccccgccccgtccgggctggggcggaggagcgggcggggaccaaaggttggtgtctttgcgctcggaccttcgccagaggggccgggacatcatgacggtgggagccaggctccgaagcaaggcggagagcagcctcctgcgccgcgggccccgagggcgagggcgaaccgagggggacgaggaggcggccgccatcctggagcacctggagtacgcggacgaggcggaggcggcggccgagagcgggacgagcgcggcggacgagcggggcccggggacccggggcgcgcggagggtgcacttcgccctcctgcccgagcgctacgagccactggaggagccggcgccgagcgagcagcccaggaagaggtaccggaggaagctgaagaagtacggcaaggtaggggccctgcgccaccactgcccggggggcgcgggtgtggtgtcccgcgggggagcgggagccgggtccttaccatcgactcacccagtttctccgggctgcacctgcgacccctccgcccccgctcccattccctcgccggagggaagccgcgagttgcgagtcgtgatagaaacttaaatcgggggttgcgctgggtggtccctgctgtgcctgctattgcgctcctggcttcttaagaacattctcaaggggctcctaccgcggtggtttttatgtaagatcaggaatcagtttcctgattacagatgggaatactgaagcgttagcgcggcaggtgacttggagaaggtggcccagttggaaagaaagaaattgcaacccagtgtatttgttttccagtaacatcccctccaggatatcccactagttgagaaatgtttgggttactctcccaaatattcccaaggttatttcccgagcctgggagcgcaacaaatacataaataggcgctcgttgaatttttctcgtctagccaactatcagtgtactctggggccttcaaaacattctgccgtttgtctcggggagatggggttaggaagaatgaatatgggagaaaatgacagtttccttcgcggaaatcaaagcgcagatgcagttcccaggtgtctctgcatggaaacagtcgaagctgctgccggaagctctgctggcctggacaaggccacccagaataaagtcacagaagttactgtgtcctggccaaaggccacgggccccatctgatttattgtctatttatctgtgttgcccaatgccgtcttacacctgaagccattcagtctccatgcctgggagcttaggtttatcatcctctttaaaggtatgtcagcagcttctggagcagaatacaggcaggggtaaaactataaagttgggtctttcaggcttagagccctgctaggacgattcatctctgctttgggtcccagttgagcacaaagaagccatcatgtccctctccattggtgaactgatactgcagaaacctcagctcaaggactaggacttgaagatattttgggggcactcattatgcgtcaggcattgtgctgagcagtagagatgcgaaaatgaatacagtgcagccctgccctagagaagggcacagcctcccagggagacactgacatagctggctccccccgcccccgggggggcttcagggcacagagctcaggcagttcactcctcagcggtgagcttgtaaactcagggaagttttcaaatcacggtgacatgaaaactgggcacagaaggatgagttaagatttcaccagataacagtgaagtggtatgaagtaggcacacttcatccccactagaacggctactccaaaaaatgtccaaacaaaccgaataacaaatgttggcgagaatgtagagaaattggaaccattgtacattgctggtgggaatgtaaaatgggacagctgctgtggaaaacaatttgggagttccttaaaaagttcagtgtagacttattctgtgatctagcagttccactcctagggatgtaaccaaagaattgaaaacaggtactcaaatcaatgtttatatacacattttaatggaattattatttacaatagtcaaaaggtggaaacaacccaaatgtccctaaatggatgaatgcataaacaagtgtgttatatacatacaatggaatagtattcagccataaaaggaaggaaatgtactaatccatgctacaatatgatgaacctctaaaaatattatgctaagtgaagtaaacaagacccgcaagatcacatattgtgcgtatgattccatttgtatggaatgcttaggataggtcaacccatggagatggaacacagattggtggttgccagggactgcgggaaagaggaatggagcccatctgcttaatgggtaatgtgttttttcctggggatgatgaaaatgttttggaactagatagaagtggtggttgcacaacaatgtaaatgtactaaatgccaccgggctgtacgcactttaaaatggtgaattttatgttatgtgaattttgccttaactaaaacaaacaaaaaaaacaagatttcagtggatagagaagtggtgtcatctcaggtagaggggccatcacaagcccagctgtgggcatgaaagctctagagtgttgcacgctagttcaatggacccaggaggccaggtgagaggatgtcgtcaggttagggttggatctctcctttctgcccttcaaaagtgacttcagcttctactttcttggagccacctgagagggtcaccaggctcaaacatggagatataaagcaggtgacccctctttgttccccgagaccccagctcccctctgagagagtagttgggtagaaagctctactcagatcaaagaattccaaatgcactctcttaaatgacactgaaatagtggttgagagatattttatgtttctttgcatttcatttctcaaatctgtgtttttaacagtgttccagttaatgaactattttagtagattttttttccctaaattacaaagtgacaagtagcttttaaagtataacaggctgagcaaaatggatgtacaaataccaaaaatgtcacgtttaatgcaggcgattgtcattctgatcttgtttataatggatcactcttgattgttaagcttgttcccagagaatatgtttttcttttgttgtttcaaacatgtaagtaaaattcccccagtgattcttatcacacatttaaagaactgtatctcttagcaacatcacatacccacacatgcgcatgccccagcccagtgtctctttgagacatcaacagggtaatgtccaggaaagcagtgtctagagaagacacagacattacttggttcttgcaaagctcctcatttagcgggagaggtaccaaaggaaacactcagcctctttctacatgctcaggatacagtaatgagcacaacagagtccctgccctccttctgttactgtgagggaccctgtaatttaaactattgaaagctcagctgggtgtggtggctcacacatgtaatcccagcactttgggaggctgaggcgggtggatcacctgaggtcaggagctggaaaccagactgacgaacatggtgaaccctgtctctactaaaaatacaaaaagattagcctggcgcggtggtgcatgcctataatcccagctacttgggaggctgcagcaggagaatcgcttgaacctgggaggtggaggttgcagtgagctgagatcgcgccattgcactccagactgggcaacaagagcaaaacgcggtctcaaaaaaaaaaaaaaaaaaaaaagctcaagtaagccagaagtcataggaaattatagtcttaagaaactttcccaaacagacaacaaaaatattgggtttatctatcaccaccacaaacctaaattgctatgtaatcaaaagaagcagatgttatttagcagtaataatagctgacattggggggcacttatactgcctgcagtttgtgccaggccctgttctcagtgctttgcttacatgatctcatttactcctcttaacaacccaatgaggtggttactaaatattcccattgtataggtgaggaaaccgaggccatgggaaattaagtaagtgatagagttggaattcaagcccagggcatgagtggttaactagaagcttacatattgcctttatttaaaaagggaaacatagtatgggggttaaggtcataggccctgaagtgagatttctttgggattgaacttcagctctgcccctaaccagatatatacatgtggacagatgtaatctctctgtgctttgaatgattgaagtctgatagacaaaggccaccagggacatgccagtagccaatccacgttaggtttatgtgcttagggctacaagggagagtgcatgccagaggaattgtggggtcttcaaaaagtggagatctcaagtaacgaattgaatatttgagtctgaactaaagagttcttcaaatctaggagatacttgtagtcattagaaatggatgagaccatctaaggagagactgtagggaaagaaagagagaaggaaagacccaggactgagtattgaacaacaccaacattttaaagtctggtagaagggataatttagcaaagaaagctgaggaggagctccctatttaggtaggggagaactaagaatatggagtcaaagacgccacatgattatttcataaagtatgtcaaaagctgctgagaggtcagggagagaaagacagaaaagcgtccactgggtcaggcagcatgggggttgtagatggccatgaccagacagtccctcatgggttggggtaggagccggagtcagagggaataagaagcgcagacatggaggcagtatatgtggttggctcttttggctggcttggcacgatggagggcagagactggggcaggatatggagtcacggtgatacccgagcatgtatgtaagctaatgggatccaatggagaggaagcgaatgatggaggtggtgaagggaaagccaagatcaaggtgggagaaggcactgacaccaagtatcaagggaatggcttgggggaagaagaccactttctccaccgtaacacaggcaatgcgggagaagccaggggcagccacaggcagggctgttgagagtggtggaaggtgaacgtgttccctgacgatgtctgggttttttttttttttttttttttctgtgaaaggtgaagtgggatcatctcatgaaggtatggagacttgggtgtgttcgtgtgtgttgcaagtggggaggcttaagaagggaaaaggtatgaggcagtacccgggggagagagaaattcatcctactggacagatgtggaggtttgtcaggtggtgttggaagtcaaggtgagatatgtgattgtgatcaggaattttaagttaaaccagtctgagtggttatggtaatatggaaaagtcaaaggactgagagacaaggtatgtggcctaaggcacaggttatctgcatggacattgatatcaccaagagtgatgacagaagttgaggtacggaggggaagaccatgggcagccgtgcaataaatgtttggtggtggtggtggtaatttttctgttgcaatcacatttgagtcctttagatgtcccctgtctagcacctgacattccctgaatgtcccctacccagccttgtagaaaaggaagaggaggagtggttaccaagaaagcattgcccaagcctgaccatcagggagcttataatggtattggaaatgctggacttacatagatatagcaattagaaaatggcagaagactacaaaaggacagatgtgtgggtcagacagaaatatgccattgaggtagaaggaggagaagatgggctttcagataaggtgaaggaaggaaaacttaacccagccttctgacggtccagtaatttttagctggaacagagaagaggagtgatctttggtttaaaaaacaaaataaaactgctttagttttagaattagcagccttactgctgtttccaagaaggtctttgaattatctggaaataagctgtgcttgaaagcactttgcaaggtgatgatgtctgctgtgagccgctacatattcttaggctggaggtgggcaccttccaccagagatgtgggaatgtggtaacttgctgatttgtcacaagagaatcaggaaaaatgatctttatatatgtcgccgtgactcattttttttcatgaaagatggcagaattaaaaagttgcctaccctaatcctttgcttttctcttttattcctaacactagaatgtcgggaaggtcatcatcaaaggatgccgctacgtggtcatcggcctgcaaggcttcgctgcagcctactccgccccgtttgcggtagccaccagcgtggtatccttcgtgcgctaatgggagctgctgtggcaggtgcccccagagtgaacgggagcccctgctgtgggaactttgtgaatcctggagcatctcagacttgaacacacagcatatttggaagagaaaacatgcctttctttgttgaatcacattagtatgatgagtgagtcatccctgcccatctgctgagcttctcacatctctcagtcacacgtggacccagtggtcaatcctgcagagaattcggcggaggttaggtttgggagtggagctagcgtgctaaagccagagccttcacgtgaaggtggcaggcactggggcggaagccaacactcaacagatgcaagcagtgtgggtgtgcagcagaacagtgatcttgggggaggaagaggatgttactagagtcagatgatttgctgtattctcctgaaaggtcgtaggctgacaggcgctcacattccttggctgcctcggttctgagggcagctaaggagctgtttattcctcaagtcatgctccccgatctccttcctctaccactctgtcaccaggagtttaattacaggcttgaggagaagaaaggaagaaaagatatcttgatgctttgaaaactgtgttggcagtgtggcatgactgtttaaagtagataaaaccttgtcattttaccccatccctgcatgactgtgaagctggcgaggaaggaggaagaagggcaagttcagatgcaggctgggtggctgggacaggttggctaagggactactctggagggctcttctgcctggcattgcccacttcggcccagccacgtgtttgcagcgaccagagtccctgcaaaggtgtggctggctgtggtcagggtgctactagcaccatcagcgcactcccgccattggctcagctcctctctgccagtccaactaagagtgctttgtcctgggtgggacataggggctgagagagatggggggagacataacacccaggaatgaaaatacagatttagagaaggaaccagtaagtaggagacagatgtgaaggaaatggaaatgaggcaagaggacattggaagagagaagtttgctgtccaggagccaggtctggagcatcagtgtgagggagttcaggtaggctgggcctgtgcctctaggtagggacaagggaggctgggtagccagggctggtgcttaaaacccctgaggccatgagctcattggctgcctttgtagcatcctgtcttcttctgtgctgcctggtttgatctcatctcacctggattcaaagggtaaggtgggcatgggtcttgggcctgacacccaccaaggatgacctgtggactgccatcggatgctgaacagggagatgaaaggaggtcctcttaccatacccctctgccaaccccccagtaggccactgttctgactttgtttccagaatatccagaaatccaaaggggctgttgctgaacagtctgcaggaccagtgacagcacctacctgttgtcccaaggcatacaaaggaggcctcaacgctcatgcttctctaatcaagccctaccaagacagacagaaagacagacagaaaaaaggaaggggtagaggagaaggttgaagctgtggagctagactctgcttcacttcctgaagcttcaacttcatgtcgaagattcactgggacccaattcctgcattgttaatatttgtgaggaaaagtgaaacaagtgatctggttttagcccagatgatgaaagtggatatggcacattttcacacacgtgagataattacagcttgccccacaacactgggtgttggagaaagggagagatagtcataagtggaagaaaaagccaagcatagtgagtgggaaagagagtgagagcctgtgcaggctgctgacgagccccaggcagcccacaagtttctcgtggggagatggaggcagagcccagggtaggggacagagctgctggggcctttccttgcctgggaatctgtcccaggaagagcttccccactcccatcccccaaattggaaaaaccgtacattcaagcctgtttggccctgaaattcttaagaatctggttaagaattaactcactaatgtcaaaagtcaaaacctcctaggggttgtcctgggagtcaggttcacgggtacagaagatgaatctcagatgtcactcaacctgagccgtcattctctgtggcagggctgccctgggtttctcttactcaatccctggagtgtaagcatttggattgtgtcacagattacctttttaccttttctttctttttttttctttttttcaatatcagtgcccacaccttactgagtattgagttttagagctttcgcttgatgtgcttgaccaagagacttcttttgtatccttttcttgtcctatgatgtaaataaaagcctcgatttatgtaatg

SEQ ID NO: 38396 - DNA, 33090 bp, Homo sapiens
gtaaccgaaccctgagccgcctgcgcggatcggcgtccgcagcgggcggctgctgaggtgagggccgggccagaggagaggcatacccactggggcgtaggtctgggactccccctgtccgccctggcgcgacctcaggactctccgtgtcccctccgtgacccccgcggcccgggccgctctttgcatcttgtcttgcccacagctggcctcggccaggtccgagggcctggatgcgaccttggggcagcccctactcttccgggcagcccacttccgcggccaccggtgcagggcatgccccggggccgtggaggtgagggaaagaggcgcgagtcgcgttttaactccgcccccgtcccccaaggccgcgcctcgcagcctgggctgcaaactttagcgtcctttaagttacagacgtgcgtggggctccgtgaggaggtgggcgaagagaaaggctctgagtaaataggcaaggcccggggtgagcaggggctggaatccgaaagtgggaggcggcggccccccaccctccatagtccttccgccctctgctagcaccgaagtttagcccaggacgggggccgtttaagggcccggccctccgccgccgcgcacgtgagcggcaccaggaagctggctgggcgcagccttccctgaggctcgctggcaccggccgcacgcgtccatcccgggcctctgagcggagggggagccgaggctagagggagggcgcagtctgcccaaggtcagcggcagcggcagtttctgggcgccaagtgtgattggagtactccaggaagaggggcgtgaccagagctctagcgaagagacctgacattgtaaagctaggtttggcttctgatttccacagggggtttgagaatgggacgagggtgctttagagggaccggtaggctttccctgaggacggtaatcagggcatgatggttggctcagtggttatttcctgggcaggggtgactgttctttcagctcccagcactggagcgctcggcccctgccgcactggatgccagcagttactaaaagtgagcctggcatttcaggtgagctcccagaccttcttccttttctcttgaatataggggaaattcacgttacctctccacgtgccgaccaaggctctgagacccccaggtgggttttcttcccccccgccgttttctgagcagtttgggaagtgagaggaagagaaaggtagatactaagtttccttgaggagacaggaagtgttcagctgagatggcagatcagggtgagggcttgtcattcccaaggcaagtgggggcctagatgctgagagttttccagctttgggctcagagatgtccaacaaggatttaatgcttcaggcgttttggaagccagtcaccagagaggagagagaaagtggaaatgaggggctggaatcagactgtctgggcttgtgttgcctgcattttggtccacgtggctctgtttaatacctgtgttaccttgggcaagtctcttaacctctaactacttgaacctttagccttacctacctctttggattgctttgagggtgaatgaagtagctgtgtttcaacatttagacagtgcctggcgtatagtaagcattcagtggaagatttctcatcattatcaaagaaaattggaatgaaagttactggagacaagatgagtaggacaggcagaaaagagagagatactgatgggtagaagcacagatgggtgagactagtgggcaacacctcaatttcttgacaccgaaagtttagaaatttactttgcctctttgtgagcaaatactgtgtgctcattgactccaaagacaatttttttttagcgtaaaatcaacacccagcacccacagggaagaaataattccacagagctaagtattccacaaagttgcagcgtggcctttttagcttcaaaaccttttaaatgttaaatattacttttaaataattggggtgggaatgtccccccagtgggtcacatggctcccttcctctttaaacagtcttctctgggctgtgatttttcccccccgccaggcaactcaggtcaagccctctgtgtaagagggttaggcctctggccccaagctgcctggagaactaggcagcctgccttgaatagctcacagactggcctctgtgttatgttcctgggactgctcttgaacagcttcttttcctcttagggataattgttacttcctcctgctgtgcgactccccttttagcagccttttcctcttactactcactgtttcttctgtgggctggaaaattgggatgaagcttgttaacattggtggttcaagtctgggaagcttagtgttggactttgttctgcctgctcaggccgctttgctctggtctttcctctggttctggatgggtaagcttgctggatagcaaggtccctgcaggccagatgtacttagaaaaggagagtttcttatgaaattctcttcctgaggcacatttttcctcacaagtttttgttccttatggtttccctgtcgttagtaagtgtttggaccctagcatttgccagtcctccctctggcagtcgtccctgaggcttggggaggctgggctggtggcgtggctcagctgtggggaggaagaggtaatgtggaggaaaggcaggctggctggtatctggtacatcttcggggagacttgtcagggcccggagtatgtctctggctgaatcactcctgtgcccctctgtgactcagtttccccaggtgtgaccagggctgccagctgacagtttgagctgctctgagatcctcaccaactgcgattaagaaataaagaggcttgtggcttcagtcatccttgtagctcccttccaggtcactctgtgtgtaaacacctctggcccctcccctttctgggtcagagcacccaaggcaggtctgaggaggttgggccagaactggttggcgggcaagtgggcacattgtcagagtaggctaccagcctcctctcccttctttctcctttgcagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtaaggagtctccatggggttctgccccatggatgggcctggtgggccagggcttctttggggagggtagttttggttgctgaggaaagggtgggagaatcttcaagctggccctgcagacccctcctctatgagcttgaagcaccttccagatttagcctggacttctgctcccggcatccatttgtgggctttctatttgcccaggtctggttccccttgcccatggctacttgtggatttccaaatgcagtggactataccaccatgaatccctggcttctgccaggactttggtcccctgcctcctcttcttgtcatccctccttccatctccatttggggccagtgctctaaggccaggccattcagattctgcccactctttggggttacatcttgctgtttctgtgctttccatccctcagctcttctgccatagttgtaggcccttgagggctgagagggcagtccctggggatggggcttggaatcttacctcttcagccattctgatgcccctcaacctggtgatatggcatttccttagacctcaagctggtgctgggagatggccaagggggctagtggagccagatgagttacttagaatgttcagaatgctgaagtcaaaaactaatccagcatcactagcaccctgtgagcgtctggctgttcttacaacctatggtgagtcagagcttgctaatgtaacctactgctatgctatggggtggtgctgcccacagctggatgggctggcagctctgtcaagggttcttcagcctctactactaagccatgccaaaccaagcatttggaatccccagctctgatttccttgcctggagagctcaagtgcacaagtcctgcagtctacccaatgtgtgctgaccggcttactggggcactagttgaaacaggatgtactggttccctctctgtgccaggttctactctacacctacactctggagatgaatcagacctggctctgccctcaggaagctctgtgtggctgacatgtcagccccacataagtgattctccaacaagacactgtgcttgatgtccacagaactttgagctgtaggttcagggaggctgccatgagtctgctggggaggctcagagaaggggtagatttcagctgggccttctcatgtaagtagaattttgctttgttgggaaggggtacttggctaagaaaactgtgacagcaagagcctgaagacatgggatgaccagagaattgtggttagtagacatgtcttgggtggagaaaggtggaagggtttgcccagccaggtggtggggaagtacagcaggttgagaagaaggatgtggcacaatttgccacctttgttttaggaagttagctgaagggcaggtggaggagggaaggagatgaggcaggaggccgtagaagagattgggctgggtccaggtgagaggcgacatgggttggttgaggttttgcagtcacatggccaggagatggcactaactgaagttgggagcactggagcctgagtgggatgggacagacagtgggctatggggagctcctagagcagatgtgtgaccctcaccccttcaagggctccgttgtgtaaggccctgcccccccttccacacctggcccagtcagagccttctgcaagaagagtccttgcagctggctgtcttctcattggcgtgtctgcctgttctggaatcaacaggttgcctcttgggttggaggtgctaattcctggatgggaaagggctaaggcagcagggtaccctggggtcagtgctggaggctggtctagggaagagtgagatggaagaagcctggcatgggatattctggcctggccactgcctcctgcagctttcccagagatgtggtggaccccatggggtgggccctgggtctccagggttggttggtcatagtctgactagggtgcttgtctgggggactgtggcctgagagcacagccttgaggctagcagtcccgagttctgattctgtcccatcactgtcctgctgagtgatcttaggcatatcccataatgtttctgagcctctatttccttgtctgcagagtaatgataaaatacctgcttcatagtagactgagaagagttaagtgatataggtgaggcatttaccccagcacttagccctcaacagatgcttaacaacaacaaagatgggtgggaaaaccacttgtgctaacatatgctgagaggtcagactgagcaaacctagacccttggcctggctgtggtcatttgggtggcacagaggatgatgaacaagtcaaggtggcccttctgaccctgcccatcccagtcctgggtcagtccagaagacacctgtgtccccatttagagctaggtcacacttggcacctgggatggctcagggacacttgggtccccatttactcttggagctggtcagtgcattctctgcctgacagagattgtaacaggttcagggaaccatggacccccaggcttcaggtgctcgtggctatcacagactggtccggaaggacctgaggcctcctggtccacactccatattatggagggagaaacagattcagatagtaggagaaaggcactgatctcatatgtttttgttttcatttaacaaatatctgagcacctgctctgtaccaggctctgtgttgggcactagggtaccatggggaccaggacctgccagtgtgtgggtgttaggagcctagaggaaaggccccatcctggtcctggagtgggctgagaaccaaaggtttttgtcccctaggctgcctccaccagcagtgtgcagcgtggcatgctctggttctcagagaaagagaatagaggctgacctgttcagtgtcccacccccactgtgtccttccctagcccagagtgacaggagccagaacctgcttctctgtgagtgtggggaggcagtgaggctgtgtcaggctctgtgagtggggtggtgagtaaccaggtgagaggtgccacctggctttagatgctgcccaccccatgaggtgtgacggacagctccctagccatgcctcgtcctgtcctcagctgggcagggagtaggctggtcccacctaggctgggtgtggacccaggaagtagcacaagaaagggtaccactaagattggacagtggcagttggtgtggacctgttcatagtagctgctgctggagctgttagccttgtgccctggagtcctgtatgggaagaggctgcaggtctgggtgagtggttcttgtgaggcaggaggaaggattccattctccatccctgaaacccttggcatggttgggaatgggaaggtggggaagaagtcttttgggaagtggacagaccctggcaggggctcatgggtgtactcacccacctcagagcccagcattcatggagtgtgggccattcctcttcaaggtatgcaagggatggggtatgagttcagagataaggatcacatgtaggcggatgtcagtcacagatctcccttacacacactggtccatactgcccttgcatgactggggaagggtcctgactagaaaaactgctctgcctttagccctgcttctgcggtgggtgctgggggcttggaaagtgacttcaggctcccttttggggcctggtccctctgggagccttcagtgttggaggggaaggaaggagctgagaggaccctgagtgcctcgcttgatcctggccagctctggcctgtggacaggccctagtggctgggctgctatcactgtgcctgtgggcccatcctgtctgccaggctggctctctacctcctgccccaccctgtgccaccatcacctctgctgctatgtttggggcttaagcaacctgcctgcttgcttatatggggagcctggctggggcaagatgggtgtggcagctagttcaatttatgtggcccaagtgggcctatatttgctgcttacatctactacctaggaggtggtgtttgctccaggcatggagtgggttggggaactggtggtacttgcttctgcctttagtaaacaagactgccattgaagccccctttcccttagtccaatgagaaccaaggcccagggccactaggtctgcaggggcctgtggtcatttggctggcatgaccacagcctcacagaggctggtgagagttctgatgtaggcctgtgtcacactccctcctccctcagtgtgtgtggagagaaggctccctgccctccctggaggcacttagtttgggtggagcctgggaaggggtgagggagtaggatttcccaggactgacctcctcaacaaaggcaatgggaatgtgggctgggatgtttcctgagggctcaggccgccccctatcctggttactccatggttattttctgccaggtggagtccaggcatttgctgtgcagcaggttaactatgtgggacaggtctggaagcacgagctcctctctgcccactagaactgtccttgaggtgaggtgagacgaggtgtgagaggaaggggcttcggatttgcccttctgggtttgaatcaaggctccactgctaaccaatgtgtgactttaggtgagtcacttggcctgtctgagtatgtctcctcatctgtcacatgaggataaaagaatccctacctcagggtttttgttttgtgggggctaattgataatgatatggcccaatacccagttctttaaataggtgggtgtcacacttgacatccagtcctgcctgaggacctcatgccactgggactttgtacttttagggaccctgcctgcctctctggtttagtcccagcctcctgcaggttgtctgggccatgtgaggcggcacagtgcagggaaaagccattgtgcagcccgctttcactagggccaatttccgggactcctggatgcccctgggttgtgtggcgcagctctgaagctggtctgcttgagtttgaatcctgacttcagcactcccttgctgtgtgaccttggctgaatggcttggttgtctgggccttgggaacagggttgaaaacagtaccaaccacagaaggctgtttggatttaatgagcttatgcttggaaggcagagtctggggaaagtggtgagtgcctggtcagatatcagctgtttttaggattctgtttgaaggtgtagggttatagaggaaggttcctgaaaggtttctaagtaaactcacctttgagggctggtatcttgttgactcctttctttcctcccgagcctgaagaatgaggcttgtcctctggcctagctgtctgcatcatctcgtgtcctgactggtgcctgtctccgtgtgcctttgggcataagcttcccagggaagttgggggttggcgtgttgacctgtagcacctaggagggcaaacgaggtcccgtatcaaccacctagtcatgggccagtgcagctcgtctattcccttgggagtacaagtgcaaatgaagggccctgcctctactttcccccttaacttgggtagctctgggtcagtgggctggcatgggaagagtaagggcagccctctgtgcctgggtttgagagatggtgctgctgtccctgtcaggttgtgtaggttgtgggcctggggttggcagtttgtattaaccctgaacccaatgactacatttggtctgggccgctgacaccatttctcattcctgcatcctggaagattatcagtcttgtccagttcccagactcagcgaggtcttggcttggcaggggccccgagatggctgtcttcgctatagcctcacacaatagggtcggcagggcactgtgacaccactcaggaaggggcagtggggccagccttgggactagctcgtacctggaagcctcaggttctaagcagactgccctctcctcccagtaatgggactcaggaggcttttcagcccaaaggagatgctctggggcctggcatgcctctgttgttttcctggtactcttgctttgaggacacatcctggatgggcttgtctttaccccgagtggtggtgggtctggccactgccctgtttcccagatgtggttccttgtaggtactagttctggtccaattcttgttctgggcagaggtacccagagaaatagctgatctggggaggaagaggagcaggcaggtagggctgggaggcccaggcctatgtcctagggttcggcccaaatacagatactcattgagccaaggtggatggggtctcttgcccatcaggacatcccaaccttctgggcacttgacagccttagtaggccttttccctggaggcgggtctgggctttactgggaggccaggaaagctttcctctgccactggatcagccttgccactccctaggttattttagggcctgtcccatttcctccttgctggtgccttgttcagctgcttcccagcttcaactttgcatggggccacttagtgggtggtaggcttgctgagagaccttctaggctcctccttaggccagggcaggggaggaggtaggaagtgttcttacttgtggaattagggagttgcttagccaggaaaggagctgctgtgccccacacacctcctggatcctgggagccctgtcttcttagctcccttcttccactttgacaggagctctgccttttctccaggtggagggagaggaagtttgttatggtgcagggcttgcttgtgtgtgcatgcatgtactgtcactgagcatgcctcaagaactttctgtgtgcgcaggatcctggacctttttgcctagaggcctggagtgatggagagagatggggaggccatcagttacagtgcagcacaacacctgctccctggtgggtacttgggatcagagaggaggggctgcttggtggagagcaacagaaggctttgaaggggaaagttgagctgagtcttgcaggatgggcaggagtttcccagtcagaagggactctggaatagggtgaagaaggacatttcaggcagaggaagtagcttacgcaaaggcaggaagcatgggaggatgtggcatgtttggggagctgcaaatagtttcatgtgggtgtgtgtgggggtgtggcgggtgaggaggctggcaaggcgggctgggccagagcctggatctgtccctccctctgccatgcagacactcagttggtgcctgcccacctgggctctggcccctgctggggcctgaggctgcagaaagggagtgcaaggtgagtgtgtgggcaaattcatgcagtattatgtgggccactccaaaagagccttgcctattggcttgtgaatttagtttcatcctagaggtaaattgggagccattgagaggttctgagcaagatgaccacatgtgttctggtgtcttttggctactgaagaggatgttgagctgggagtcccataaggcctgctgaagcgttcccaggaaagaccctggaactcaaacccaggcaagccagctgtagaaaggaagagaataagtgacctttcatccgtttctccatatgacttatgtagatgtttcttttgcacagcacaggttggtagggtcagggacatgaagataggctttgtggcaggcagtgtctcttggcttgtcagcaggaggcctgccagataacttcctgcctatctggtcattctcaagtcttggcgtgtgagtagggcagttccaccatctagagacaagagatggtattgcagtgatctcctgtgcctctgggtggggtgggaggagcttcaggccaaaagaagtgactgtgtgcaaggtagacttatggagggcaagaaagtttacagcaaaatactgggggagaagagagtgccactgagccacgctgaaaggctcttcaagagggtatttgaaccggaaggacaggcagggaggagctgcatattcagaggtttgggtggtcgggcattctaggccatggacagttgtttggactgtgtcatagctactaataaccacaattatggggcatttgctgaatgctggacccaggctaagctctcgtgaagtttcttgtttaatatggcagttctgtaagtagatattgaggaactggggctcccagaacccaagggacttgtctagaatcacacgactcagattcgcaccgtggcctgcctctctcaagctgtgtttctgaccactacacccggttgcctgctactaaagctctgagccaggtttggatgccgtaggcttcaagggggctgcaaggggaccagagctgcagacagttgagggtgaccgttagggtctgcttagaagtgagagcctggaataggtgcccaagtcccaggcaaactgtgactaaaaggaaggcctgggttggcctgagtagaggaggccattcagggctgagaaacccccaggggatttcagagagggcttggaaagggctgtaatgggagggagaggtgagaacaggtaataatgacttcacagtgctgggaaggagggctggggagaggagtaagtggaggtagagggagaagcctgtttaaacttaggggtcatccctgtgaaggtgaactgctggcaaaaaaaatttttttgcggtgggtagggagaaaggagcctttagagttgagcaaaacccaggattgagggtacaaggtctgtgctgaatctcttggattcaagatcatatgtctctgagggcccagtctgaaggctggtacagacttaggcacctggaaagctgacgtgggaaacaggtagcagtaggtgagacaaagtgaggcctcttgatgccaggaggagaaatgagtactgggccttgcagcattcattcagtcctaggaagtgttggaggctcacataggagccttacatggctgaggtttctgggagccagaggagggaaattaggtagggaggcaagcagagtgggaagtgcaggcactagcaacctacagagatttggaggggaaccagtggtcttggcttttagccaggaagggacttaggaagtgggataggtccctggatgggccatgggttgcagaagaagtctagaggctctggtgatggtagctggccctgccagaggggtggggaggatgatctcttcacagaatttcaccagcaacccagatgtcagtgatcccaatcctatgtcctgacaggtgcttcctgcagcccctcctcagccacttgccaggtcctgaccctgcaagcatgtgtgtaaacacacacacacgtgttcttgctttcctagggcatgaccgtggagggctctgagctctttattaccactcctcagttttgctcccttgcctgccataatttctctgcctgtaaagcctgctcttctccaggagataggagggaaattagctaataggattttgctggacccaggctgcaggatcagccactgtacagttctgctggtggccctggggcgtgggggctgacagagggtcttatggtggggtggaagggccccctcagtggagccatgtggagggtgatggttcagaggtcctctccgcccttccctctcctggcctccagaagggcagagaccaagtctaacccctcactatgatccctgggtttccacagggcatggcatgtttgttgaaggaatagatgagagtcctgtggtacgatgccacaggcaggggccataggtgggttccagtaagaaaatagctagctgtgtcctggtatctggggctgcatggcttgtcagagctgctggttcttttaggcctgatctggcacagtcccaggaggaaggaggtctgagggcctccttcctttggccaactctcacacccatgctttgcttccccaggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggtgaggcacaggcctggggtgtgtgtgttggggacagccaggccccttgggtggagctgaggaggactgcctagaatgggaggaagaagtggttttgggagagcagcaccctggggccctcatggaacaggtacctgtggagctaggaagatgggcagaggttgttggcatctctttcagatgcccaagatcttttggaagccggagcatatcccaagagcatggagaacttgttcataaatctgatctggttagtttggctctggctttgaccaaagacatccatagtgcttatcccacactcctggctcagatgaatggacaggccactttattctcatcctgctggaggcctgcaaagcaaggacctgaggctcccagtgtctgggcaggccccaggtaatcatgtattgcccgtggccctgcctgtgcatgggcttatacatctgctcccagaggccagggctgggacagcagtggcaggctctgtttcctttacttcctgacttggttactggcaatgctggcagcccaaccttcctggaggaaggagagccagtcacctggtcatctgacgggtttctgtgtctacagaaatttttttaaaacttgccctgttacacatccctcctcccctaaacgttttgtaaacttggttgctagggaaatgaccccagtttgggcttggacgtgattgttcattcatttaacttgtatttatagtctgtgtgccaggtgctataatgggcacaatgtgaatgaaacgttggtgcatgaaacagccattcacagtgaggtggtgaagataggtaataaatatcagacaaaaataggacgtgtgctagagaaggagagggtgagaaaagtcagggaaccaacttggacagaatggtcagggacagcctctcagaggagataacctcaaggcagagtcctagaagagcctttagagaggagataagaacttctagtcagagctttggtctaaatgcagcaggaagtcactgcagtgttccaaccaggaaaataacacagttggagccacgtctgtacaagatgagctgtcccatctctgggcagggtgggactggaccacagatctgggaccaggtggagatgcttaggcctggggctaaggaattagcctaggaggctgtcatgaatcccattgtgagtggtggcagcttgggcaggcccagcggctatagagctgtggacaaggatggagatttacaatcacttttgggatagaactgatagactttgggtggattcactgttgtggaaggagaggcagtgagggagtcacagagggctctgctcccctctggcctgggcaggtgggcaagtatgtagtgatgctttcactgacatgtggggaactgagggaggccctggttttggggggaaggtagctatttgggctatgtcaggggagctgcctgagatacatctaagttggggggtgtggagtcagcaatggtatgtgtggcctggagttgaggaaaggctgggctggtggatatatttggggacatcagcctgttggcagtatttgacctgggaggctgccctgtgcctccctgcctctgtgggaccaggtaggcagtggacagcctgtggcagcaaaggctgcgcagagggcgtggccagtgtggcaggggtcagggaacaggacgagagtcagtgggagtgagagcctggtacacttggaggatccttgcaactttgttcaccaaagcagcttggggaaagggacacagcgttgatgatggaaatgggagttcagatgtccctggagtctggtgttggggctgaggaatgaataaatgaggccctgggtcaccagctgtgtccttggcggtcaaagacaggtttgaagaatcaggagtgagaagacctggaaaggggagggctgtcacggtgataaggcaagggcacagggagaatagaggggagtttcctttgtgagctggagggtggtggccaaaaggggtgtggggcaggatgtgcttgcctggctgcggttggactggaggtgggggcgggctggctggtggtgtgggcaggaaggaagataccagtgccctaggcctgcttagtgtgctgcctctggggagtcccgccccatttcattcaaggaaggcctctccagtcctgtcggtgccatcctcaacctcatgggcccatctggaggggcacccctgggaaagagacttcttgggttccagacctcagaacaggacatgtggcatgtggtgtggtggtgagcaactcagccaccaaagccttttcctggcttcaggggtttatttttagacacctttgtccaaatttcccggcccctgacagcttcacaagttgcctggttttgacgtcacctctttgatgaaagcccttcctccttcctccccgctcccatgggagcctgtcagctgtgctcctggagtgggggttgagacaaggaagccagtgatatgggggagagcaaggggcttctcccagagacaggtgtgaggcatgcttgtgtgggcttggccatcagcggggagagtaagatagaggccggctgcccacagaagaggcatggccgaaggtcctgggcttgttttggcagcagggtgtgggggttgcctctgcccctgtgtttagcctgaccttgcgtcttggggaacaaagccaggggagagatgaggaaggggctagctctgtttgctggtcacagcctgcagtggacaggggtggccctgtgcctctctcagcccaggagacagcaaggagagagtataaggctcccttccatccctgccttcatctcccctgccctgaggtcagagaaaggagattactaatgagactagttgcgtctcactcttctagcaccgacagcttttaactgtgtgtgcgtgcgcgtgtgtacacccttctttttctctctggatctgggactgctgtgaaggctcttcaaatggaatgacagcagccgtcagctttctgctttggcaggggtgagagaggccaggagccctgctgccaggagttgcggggggaggacttggcaggctcaccagcctctccagaggctaggtgaggggcaggggtgaatggatcttagcttcgggtttgggaggtggagagcagctgctgtcccgggagttgcagatgtgcctgagcctggaacaggattggtctcatgggacagagggacctgaagttcacggcgagaggcccaaggagaagcacttgtcaggactctcgggattctggaagggatggctgatctcagctttcctggtttgcatggcagcctctggctctctggctagccttccccagcttggcagcctggcaaactgctatagatgctggaactctgcctttctccatataaactgctaagggcccccaggctgaacactcattcccctggaatccatgcgtactgtgtgaccatcactccatatggaagatgcctcagctttgtcaggctgctccgctggagtccaaggaggtggcctctagtacaggaggagaccactccccaagtcccaggaaaggggtatcttctggaagctgcaggatggaacagagcttgcttgaaattgcaaacctgcagaggggagatggggcccagatgtgagcccagagcaatgggcagaggcccccaaattcaccagtcttaatgagtgtccagggaaggcttcggacacatggaacagaccaggactgagggatgggcctgggaattcgatgtgtgggattgtgtgtgtaaggtctctagtgcagtttgctcatatctgtctgtagcacttggtgaggaaggccattgagagtgtttgacacacagccaagcccccatgcctgatttctctcccagacccgtccagaatctttttcaaaagtgcccttccccatggtctctgatttcagggagtttttagggggagggtctttgtaaaatggtttgagcctcctctcccaagtttagggtgttacagggcattgttcatgtagtggctgattggctggggagtgcaggtggccctggaggtcagactaatgtctgactatccaccatcaaattggagaaaagcgtgtaagtaaggaggggtcaccgaatatagtgagcctgtgaggggaaccttggtggccgaattctgggacagctgggttgactgggactgtcttaccaggggcttaaaggggataaggccaggtgtggtggctcatgcctgtaatcccaacactttgggagcctgaggtgggaggatcacttgagcccaggagttccagaccagcctgggcaacataagtgagatcctgcctctaaaaaaaacagaaaaaaaattagccaggcatttgtagtcccagctactcaggaggctgaggtgggaggatcgcttgagcctgggaggtcaaggctgcagtgagccatgattgtgccactgcagtctatcctgggtgacagagtgagactctgtctcaaaaataaataaatagataaatgaagggggcatggtggctcacacctgtaatcccagcactttgggaggctgaggcaggtagattactccagctcaggagtttgagaccagcctggacaacatggtgaaacctcgtctctacagaaaaaaaatacaaaaaaattagctgggcgtggtggcgtgcacctgtggtctcagctactcgggaggctgagacaggagaattgcttgagctcaggagacagaggttgcagtgagccaagatcacgccattgcacattagcttgggtaacaggagtgaaacccatctcaaaaaaataaaagtaaaaacattaaaaaaaaaaaaaaagggaaggaaggaagtaaagtaagaaagtaaggcaaggaccccagaccatagttctcagactgccctggctgtgctgaggtgccctgtggctatcagcctgtggtgggagctgtactcagaccctttcctgcttcacctggagtagttctgcctgtgagttttacaacccaggtgtcttgagcttttgtttggaagggagcttctaaggctcagctggtttgaaaacctctgtcctaagagaggggcaaaactgggcagatgccacctccagtcccgcccactacatgtctgttctcgatcctgaggatgctgtaactgcagtatgagtggagctgggaggcaccagggcccagcccttgtgcaggtagggcaggagctccaaagagaggcacttgtcttgaggggagtgtgactgattggaagctggacctggagggaccctggggagctgcaggttggagttctcctggggtggtggtgactgaactcctgagtggtgggtgatagcattatggggcagccagcttggaactaaggcctgtgggccccagcagattgcctgtggaaatgggtcagcctgttgagcagtggctgtgaggaagctcgaaacagcctggccacagcctgtgttctgtccagtgggcacagaaccgcttgtgtttgcttccctttagtctgcctcagtgaccctgagggagtcagtcggtgggtctgagtccacactggggccaaaacaccagtgcagagcaacaaggcctcggccggggaaatacaggtgaggacgccacgtgtggtggctcacgcctgtaatccccacactttaggaggctgaggtgggtggatcacctaaagtcaggagtttgagaccagcctggccaacacagtgaaaccccatctttactaaaagtacaaaaatcagctgggcttggtggcacacacctctaatctcagctactcaggaggctgaggcacgagaattgcttgaactcgggaggcagaggttgcagtgagctgagatcacgacactgcccagtgagctgagatcacgacactgatctccagcctgggtgacagagcaagactccgtctcaaaaaaaaaaaaaaaaaaagcaggtgagggagccccagcaggaatgtgaaatctgtggtcatttccctcttcctgcctgtcacctttgccaagctaacatgggaagcttccaaactttatttttaacaagggaggccctcttggcatctcagctcagtcacttattcagcagttatttactgaggtctcttgtgtgtgtcattgttctgcgcatggaggaaccagctaggaggcgtcatagagtcctaatcaaagccagcatccccattgttttacagatggggaggctgaggcctagggaaggaaggtgccccaaggtcaagggatggagcggtagctgagtccagactgggtcccttaggccgaggatcgttccgatggctatatgccttttgccactccatcctgtacataagtggggctggaaccaagaggctgagaacttgtcatcaatttgggatatgctcgggatggtgccccagggtgggctttctttccttctttctccaaccctggtagtcacagttggaggctgaggcttcaggtctaggagactgctgggggagccgaggcaaagcacaggaagaggctgtgtacccgcttgcccagcaggcactcattaaggcaggccttgggaactgctctgggcacaggaagcagctgctgcaggcaccttatcgggcctcttgtccacaccctcagtgaggcagaggcggttctattcccaggcttccctccctggatctcaagggctggcttacctgctggtactgccacctgctaagtggcctgctctggcacagggaggagggcacttttggcagcatcaggacctggagctgagtgacaatcctccagcactctttcctcttccacctcctccagccacagagcctagccatgcctgggtgtggggaggggagggatagattcgctgggaaaggcaaaacaacccttgtgcggtggtggcatttgggctgcacctataaggtaggcagtgttccccaggtgggaaggcaggtcaggcagagatactggcttggtggcagtcatggcttgtgtatccagtgaggctggagtacaggagaggagcaagagtttgggcctaagagatataggctgggtcctgcaggcactagggagacactgatggcgtctgagcagatgagtgacagtatccaggctgggcttcagatcaagtctcttcagtacctaggagatggggaggaagagccagaggccacagtcaaattctgcacaaagataatgcaagttagctgaaagtagcagtgacttttcattcccagatgtccccaagccaagaggcgatcctcccaccataccacggcttggcttccccggctccccttagggagctacccttgggtattgaggtgttgggagccaggcctctcccctttgttggcctaggcactggaacctgctccttagcctctctggctttaccccacctccctcccttcccccaggaatgaaagcacaaagccagcctttgctagggcggcgtgggagccaccactctcaaaataccagctcggatattgtagcttggcagccctgcaggaccctgggggctgaagcttgtctggatggtgctgtggggttgggctgtcaccagtccagagggagccttcttccccaggcagatggaatttacttatcaaagaagaattctgttgctcttctccaggaagcttgagattggaattagggaggggaaagagattccaaggagagaatttgcagtgcaccccctctcccccaagcagaacaacttcttcttcagctgagccctcagattaggagaggctagctgtctagttatgcaggtgggaaggaaaggacttcactgaggagtggagcagaggtcagaggtaccagttggagatgagaaattcagggccttctccttctctccctctcttctgtcccctgtctcctctccattcccacttgcccacttgtccttcccctctggcaattcctgactcctctggctctcaggtgcttggcttcccagctccatctgtacgagcagccttcctgctgctggataatcatcagcaaccagtttgtcagcttgtgagcaggacagggctcaaggtccttgactacacagacaagctgctaagaatgctggatcttggagagggggtgggctgtggagcctgcgatggtagagccatcatctggaaggctgtggctctcctcccagatttgcaagggagagcaatgggatcagggctgactcacccagtgctctagctgagctctccttggggtactcactcctgtactccccaaccctctggtctggccacacaacggcccaggcccaagaaggccagagcagggctgaaccagggttgtatcttggccctctgggcctagagaaaggtaaggctgggtatggatgcaggattaggggcctcccagtccatctgggcactaaggtgcttaagagcctgtgtcccatgtgcctgcttagagggaaacattgtttccccacccctcaataccccaggctgccctgtgcttgactgctgcctaggccctcctccacaggacaccgaggaagccagggcctgcgtcgtgccagggagatgaatagaggtgtaaattgtgtggtgagctgccggctctgaggtgaaaatgaaaagtcttcaggcagtggcggcagcaggcgcagcaggctggggtgccaggcacagcacaccgtctcccgccccattctctctcacaccttcccactcctgcagtcttccccaggttcccacccaggcctggacctgcctccctggctcctctgccattccctgcctttcagccggtggctcccaggctggccctgggctcgacctaaccccaagagggccattatatctcgtttccattatgtttttttttttttttttttttgagacagagtctcattctgtcacacaggctggagtgcggtggcacgatcgcggctcactgcaacctctgcctcccggattcaagcaattcttctgcctcagcctcccaagtagctgggactacaagcatccgacaccacgcccagctaatttttgtatttttagtagagatggggtttcaccatgtcagccaggctggtctcgaactcctgaccccaggtgatctgcccaccttggcctcccaaagtgctgggatgacaggcgtgagccaccactcccggcctccattatgttttctacttggctgatctgttgcacagaaaaatgggctgtgcttgagttacctttgtgacttaatgtttgtggtagtccctccattgattctttttgggttttctgagtatagttttcttaccgtcacataatggtgtttttattcatcctttccagttcctcacttcttttgagatcatctattctaatccctttctttccttccttccttccttccttccttccttccttccttccttccttccttccttccttcctcccttcccttcccttcccttccccttccttccgtccgtccttccttccttccttccttccttccttccttccttccttccttccttccttccttctttccttctttcttgttttgctctgttgcccgggctggagtgcagtggcgcgatctcggctcactgcacctccatctcccgcattcaagcaattctcctgcctcagcctcccgggtagctgggattacatgcacctgtcaccacacctggttaatttttgtatttgtagtagagacagggtttcactatgttggccaggctggtctgaaacttgtgacctcaagtaatccacccgccttgacctcccaaagtgctaggattgcaggcatgagccaccgcgcctggccaaagagggaaagagggagggaacgataggccaaaagcctacagcacccggtattccaggcagtctcccatccaagtactaactagacccgaccttgcttagcttctgagatcagacaagatcaggtgcattcagggtggtatgactgtagaccctttatttcatacttgggcaaattgagggccagagggaagctaccgatttgtgtagccaagccaatgccctaggctcctgcctggggtgctctctgccacttcctgcttcctcttttccctccctggccatcctgtcttactccctgtctcctttgcctgccattttcagagctttgggctctgctggtgtgaggggagagtagagagaggggaaggtgctcaccagcccttctgcaggctctccctgctgctgtggcaaggccccagagcaccaacagacaggtctggcttctgggccagaagctttggggcagcctggtgggggtgagaggaaagtttccgggcagaataataacgtgctaccttctagctgcagcctcttgctatacctccccaaagcatgcacgtgccatgaagaccagctgcctgaggggcctccagggtttgagtccccacttgcagggactgctgtgtgcaggcaggtgcatgttggtgtctgtaattaaaaatgagcatgcatcacttcacccagtgaggagacgccactacctcgggtgggatgcaacagctgcttgctggctgtgcagctgcctgggtatccagcctggcacagaaggatagataggactgggtagctcagggtgaacagtaaggcaaggcccagggcccctcagccagacctcatcccttgctgggcctagagcttatgtaggagatgtgacccgtccttggcccacacattgcctccttcttttgggcatttgcagccacctagttctaagcaaacctccagcctctgggtagcctgggagtgggacccatcatcagccttcgtcctgggcctgacctcttctgtcttctatttgctcccaatccctagctgaagccagggcacagggtgatgtcctgaatacaaagcactaaatgaggatagttcaggtccaggtcctctctcttacctcttttcttcctctcccataattcagaaagacctgctggggaggcactgtgggtcccgtgggggaaagcttggcctggtgtatcagtcttgccctgttgtgggagccctgagctgaatggggtaaatgcctgcaccctgcccaggagatgaactcaggctgaagtgaggtgggagtgtgtggtgtgtccccaaggtagctgacgcagtggcactgtggcagcctgtgtgaggtgggtgagctgctccttcccttttttgccaacactcctgagtgagtaagcaggtgttggtgcagggtggggtggtggtggggaagtgctggtgtctggggtctcttagaaattcctgcatcatgggtggtgtcccaagtccccatcttgtttctgcatgtggaagacccaggtgggagggaaggcccggaggtgtgtctgagggactggaactctgaatccagtttctggcagaccctgggggcaccttggcatggttcactgacttttgcctgttaggtggagaggaatgtgaacatctgcaactctcccaccttggaaagaggctttatagtctccttgggtctgtgtgtgggagtgagctgctctgggctgtgggtttgttagatggccagtggtgtcagtggcagagcacgttctcatgtcctggcaatgcttccacacactgctggctgtctgggctgtggaaggggatgtgccagggctaggaggaccccaggcccacccaggctcttcaccagtgggaccagcccagtgtgaccttgagctagtgtccttggccactggcagtctgctctccaagggctccctggggctaactgagggagaggcagctggcctcgccttcctccaatgattttccaatatttactggctcattgacatattgcccgggccatggctcctactgtgcagcaaggacctgagagccagcccatggtcaccctgtcttccctccgaggttgcacctggctgggagggaaagggcttgtcctctctgcctgatcactcagggacagagcatatagcttgtcctgcccctcaccttccatccccagcccccactagagtcattcttgctcagtgggcagagcatgcaagggagagcagtctcccaggaagggccagggggcaactacaagccccttctctgcctgtgggcctggcttagaagtttgctcctttgccttcttcctgtcccttctctgcccaagtctgaattttggtaggacctggtgcatgtgctataatgatttggggctgaacagtcaatggcattttaattagctccatgcctccctccagtagggaggaccagggcccccaggtaacagcaggtaggaccaggctagttttgggcctgaggctgcccctccaggggtctgggagcaggctctgggacctggtgctccctgtgtgagatgctgtgaggagggagagctgggcagagaaggaagggctgtgtcgcagggccacagttttctctccatcctctgtctcccttgatcctctgttctccctgatggctttgagatgaaggcgacggcaaggatggaggatgcagtttccatggcaacggggctgtccacagccaggcaacttcagagccgggctctccggaggaagcagatgcgcagaacagccgcagagctgcctcccgcctgccaacgagggggctggcagaacaggtggcacagggtggcagcctggtgctgcccagcctaggggagagggtggaaagagcagtactccctcttattatcttgttatggccaagttcctccagaagggaagctagggaggtggcttgagtgttgagaggggttgggctagggtccccattgtccctggaatctctgggtggacacaggctctgtcctctgggatcttcccccaaaagccaaatgtctgctgctcttgtgatggccactcagctactaccctttgggtcctttgtccagagtgtgaggatgttggtgaaggccatgccctgactagattcagggatccttttctttcatctagctactggggaaggacctggaccttcttcaggggcctccctgcccctggcctcagtgacctggaccagtttgctgagttgggttcaggtttggcagatgcctgcctctaagtgctggcattggaggggccccagagcctgacagctcctgcttcctgacactgtgatcttgtttagcctcctcctggagaccaaggctggagtgggtatgtgagtgggtagagaagcaaagacagccatctgtgtgtttagaaatgggacgtgtcaggggcatggactcttgagatggaggaagccccgagggcacccaggttggcaaagaagatttgactccaactattaaaaaataatgactttccttcaccgaccttggaagcatcagggctagggtgttctactttgctgttgagcacatggagacttaggatggaaggctttgcctggatcacccatggagtcagaggctgagccacagccagacctgggacaggccatccacctcccgcgtggcctcctagatgcaccctcccttcagctggctgctgagggtcctagctaggtaaacctttcaggctcactcctctttccctttatcatccgtgggcttgcttttaacccttctttgctagcttgctttagttgaaggaggttcctcaaccctagggttggccaggcaggtggacaagtggagtcttggagtggcttctccttgccaggcaataagtctctcattactgctaagtggaaggctcatttcagagctcatggtgagagcggggcgaatgctataaatagtcgtgttgtgaagattggcgggtgagcagtgacagggcaggggccttgcagtcatcatagtgggtatttgtgctccttcgcaggaaaggtggcggggcaggctctgagtaagaggcaacttgacccctgttctggctgtccctgcctgcctcagggtggctctggcatgtctgtgcccctccatactcattgggggatggggagcactggattctgtgtctaggcagagggaggtggagtgccttttggaacttggggcccaaaaggtggtacatcagcccactgggtaatgtcctgtgctagatctacttgtcctacctgaccttccagtccagggtctccctcttccccatcagctaaaacctgagtttacatgtgaggaggtatgggaaccatacctgatagtctcagaggttgacatagctctaaactagcaggggaatgaatgggagtggaagtggtgtttagctggccttgatccttgttcagggtctatagtagcatgtctgcaagagcaggggctggaggcctaaggactgggggtgctggtcttctgatatctgtgggtcagtcagcgttgtccagggtggagaggaggtcagggccagggggtcctgggatggaaagtctggtaggtgagaccttggcttaggcacatggggtccctatcctggggtggtccaggggtgccaagcttcatggctctgtgagaccagtgccttctggaacagctttttggtctcagatgtacacataggagagcagtgccaggctcctgggttcttttaccacctgccctagggtgtcgtcctgggtcttcagactattattgcactctggactatggggccctgctgttagggtgatctatgtgtgcctccctcagcagggctttggaacttggaagaggttgagaggcagagccagcccctgggacagaataggtaatagacagttctgggggtcacccagggacaagtgagtcaggggccctgtagggctcattctaccttttgccactctctgactaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggtacagaaggtggggtatgaggatggggccctcctggagctcctctcttctggactccaggggcttggttgaggaggctcctccctctctgggttggcactgtgggtgtcaggctatgcttggcagagggaggaaggagacccacctacctgaggacccacatgtggagttgcctgttcccagacacatggatctacatagatgtggattcacacacattacctcctggcaacacagatacaaagaccctgcctggattccctccagatgcagcaggagtacccttggaaacaaagatcacagacagctcgatgttcatgggagggggctgaggctgctcaggaaaggagtcccttgggtggggctcagcaggaagtaagattggcatagatctggaaggtaaggaggggagcaaagtgttctcttgtccctcagtacgggccccacccagagccagctgctttctccctgccagggaacaaccagggagcatgcagaggggagccaggagatcagtcacctgtgcctttctccagggccagcccacactcctgctggcagcctcaaggccccaggtccaggctggaaggctgcttgcctgcccacccctctgcaatgatctgtgaccccgggctgtctcaggcacaagggggtctgctgggttacatcccagatggtcccagggggccttatccttggccaacctggtggagtttgtgacttctaggagtggtacagggctgtggggagaggaactgtccctcctctcctccttctttagcagatgctctgcccatccagtcttcaacagccaaggtcaccctagggagacgtgtcagctagggctgggtaggagggtattgggagcagtctctactccctaggggcctgtgtccaacacagttaacttcatctgccacttaattacctccatggggtacagctcccttctgcctggtagtgcccggcagacactcttcagtgcccctactgtgggcacaggacatggcacaaggtcagcaggcccaggcagcctccagggcaggaagacagagtgccttcactttactgtgacctccctctgctgcctgcctccccctccttgacccacccacccagcttccttccctcccaaacactgcctgtcagggtcattgaaggactgcttggcacccactacagctggctgtagtggcagctcccacattccccagctcctcagcctgttttcctcccctccagcccgcccacccactccctggtgttggggccaaggggtctgcccacctctcacagggcctgtcctgacaccccagcgggactcggtgtttgcccaccaggtgcatgccactgacacagcagttggtggtgggtgcatgcaggatgtctgactgcccaaggcttggcctgtccctgcccgcctccctgctgtggccctagcttaggccgggaggtgaaagggggtgattagctgccttgtgcctgttattacattgatgtattatttagcttcagagaggcgatgaatatttgatcgtcttgcactggctgtgggcagagcgagagggagggatttgggtgaagggggtgggcttcaagtcccctgccccagtagtcgtggggatttaggtagggccctgccttgcctggtatcttctgcccagggatgcaggcatgggactctgggacctcctcctgtgtagatcttggtgggggtatagggatgctacttccccgtattgcattccttttttttttttcttctgcggcaaggtctggctctatcgcccaggctggagtggtgcagtggcaagatctcggctcactgtaacctttccctcccaggcttaagctgtcctcccacctcagcctcctgagtagctgtgacaagaggcgtgtaccaccatgcttggctagtttttgtattttttatagagatggtgtttcgccatattgcccaggctggccttgaacttgttagctcaagtgatcctgcctcagcctcccaaagtgttgggattctagggatgagccaccatgcccagctggattccttttttttgtttgtttgtttttaaagacagttttccttttttgcccaggctggagtgaaatggcatgatcttggctcactgcaacctccacctcgtgggttcaagcgattctcctgcctcagcttcctgagtagctgggattacaggtgcctgccaccatgcccggctaatttttgtatttttagtagagatggggttttgccatgttggccaggctggtctggaactcctgacctcatgtgatccacctgcctcagcttcccaaagtgctgggattacaggcgtgagccaccgtgcctggcctccagctgaattcctttgcttgaagtgtatatatgtctccaggggctgtcttcatttcagcaggctgtcctggcctgaaggaggcacccctaggctccttcctctgaacattcctagcctaggagctgggtggtaggaggtagcatgctgggaagcaggcacattcctatacctggggtcccaagagagccattgggtgggtgggcagacagaacatacagtttaatagggccagggagaaactgtctccctcctttgctcttttcaggcctgcggtccctggggcactgatcattatttaaggagcagtgagggcctggcatcctgtcccctggtcagaagaaactacccaaaacttaaagctcccccagctccctgaccacctcattcacaggcttctgtcctgggagccacacctggggcctcagcaagaggagggccctgggccagcagcctgggcttctagggctcacctcacctctgccagtagcgcccagagggcatattctgggggctgagtgggtggtgggggtagggagagaccccaaattcccccctctcctaattctcccacccccaacctaggccccatttgaggctcaaggaaagccccaggctgagtccaggcgccaagcagaccccagctgcacctggcttggctccaacaccatggagacagtggctggggaagctggctaacccctcaccttctgtgatgtttgacagctgaccctctccccatcatacaggaagggtagcagatccactttctcccagtctggattcctgcacacagcgagcctgagccatgtgttcctccttgccaccccagcctgcattcagtgcctctgatccagggagatgaacccaggggttgctcctggacagggcagatgaaggggctgcttgcttggaggatgtattgggggtggaaggagcaggttagaaggagtttgggccatcaacctggctcagcactggtttggggcaccccaaccaccagcagagtgctctcatcatccccttttgctatcttgtggctcaggaagcaccagtcattgggggtggggtgggtaagggtttctcagggtcgacccaggcatagggagagaaaacccttaacatgtttcatcccagcaccctcctccttgcagctggttgagtatttctcaggccttctccatcctcctcgtacttcagctccctcctcaactgggacttggtgtgtaccagaggcaggggcctgctgactccctggatgctgctcctgggagccctgcacgggggagggctgcagaggggcctcctgctgcattctgcagtcctcgtgccctgtgggtgatgttctgtagctggccctggacacatctctttccaagcttgaagtgggggtgggggaaggtggagaggacactacttgtgtctctttgttctacctcagctcctcacctcagggctgagtggcccttaataaatgtggggggagggcagcaggctttgtggaagtgcagggagctgaggctaatttagagtggggagaagagtgcacagctgcctcctcccaccctctctccctccctccctccttccctccctcccttcctcccagctctttccctctgccctgtctgtgcagccccagtcagggtagagggcagagggcagctggagcaagccccctgagcccgggaggctgcattattcatgagtgcactgcgtgctgagttgcctctccctggaggagggggtggggtggtcctagctaacctgtgctcccttttcctggtcataggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccacccctgttgtgtctttttttcagactcacagtggagcttccaggacccagaataaagccaatgatttacttgtttcacctg

SEQ ID NO: 38397 - DNA, 25539 bp, Homo sapiens
cttcgcccgacgccggaactgcgagctctcagcgggagccgagacggtgcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaaggtaaatgtgcagttccggggcggcgcatgacgcgactgggactaggccggaggcagcgggggaccggcaggtgggccgctcagtgcgttgaaggattcgatccccagtccctccctcccagttctaggcgccccaaaccgctccaggcctgagaggtgggcggccgccttagtggctccagactctagctgggggcggggggcctctggcaacctcggtctcttcaaaggccctttggggtcttccgactgtgtggaagggggagcggggtccgcacgggtaggactgggccccgcggcccccaggccaggagcgtttaagtgcgcgttcccctcccccgccaagggtcctggcccggttcgggggcggaggcagcggagccagtcccagtgcccagtgcggcagcgggcagagtgaggagggtgcctctccagccgcgcgcccgccctgggccgctagcgaacctttgcgtccttctggctccagggaaaagttcgctgtttctccgccttttggccaagatcaaggatagtatggagcggggacgaggggtggggggcaaagttcgcgggtcactggcagaaaacgcctctgatcgcgtgttgcgtttttgttgttgttgttgtttgaacttctggagcattcagtggtgctgataacgctcctcagtcctctgctggtaaccatcagggctaggcgcttctcctgccttgggtctcctccccgcatctcatcccctgtctcctgcatttgatacacagatggcattgtactgtacatttcgttgtattgcttcttttttttttttaacaaaagtttattcttaaatgtacaacagctccaagacaacacttaattccagccataggtggcaaaagatgttatggcagggaatagagaggtttaaatactgatgaaataaagggtcaccatctccttaggcacagggaacagcttactttttgccagatttcttaattccacttgtggccaagggccccttccccgtggccttccattttagctcctcgagtttcttctgctcctctttttgtttctgcttgaaagccttatcttcctcgtccatctccttggcctgcattcttgggctgtttcagtggcttcttgccaccttcgtggccggacatggcgcctgccgccccttccccagcagtattgcttcctttttaccggcttgacaacaagtttgaagcggggctttgccataaaatccagttccttgctccctgctgttgcccactgttcccaagtgtgcatctaccaccttcagtggacacggacaggccacctagagtcccactgcaccacttggtgagaatttccttgaacagttaatattgctgaaccttatacccccaatctcatgcttagttcactacccaactggcaacagctcttaagacagtcaagattattctccccactttacagattaaaaaactgaggcacagaaggttaagttatttgaaccaggtctgatttcaaagcctgtgttctcaaccattaggtaatcactggctcttctagtaattcagtgactcaaaatacagacttgtacatgtgtaaacacaaaattatcatgggttaaagacctttaggctcacttgcaaatatcgggaatcattttatccaaaaaagaatgacaaggatcagcagattaagcctctgcccctgccagagggctcaaagggcaggaaaaggcagtgagagaaggagagacagaaaccaagatgacagtgcagaggaggcatggggatgagatcacacacggagccctcacagggaatgagttggggtcatttgatgttcatattagaagctgcaggttctgccttccactggggctgatggcacaagagcactgttacattttacctgctgcctttgagcttgaggttgggtggtaaaccattcttcactgttcttagcggctttatttctcatagagtcatgtgttgcttaacaacggggctacattctgagaaatgcatcattaggtgattgtggtcattgtgggagcatcacagagtgcacctacacagtcctagatggggtagcctactgcacaccaaggctacatggtgtatagcctgttgctcctagaatacaaacctggacagcatggtaccgggctgaatactgtaggcaactgtaacacaatggtaaatgtgtatctgaacatagaaaaggcacagtaaaaatacagtctaaaagattttttaaatagtacacctgtactgggcagttaccataaatggagcttgcaggactggaagctgcactgggtgagtcagcgagtgaatggtgagtgaatgtgaaggcctaggacagcagggactggtttggcaccagggactattttcatgaaagacagtttttccatggacttgcgggcggacagatggtttggggatgaaactgttccacctcagatcatcaggcattagattctcataaggagctcgcaacaacctagattcctcacatgcacagttcacaatagggttcgcactcctatgagattctaatgccaccactgatctgataggaggtggaactcaggtggtaattcaagccatggggagctgctgtaaatacagatgaagctgctcatctcctgttgtgtggcccagttcctagcaggccacagactgggatgggtccacagcccgggggttggggacccctggcctaggacattactgtacactactatagactctataacactgtacacctaggctacactaaatttgctttacaaatgtttctttcttcaatgataaattaaccttagcttactctgtttttactttataaactttttaattttttcaacttttgactcttttgtagtaacactcagcttaaaacacaaacacattgtacggctgtacaaaaaatgttttcttctttagatccttattttataagcttttaaaaattttaattcttaaactttttttgttaaaaacaaagacacaagcacacacacgagcctagacctatcactgtcttccacctccacatcttgtcccactggaaggtcttcaggggcgataacgtgcatggagctgccatctcctatgataacaatcgggaatacctactgaaggacctgcctgaggctgtgttacactgaacttttttcttttctttttttttttttttttaataagtaggagtacacacggcccaggccaggtacagtggctcacctggctcactcttgtaatcccagcacgttgagagggtgaggcaggcagattgcttgagcccaggagtttgagaccagcctgggaaacatagtgaaaccccttctctacaaaaaaatacaaaaattatccaggcatggttgtgcatacctgtagcccctgctactcaggaggctgaggtgggaggatggcttgagccggggaggtcaaggctgtccaatatcaaggattcctgatatttgcaagtgagcccaaaggtgtttaacccatgagtgagccatgatcgtgttactgtactccagcctgggcaacagagtaagaccctgtctcaaaaaaattaaaaataaaaagtaggagtatattctaaaataatggtaaaaataatattgtaaatatataaacctaaaacatagtcttttattatcattatcaagtattatgttgtgggcctaattgtatgtgctgtgcttttgtataactggtaaagcaagctagtttacaccagcctcaccaccagcatttgagtgttgcattgcgctatgatgttatgacagctatggtgtcactaggcaataggaatttttcagctccattagagtctgatgggacttatatgtcttatatgtggtctgtagctgaccaactaaaacatcatcatgctgtgcatgactgtaattaatggctgtccttcaactccttagctgggcactaaggttctccaccacaagctgacctttccatcctccctcctctacccatgggctcatttgaaggtgtgttacctctgtgttttgctctagctgtgccctgacttggctcctcttccttcctttctgcttatggaaatctttttggaactcccctgctctgctgctccgtcccccacactgtccttttatgtttcgtgtgtctgaacttgtctctcttctaggctgttagctctttaagagtcaggattgccagctgggtccagctgttatttgagcaaatcctccttgtttccgggcgtcagtttcctcttctgtatagtaaagtgttgttaaatcagttgttctccacactacccttcagtggtttctttttttttttttttctttgagatggtctcactctgttgcccaggccggagtgcagtggcgtgatctcggcccactgcagcctctgcctcttggtttcaagcgattctttgccccagcctcccaagtagctgggattataggtgtgtgccaccacgcctggctaatttttgtctttttagtaaagacggggtttcaccatgttggtcaggctggtgttgaactcctgactcaggtgatccacccgcctcggcctcccaaagtgctgggattacaggcgtgagccaccacgcctggcccttctagtggtttctgttgacttctacccacaacacctcgcctgtgacccaagccatctggacagaagtgatcctaggtcagctgctcagtggtatggtaggtttggtaagagtgggaagggtgcagcacagccccatccccgctgttggggtcagaagggcaatgttcccagcatcggggctagactaagaacacagggaccttggctgattactgtccatttctccaggacctggcatgtggtagtgcaaattaaatgttgcacaattgaatgtcggcagccaaagacaccctgcctggctcctggggggctcccagcttaaagttcagatactgtattaggtccgagacttgccctagtatctgggcgttttacacaaactctggttagacacttaaatgcattatctcttttaatcctaacaataacctttttattatttctcttacagatcaggaaattgaaggccagaagggtaaagtggtttgcccaaggccatggggctggtgtgtggctgagttgtggcttgagctaagggcttgtaagagttgacagtcagtattccgagagggagatgtaggtggagacaggagatgaagctgaaagatgagagacagtcagccagagagaatggaaggaaagaacaggaaagcagagagaggagtgtctgccagtcccaggataccacggctatatcagctttctattactacctaacaaatgatcacaaactttgatactcaaagtcacacacatttatcattttttagtttctgtacgtcagaagtcaaggcacaacttagcagagttctctgcttcaggtcttgccaggctgggctgcagtcgggagttggccagggctgtggtctcatcccaggcttgacgggaaagatctgcttccaaggtcgtcaggttgctgagacctgaattcacctcctatggttgttggactgaagtcctgttctcttgctgattgttggccgggggtcactctcagcaattagaggttgcccgcagtcctttgctacttgaccctctcgttaggcccatgagtgtctctaataagacagagccttttatatactataaccgaattacagaagtcacattaccttcaccatataacttaacctaatctcaggagtaacattgtataacctttgctgtatactattgcttagaagcaattcacaggtcccacccacatgcaagggaggggattattcaggatgtaaacatgagggccactctggggaccttggatctagactgctctgaagtttgtgggggtcagggtccttgactcctcctgatctggcatctctctatccactgcagtctcccttctccagagttgccccattttctctcctggagcactggagctggaagcgaccttatggccatctgcacacctctctggagcctccagacctgctgggctctaagagctctttgcaggtttctggggaggctaaggaagtccagtttgcctgaatgttacagttctttgcccctagccatagttctgtaattcctggctgaacaccctgtcccttgagagcccagaaactttcattggcctttctgtgtctctgatcagcttaaactgagaatgccaacttcataaacactgcttgtttacagacaaagctgaggaccctgggagataataataaggggtctttgaaggccaaaggattgggaaacactcctctgggcacctgctggatttcagccctgggaagacctgaaatgtccatcctgatttttcgtaggaggagaaacagcctagaagggatgataagggtgtgagctccttcccagagcccatctctcttccccacaccctgactagatggcgggggtgaattggggccagagtgggtgcaagagtcagattgggggggccttatggtcggtattaaggagttgaactttattttgaggaaaagaagggggaaggggagggacgtggtcggattggggtaagaaagatgactgtgacccaaatgtgggaacgaatgtgtgtgtgctgggagggagcaagactgaggactcgagggccaggtgggtgatccgagggatgcaggaaagagcctatgccagattaatggctgtgagaagcggtgtgagctgagaggcctgagatctctttaagaggttggattagcaggccttagtgactgagtgcattttgtaggtgaggtaagagcgaggtgacaggatcaacttctgagttgatagcaaggtcattggctcatcaatggagcaggacataccagttgagatatcaagtaggcatttggctattcaggcctggggtgcacaggagagctctgggctcctgggcacacacgggagccctgggtgtacaggaggcaggcgtgtgttagctgtggaagggaggtccctcctgcctcagcttatcctgctctccctctgcctgaactcctccagttctggaaggcaccctgcagtcccacacctgggccctcttctctgccactccctctgcctgcaacaggcttctctcctggactgcccccttccctgcaccttgccaacatgcatgcacacacacaggcactcatgcacacgctcacatatgcacccatgcatgcacacttacatgcacacatgcactcttacatcttttgcctggccaattcctactctcctgtcagctctcagcttaaaggccactgcctcctctgataactcattgctgaccttctatactagggctcccctctgcccactggaggccccttacttgtttgtcctttttctccaagttctcctcacaaatagtaattatttaatgtctgtcttccccactaggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaaggtaggaggaaggagaatgggggcctgccaaagccaaggcagatacgtgtcattatgcatctgtgtaaacccacagagtgtacaccaccaagagcgaaccccagtgtacactagggcccccgggtggcgacagtgcatcagtgtaggttcgtcagttgcaacacgtgcctctggtgggggatggggattgcggaaggggctgtgcctgtgtagggccagggagtataggtgaactgtattgaattgtattttccactccattttgctgtgaccctaaaactgctctaagaaaatcatctatttataaacaaataaatattcttctaagaagccaaagcagaaaacgatcaagtggagtgtgttaatgtcagcaaaggtttttgctgccacgaggttgaggcaaggagagaaacgtgtcccttggttagtgatgtggctatattcatcactttaatgagaataatgtctgctgagtgatggggctggaacctagattggagaaggtttgagcgaatggaaggtaagaaagtgactaaatgagtatagaaaactaccaagaagcttggctgttgctggtgaaagaatattacacaagtagggccaggattactgtcttgccaaacaggacagaacactaagcctctgtatttagttgctaatttattgtgacagaggagcatattgatctgtccccgtgattgtgcagttagcaaaacccaggctttgagaaaccctgtaggtcaaataccccaggctcctccacagataatctctgagggaaagacagagttgtggggagcatgtgggggttgtaccaggatttaaaagatacacggcaattttagaaattagcaagtctaaactatgatacctaaggatgcacacctgggtgataaaattataaagaaatggccgggtgtggtggctcacacctgtaatcccagcacttttagaggccgaggtgggtggatcacctgaggtcaggagttcgagacaagcctgaccaacatggagaaacctcatctctactaaaaatacaaaattagccgggcgtggtggcacatgctgtaatcccagctactccggaggctgaggcaggagaatcgcttgaacctgggaggcggaggttgtggtgagccaaggtaacaagagtgaaactctgtctcaaaaaaaaaaattataaagaaatacacagaggtgattactataagtcaaagagttacttgttcagggggaaggagggagctacgattgagtcagggcatgtggtggggtttctgaggtggccggcacagttctatttcttgatttgggtggtggttataagggtatttgccttatcataactcctcaaactctagaggaagaagtctgctgtgaagaaaagattaaggccgcggtggctcaaacctgtaatcccagcactttgggaggccgaggcgggcagattgctcgagctcaggagtttgagaccaggctgggcaagatggcaaaacctcgttcctacaaaaagcacaaaaattagccaggtgtaatggcgcatgcttatagtcccagctattttgggggttgagggaggagaattgcttgagcccaggaggttgaggctacagtgagccatgtttacaccactgtacaccagcctgggtgacagagttgagaccctgtctaaaaaaaaaaaaaaaacagcaaaactctcccccgccaaaaataaaaaaaaaaaagatgaatatggagggagttgtaaaattaaagaaggtacatgggtgcatgtgtgcttgtgtgtgtgtgtgtctgtctgtctaacaacagcagaagcaggcaagggctactgtggtagtcactgttgttcctctccccattttgcttcacagtttacaagtccttccactttctctctgaggcagaaagagcaagggtttttctctccattttatggttgggaaaattgaggcctgcctgagtgtgtgacttgtggcaagtcactctggtcatctagggcagaggctccccagatcccaggcctcctgcctccagtccccagcccgcagcccaggattaggcagagccagctgctttcccgtggctgccctgactccttacagggatcactgagattctgatgaacagaccttctgcccgcaatgccttggggaatgtcttcgtcagtgaggtaagaaagggcgggcgccagggtgggctggggatgggctggcactatctaactgggtgtcctctgtagctgctggaaactctggcccagctgcgggaggaccggcaagtgcgtgtcctgctcttcagaagtggagtgaagggcgtgttctgtgcaggtaggttctctctcctgcccccatctgtgctctgcagggtgcccaccagcctccaggggttgggggaaaccttagatcagcttcagcatgggactcattgttgccattttaccgatgtgaatgcagagactcagggaggaaaattcccttgcctaggatcacatagctagtaaggggtaggatagactttagtttgaacttggcctctctaacccttagatcttagttatttcggctatgccatgctttgttctgacccttcacgggggaaataagaaaatggagtccaagacgggtacagtggctcacatctgtaattccagcactttgggaggctggggcgggtagatcacttgaggcccgagttcgagaccagcctggccaacatggtgaaaccccttctctactaaaaaatacaaaaattagctgggtatggtggcaggcacctgtagtcccagctactcaggaggctgaggcaggagaattgcttgaacccgggaggcggaggttgcagtgagctgagattgcagctctagaattcctgggctagttcctgcccctctcggagcttcagtttccgcatctctcacagaagggctggaactgatcaaagatttccaaaggctctcccagctctgacttcctgtagtctaggactggaagagtctatttactctctactcctgctcacccctgcatctggcctttgaggaccccaccacggtcactcttcccgccaaggcgcttgcccacctgcatgccaccgtatcttgtgctcacttccgttctcgtttacttgacctttgacctctcagccttcttggaccttgctgactctgcctgtaaaaattagtcaagttttaattttcttattacttacatattttagaaattgtgggctgggtgcagtggctcacgcctgtaatcccagcactttgggaggccgaggtgtgtggatcacctgaggtcaggagttcgagaccatcctgaccaatatggtgaaaccgcgtctctactaaaaatacaaaaattagccaggcattgtggccagtgcctgtaatcccagctactcaggaggctgagacaggagaattgcttgaacccgggaggtggaggttacagtgagctgagatcacgccactgcactccagcctgggtgacagagcacaactccatctcaaaaaaaaaaaaaaaaaaaaaaaaaaaaaaaaaacgaaattgtggtgaaatataagtaacacaaaatttaccgttttaaccatttttaagtgtacaattcagagtggcattaagtacattcacaatattgtgcaatgtcaccgctatccattcccagaacttctttatcataccaaacaaactcagcctgttcagacagtgactcccattcccccttcccctccagcctgggtaacctctatggtactttgtctctatgtatttatctattctaaatacctcataccagtagaatcatatcatatttgttttttggtgcctggcttattttacttaacatgtcctcaaggttcctccaagttgtggcaagtgtcagaactccattcctttttatggagtaacattctattgtaatgagtagcattctattgtatatataccacattttgtttacccaatcatctgttgatagatacttgggttgttttcacttttggccactgtgaagaatgtccccaaatacattggtgtacaagtaccgtcagccctctgcatctgcaggttccgcacccacagactcaaccaaccgcagattgaaaatgttaacaacaaaaataacaatgcaacaacaaaaaataatatagataaaaacaacacagtacaacagtttacatagtatttacattgtattaggtattgtaagtaatctagagacaatttagagcaagcttgtccattgtccaaccctcggcctctgggccgcatgtggcccaggatggctttgaatgtggcccaacacaaatttgtaaactttcttaagacattataagatttttttgtgtggtgtttttttttttttttttaagctcatcagttaccgttggtgttagtgtattttatgtgtagcccaagacgattcttccagtgtggcccaggaaagccaaaagattggaacccctggcttagagtatacaggaggatatatgagcataggtcatattgcaaatactacaatattttatacaaggggcttgagcatccatggatttttgtatctgaggggtcctggaaccagtcccctacggataaggagggactgtatctgtttgagtccttgctttcaactcttttgggtatatacttgggactagaattgtatggtaattctgtttaactttttggaactggtttccacagcagctgcatgggtttacactcccaccagcaatgcaccagggttccatgtctccacatccatgccaactttttgttttgtttgttttaaaagccattctaatagacgtgaggtagtatctcattgtggtttttgatttgcatttgtctaatgacgatgagattgagcaacttttcaagtgcttattgaccatctgtgtatctcctcaggagaaatgtctattcaagtcctttttcctttttttttttttttttttttttttgagactctgtcacccaggatggagcgcagtggcacaatcttggctcactgtaacctctgcctcctgggctcacgcgattctcctgcctcagcctcaacctccctagtagctgggattacaggtgcccaccaacacacctggctaattcttgtatttttagtagagacactgtttcaccacgttggccaggctggtcttgaactcgtgacctcaggtgatgtgcccacctcggcctcccaaagtgctgggattacaggtgtgagccactgcgcctggccctttgcccatttctgaattgggttgttttgttgtttagttggagaagttctttatatatcctagatattaaacctttatcagatatatgatttacacatattttcttccattctgtgtgttgtcttttcttttttttcttttttcttctttgaaacggagtcttgctcgtcaccgaggctggagtgcagttggtgcgatctcagctcactgcagccttcacctcctgggttcaggtgattctcctgcctccgccacctgagtagctgggattataggtgtccgccaccacacctggctgatttttgtatttttagtggagacagggtttcaccatgttggtcttgaactactgacctcaggtgatgcacctgcctcggcctcccaaaatgctgagattgcaagcgtgagccactgcacccagccatttctgtgggttgtctttgtattctattgatagtgtcctctgatgcacagaaggtttccattttgatggagtccagttcacctttctgcagtgtcacaccctccttgtttgatgctcctcttttcccttgacttccttgcccgggttcctggtgtttctccttcctcgctggctgcctgtcctcaggtcttctttgctggatcctttaaccgcctgggattccgtaaagtgccattttcctaagggctggtaccaaccctcgccatctgcaggtgcagacctgaaggagcgggaacagatgagtgaagcagaggtgggggtgtttgtccagcgactccggggcctgatgaatgacatcggtgaggatctgggtgtggggtggaggagggggtttgggggtccctgccgatgacagtcccgctacccccaccagcatctaaggagagtcttctttctgtttggagttctgtgataagacagatgactcacccagggggatggaggaggatgaccgagggcagttctctcagagagggagttctggctcttcagcttttgtgtcccgccccaccctcagggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctgggtcaataatgcctgatacacatttgtcttccccatgagactgagccccatgggaacaaaggctatgtctgattcattctgtgttcccagttcccagcacccagcacagggcttggcacaaagaaagggaggccccagggaggccagcggattaggcctgaacagggatcatccagcccatcctcccattcctcttccctggctgattctgtaactttccctaaagggaaaattggcttctgagataacctggctgcgggaagcagaggttgtcgtgagcagagattgtgccattgcactccagcctgggcaacaacagcgagactccatctcaaaaaaaaaaaaaaagaaaaaaggaaaaaaaagaggccgggcgcagtggctcattcctgtaatcccagcagtttgggaggctgaggcgggcggatcacgaggtcaggagttcaagaccagtctggccaacatggtgaaacccccgtctctacttaaaaaaaaaaaaaaaaaaatacaaaaaaattagctgggcgtggtggcgcacatctgtaatcccagctactcaggaggttgaggcaagagaatcacttgaacctgggaggcagaggttgcagtgagccaagatcatgccactgcactccagcctgggtgacagaacaagactccgtctcaaaaaaaaaaaaaaaaaagaattaagataacctggctgaggttccatgtaatgtccccagacctgggtccactgaggcctctgtcccaaccagcttgcccctccccagccttgagtctctgtcctggtcccaccagggctttgcaggctgagcctttcttcctctccacagcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggtaatcgcaactacagcacccgcccaattccaccccatccagggtccttcgctgctttccttttttgccctctgttctgggctctgccctcccacctgaaccctgctcctctgagaagtcttggctgagtcccaggctgagccttctctgggttcccacttcccatgctgattcccaccctgctccctccatcctggtaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggtgtggtgacagctcggcaccagaaggagggctggagtcatgggggaggcatgtgtggggcagggtgtccccttgggctgcacatccattctcccagagacatatgattaaccctctttggagtttgtttaaccatccagtaaacacaatcaagtcaaattttaattctgaattaaaatgtaaattgaattccaaagggctggaaccaaatgggcttgaaagccctctgaatgtaacactgtccagtagaccattctgagatgagataaatgttctatacttgtgcttatccagtatgggagccactagccaaatgatttaaattgcagaaaatgaatgcagttcctcattcacactagccacatttcaaatgctaatagccacatgtggcttgtggctactatactatatagcacagccttaaaatcccccaaagactgaaaaagcaagattctaaaatagatacagaacttccaacccatatttcctaccatactgcctggtgggatattcttgaaatacaacatgtgggctgggcagggtggctcatgcctgtaatcccagcactttgggaggctgaggcgggtgtatcacgaggttaggagttcaagaccaccctggccaatatggtgaaaccccgtctctactaaaaatacaaaaattagctgggtgtggaggcacgcacctgtaatcccagctactcaggaggctgaggcaggagaatcgcttgaacctgggaggcggaggttgcagtgagccaagatcgcgccattgcactccactgggcgacaggacgagacttcatctcaaaaaaaaaaaaaaaagaaagaaagaaagaaatacaacatacaggacatgtattaagcatttttttctttgaagagatagggtctcgctgtgtcatccaggctggagtgcagtggtgcaatcatggctcactgcagttttaaactcctgggctcaagtgatcctcccgcctcagcctcccaaagtgttagaattacaagcatgaaccaccgtgacgggccaggctcatgttttagccagatgtggtagttcgagcctgtaatcccagttatttgggaaaaagcattgcttgaacccatgaattcaaagctgcagtaagctggtcacgccactgcacttccagcctgggcaacaaagcaaaatcccgttgctaaaaacaaacaaacaaaaacaaaaagccaaaaaaaacaaccaaaaaacccctcattaaaaaaatcctcaaatagcatgggaaagggtgagggataaaagactacacgttgggtacggtgcaccaaaatcttagaaatcaccactaaagaacgtatccatgtaaccaaaagccacctgttccctaaaatctattgaaagaaaaaaattaaaaatcctcaaacaataacctctcagcatggtaccccaaagggtaccatgctcagtagggagcaggtcaggccctgcccaggtacaaccctaccagctgcagggcccaaagccctcagcagggatatctgggatctggctgtctggggtatccaaggccctgcgagggtctgctggcttctcccaactctcagggggcccaggatacagggggttgggtacaggagatcccaaatttccataaagattaaaagtggcttaaatggagctaagttagactaatttataataaatttgtcttagcctataatgctaggtaccttaatgtagtatctcagctcttagaataatccagttgaactgattatccccattttatctgtgagaaaacccataaaagttcagtgacttgttcatcaaggtcacaaagagtgattgtagtattagaaaaaaaaacaacaccggtattttggcatttattttgcacaatacagaatgcaatataaaaaaggtattttaagagagcaaaatatgtacaaaattttaaaaacaaactaaatatttaatgtatttcaaatacaaaaatttacaaatgtcacaaaacaaagttaaccatacatcattttaatattgacatatattgaattaatcatataaaagtaaccattttggcttagcatggtggctcacgcctgtaatcccagcactttgggaggctgaggtgggaagactgcttgagaccaggggttctagaccaggctgggcaacatagtgagacctcatttgtattaaaacagaaaagaagccgggtgcagtggctcattgctgtaatcccagcactttgggaggtcaagacaggaggatcacttgatgccaggagtttgagaccagcctggccaacatggcaaaaccctgtctttactaaaattacaaaatttagctgggcatggtggctcatgccttttattacagctactcaggaggctgaggcacgagaatcacttgagtctgggaggtggaggttgcagtgagccgagatcgcaccactgcactccagcccaagtgacagagcaagattctgttaataaaataaaatagtataattttgaacaaaaatcctttctttcctgtctctcaaatgtaaataatcctaatacttcttaaaacagatcttctttaatttggaggtgagggactatagctttttgaaagcatttgtcttttttttttttaagcttcatcatatataaatgaagagtctgatgctattgcctagacaatattaatgctgtcaagtttctattatacttggttagaaagtctccgaactaatacagaactctgggtcactcaatggagtggctgattgcagctttcatatctagacctgtagactatagggtttgtctttttgccttaactaaataacaatcacaaaataattcagatttccaaatatactaaaatattggtactatataattactgatattttcagtacttaaaagtagctttgtataccaaaacaccagtctaccaaaaacaagtactggcatgagtaatcccagagttgagaccttctgggtcaacctgaaaaacaaaacttcaacttccacctatgttactgggtgctcagaataaaggtttccggataggagagggccagggatggtgtagatggccaccatctagtggacaaaccactctgatagggtagcaaatggttccagagttttctcagcccagaaaaaaactgtcaatatccacagtttgcatcagatttccttcttaaatagtaaatacacattacactttgagaaatggattcagctgtgttttttttcttttctttttagagacaggatcttgctctgttgcccaggctggagtgcagtggcacgatcatagctcaccacagccttgaagccctgggcctgagcagtccttccacctcagcctctgaatagctgggactacaggtgcaagctactgacttggctagaatttggctgttttcactcacaaacatacgtacataccgtttttaactttaataaaaggttactttatttatttatttatttatttatttatttatttttgagacagggtctggctcttttgcccaggctggagtgcagtggcatgatcacagctcactggagcattgacctctcaggcccaagtgatccttccacctaagactactgagtagctgagactacaggtgcaagtcaccacgcccagctaattttttattttttgtagagatgggatctcatgatgatgcccaggctggtctcaaactctttgggcaagcaatcctcctgcctcagcctctcaaagccctgtgattacaggcgtgagccactgcacctggccaagattacttcctttattgggtagttacctaaataataacacatatggcaagcaaatctaaaagaacagaggagtaagaagggcataaggtaaaaatcaaaggcaagatgaccagctagtcctggtttacctgtgactaccccagttttaaaagtggaagtcccatatcccagtaacccttcagtcacaagcaaacccaaacagcccttcatttcccaatccctctctctccccagatcatcactattgtttccatactcttccagaaatttccattgcatatggaaggacgtgtattatgcacatatgcttacatatttaaataaattccttttaatggcttagaggacaagaaatatctttcgaggctaatctgtttctaacaaattttaaaaacaaaatttaaatatgcatagtaaggaattcaaacatggaagaatataaaacaaaaccttcattttatataacaaaacatttataaaccttcgtttataaaacaaaacaaaggtttggttttgttttataaaggcacaccagcattttgccagtttttgccaaattgctctcctgtggcatactcttttacttttctatcaataatgtatgtaaatactggtttccccagtctcggcagtagtaggcatattgatattttagtatttgctggtctgaggtgaaagggcacagtacctcactgttttgatttgcctttcaagcgtgtagcagctgctggacatccttcacgttcgtacttcttttccggtggaccttttacatactcttttgtaaatggtttaaaagttactttatactaacttttttgtaaatcaaggaaattcatctgtcataagcattgcaattctttttcccagttttttttttttttgagacttttcctgagaaagttttataaacacttcaaataatatgatataggaagtaattcctccttgcctggaagtggggctgagactggagtgctagggctggtgtggaaccaaggccagtgacaaagcagacactgttgcttctatgtggctgtattaaaatgcacccgcccctctgcactgccccacagaccaggatttcaacacagccctgtcgacttgaaagcccaagttcctaaccctgactttgtttcactctgctggggtaaaaccttaccgcagaggctggcatttgctgaaatgaggtcgaggaagtgggaaaggtggttgggagtccaatccaagtctcaccaatgattggataaacacagccaagtgcttcacctccctgcactgcaatctcacagctgtaaaatcacagctgggtcatcagtgatgacaccagcctagaagtgtgggtagcaccattagatgagtctgtgggggaggaaagcactttgtaaactagttatgttgtgcatgttggaaggatgggctgaataacaagaaacccaggtgttcagggatcagagtctggcttctttcatgatagaaaaagaacctcagctaacaggttataggactaacgctaaagaaactgtcagcagaatggctggaaccagacccagacatctgcctccctcctttaaaacaaagctgtgcacctcagacctgcaactatcagccttgatgccctcctcaaccaagactttttgcttttccctaggcccccattgccgtgcggctgggcaaagtagccattgaccgaggaacggaggtgagagggttttgggttgggacttgggtccactaaagttggtcgcggctgggacacagtgctttcagagctcagacagcacagctgggaaaaactcaggaagtggactcttctaacagacttgaactctgacctcgtgctctacgtcagtttacacatctgcaaattggccagacagtattattgtttacattctatcctcatctttctcccttggagagaggatgagattgaggttaagaaagggtaaatgatttgcccaaggtctcagaggaagtgagtagaaagaacccgggtctgtgtggctgccagtccatgctgcaagatttgtgctggcagtaatgtggcctcagggcagggcttggggtgatgccttgggtgtggctaatccatctgtccacctcaactctcccatctagttaatccatctgtccacctcaactctcccatctagtcactcatcacacactgaatccagaacaaagctgggaactgggatacagatggatgagttaaacatggtcactgcccccgggagggggcagatacagacacaaatcaaggataatggtaccacgctgacaccccagaaaggttagagctttgcggtccattatgatatccatgtgtggcttttaaattaaaagtaaaatgtggtcaggcgcggtggctcatgcctgtagtcccagcactttgggaggctgaggcgggcgatcacgaggtcaggagatcgagaccatcctggctaacacagtgaaaccccgtctctactaaaaatacaaaaaattagccaggcgtggtggcaggcacctgtagtcccagctactcaggaggctgaggcaggcgaatcgcttgaacccaggaggcggagtttgcagtgagccgagatcgcaccactgcactccagcctgggcgacagagcgagactccgtctcaaaataaataaataaataaataaaataaaatgttcagtttctccttcacgctaatcacagttcacgtgcttgacattcacatgcggctagtggctaccatactgggcagtgctcggttaaagactgttttctacagttggactgtgggaaggataaaaattccagaggaaaagtatgggcaaaggcacagaggaggataagcaagcagctcgtccagatgagagtgagggaagaagagagagtgcaagttcgaggcactaggctgtctgggttcaaagacctgctcttccacatactgttgtgaactttgacaaattatttcacctttctatgcctcaggtttctcagctgtagaatagggatactaacccttgctgtgaaaattaagttcacacacacatggtacttctcttagaatgaggctttcaagtgccagtcagtgggccctagaggctggagcaattgccagggcccaggtcataaaggttcagaaattaacgggtgacaggaagcgtggtgaggcagccggatgggaaggagaactcctcttctctggcaaaatgtctcagtctgtctcgtttctcccagcagttttgtcatagttacgaatggtgtttcttctctaggagggaaattccttctcatagctatctctgctcatatagatgtctgtaggcaatagggtgggctggcttccagtgtgggtgaagatggacaaggtcagaccaatccagggagcacgtctttcttgcaggtggacattgcatctgggatggccattgaagggatgtgctatgcccaggtatgtagcaaccagcccatgcctgcttgttaacataggctgggccaggctagagggactttgtatggtacatgaccaattttagaaggttcttctcaacacaaacagtctgaccgcatccatcgtccctcataagtcacctggagtggcttgaggagagccatagtgcttctctctgggacttttccctcaaccatctaatgtactggggttcatcctgcccacttaatgccgagaatcacagaacacaggtccttaagaggaagaaccacatcttttgcctctgtatcagatgccactgtaaagttcaggatggagttgggaggtcaagggcttggttgtagcctgcaggctgtgttcaatgtaggggctgtacacttgggactgacctattaaatctcttactcatgggtgagtaaaaaatgctaatctccacgttaacagatatccaaaatactcctaaggggtcctgggacttggagaaactagtgtgaacctggattcaaagccagatttcttactgcaaagaatttttttctctactgagcagcctcatgtcagaccactgcagacggcagctgagttctcaggaggcatgaaagcagtgtgcaagtggaggctaatgctgatggggcacagagaatacaaaggctggcctgtcttccccaggagacaaagcagccacggaggcttatacctttgcatgcctcaagatcagagtccagagacaatggaaacacttggaccctggccttgtcttgggctggacaagcttaagcaactctttttgggcctgtggccctgctcccccaaaactaatattttgtaccttgttgcagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctg

SEQ ID NO: 38398 - DNA, 13822 bp, Homo sapiens
tcatggctgcgcgtgcagacgtgcgtcatcgccgcgcgccgcgccgagcgaatctcggagtcggtgggtgcagatggcggcggcagttgtggtggcggagggggacagcgactcccggcccggacaggagttgttagtggcctggaacaccgtgagcaccggcctggtgccgccggctgcgctggggctggtgaggcctgggaagagaggggcggccccgcgcggagtttccgggaccgtacgcgctttggggccgctaccctcgggttcatacggctctgtccatcatccgcctctgtcctgtcctgccattttccaccacctttccgtttcgtttcgttcagctccgctgacagcccttccatagcttcggcccaacgtccgggcagcacggacagggggcagcggagtttttgcagcctccccctcagcttcttcccttccccgcctctccccacctctatgttgtgttcccctcgcctcacggttttctgcaccccaggtgtcttcccggaccagcggtgcagtcccgccaaaggaagaggagctccgggcggcggtggaggttctgaggggccacgggctacactcggtcctggaggagtggttcgtggaggtgctgcagaacgatctgcaggccaacatctcccctgagttctggaatgccatctcccaatgcgagaactctgcggatgagccccagtgccttttgctactccttgacgcttttggcctgctggagagccgcctggatccctacctgcgtagcctagagctgctggagaaatggactcgcctgggcttgctgatgggcactggtgctcaggggctgcgagaagaagtccacactatgttgcgcggagtcttgttctttagcacccccagaaccttccaagagatgatccagcgtctgtatgggtgcttcttgagagtctatatgcagagtaagaggaagggggaagggggcacagacccggaactggaaggggagctggacagccggtatgcccgtcgccggtactaccggctcctgcagagcccgctgtgtgcagggtgcagcagtgacaagcaacagtgctggtgtcgccaggctctggagcagttccatcagctcagccaggtcttgtgagtagtctgtcccgatggccatgcccttgctccttctggttccccgctgctcccctgggtccagctggcctcagcagaaagctggtgagccgtcctgataaccaggaacatgacagagagagagtcccagggattcctgtgcagcgtgtcctggacacaggtgtctctcttctgtcactcaccttcagtcccacagattcatgccttgaccctggtaaggccctatgtggcttgtgtctgcagcagcaaatttcttagcaactccaaacttcctggactctgcagaattccactgtgccttttgtcgatcctggggaggaatgattctcaccctcgtcgacattccttgccctgtaattgtgaacagaagcttgctgctgcttctctccaggaagatcaggtcactgtgagggcaagcagtctcttgttagtttggagaggagaggggtttgttgtgagagacaggtcctgttgtagttctctagcaattgtcatacccttggccatttgtggtggttttgtcacattgaacgggggtgtagccatgcagctacttgagaggtcttaggtggactaaaggtggactaaaggagtgctccttttgctggcaggggtcagggagaccgtgaagggcttctgttgggctcatccctgcaaaagttacacggcaacttttctcatcctcctcttgagtccttttgtcactgtagaccagagactgcactgaaaggcacaaacagtggcatctgtacctctgcggccagggtagcagtgcagttggttgtcgtttcagagttgatcctaggagataaggctagggcccccgacagccacacctgctgccactgatcacatggggaaggccagtgtccctacctggatagaggccagctgggcggggacagcagagcctgggagtgctctgtgctcccagtggcttcttgaagcctttggtacaaccgccccccacagctgaggattgtggggaggtgtgtgctgggtgtgtgtgtgtgtgtgtgctgcatgcactctacaggcagggcagtcctggcatggggctgttctgggctagaggggccggtgtgtgctctgggtgccccatggccagggctctcctctagacacaggctcagtctgctggagcgggtcagtgccgaggctgtgaccaccaccctgcaccaggtgacccgggagaggatggaggaccgttgccggggcgagtacgagcgctccttcctgcgtgagttccacaaggtgaggacccctcccttgggctgtgccccgctggagacaggggagtaggtttctggcaaacctgacacctggcttcagaagcatccagagcacggaggcctgggtgggcccagaccgggtggtggctggagctgtcttgatgtggggtagagaccagtacttctgggccctggtgatagcgaggacgcatctgaggtgcgctcttcggatctgcgcagaatcccatggctgcaggcggtatcgggccaggatcccgagggggctacctcaggcaggtgtggcgaagctgggcccaccagaggagccactgaatggatccccttctcctgtttgctgccctacttgagtgtggactcgcttggccggtccctaatggactgacctacagccagcctgcaccacagcggggagcgagacaccctcacatggggcctccaggcacctgtgctgttggggtgtggtctggggctctgctctgggctcccggagccataggggagctgggcccagccatgtgggtccccccatcctgttcccatgtgtcacctgtcctttcctcagtgtttcagagtccccctactgaggtgcagattggctgtgatgttgggttttcaaagagggagggtgtccccaaagcggtgggcaagagtgggtagtagggtggagagggtgaacatccgtgcggtcttgccactgggtagcaggtctgtggggcatgagcacgcctgggccccgcggcggaattgccacctagaggtttgtgctcgcctgggccccccggctggtctcaagggcgtgtttatccatttaagtgggggcaagtgtgcccaccaggcacagcgcacaggtcgtgtgtgtctgtcatgtctcacgctagggttgctgctgccagtgataagtgtgggcactggcgcgtgtgagaggcacgaagactgcaggggggccgggacgtcgccttttgggccatcacccaccctgcaggttttgatgtgctccagcctccagacgcaggtggccttcgggctcccctcggtcccggccgacagggtgggtggccgtgaggctcctcccagcctctgagtcagcccggggctcaccatgcctccctgcagctcacactagcgttctcctgacagtggatcgagcgggtggtcggctggctcggcaaggtgttcctgcaggacggccccgccaggcccgcatctcccgaggccggcaacaccctgcgccgctggcgctgccacgtgcaaaggttcttctaccgcatctacgccagcctgcgcatcgaggagctcttcagcatcgtccgaggtggtcctgccccggccctggggtccgctctcccgtctggggagtcttcccagggccttccccgtgtctcctctgtgtctgcatctgggctccctgtgccttcaccgtgtctgctctgtgtctgcgtctggggctcccagggcctttgccgtgtctgctctgtgtctgcgtctgggctccctgtgtctgcgtcttgggctccctgtgccttcgccgtgtctgctctgtgtctgcgtctgggctccctgtgtctgcgtctgggctccctgtgccttcaccgtgtctgctctgtctgcgtctggggctcccagggccttcgccgtgtctgctctgtctgcgtctgggctccctgtgtctgcgtctggggctcccagggccttcgctgtgtctgctctgtgtctgcatctgggctccctgtgccttcgccgtgtctgctctgtgtctgcgtcttgggctccctgtgccttcaccgtgtctgctctgtgtctgcgtctgggctccctgtgtctgcgtctgggctccccgtgccttcaccgtgtctgctctttgtctgcatctggggctcccagggccttcgtcgtgtctgctctgtgtctgtgtctgggctccttgtgtctgcgtctgggctccctgtgccttcgccgtgtctgctctgtgtctgcatctggggctcccagggccttcgccatgtcggctctgtgtctgcatctgggctccctgtgtccacgtctggggctccctgtgccttcgctgtcgctcttgcaggggggtgcaccgggcagtgctgggactgtccccactgcggcgtcccccgtgcctggatcagggcaggtgtggcagatgctggacagtgcttctgggtgtccactgctgtgctgccttggccttggctcctgctggggactggcccctgggtgttgctctgtccaccctgtggcattgtggtcaaatgcatcagcacgccagagtgtcggggggatgtctggtgcctagcaggtggtctcatcatcgtcctggggctggcaagcacgtgtcctttcccacaccgcacacactctgcaccagcctgcacgtgcgcacgcatccatgtctgtccctgagggatgttcttcttcttgtagacttcccagactcccggccagccatcgaggacctcaagtactgcctggagaggacggaccagaggcagcagctgctcgtgtccctcaaggctgccctggagactcggctcctgcatccaggtgctgtgtgctgcccggccacccagcactctgggcttagacactcaccaggggacccatgtccagggagcctggggcctagtctgccagccctggacttgtaggtctaaggaagaaatgggttgagaagcaattggtgaggtccttaggggatctgaggtgcccgtcagcttgcttgtttcttctttggagggagtcaggactgaccggtaggtctgaggtgatgagacttagttctctcagaacagacctccctgcagggcgggacctgtgaacaggtagaggtggggatggggggacaagggaacgaggctgcagtggggacctgtagaccacctaccggcatggccagctgtctactcgggtgttgcccctgggaggctgtggtcccgggcactgcatgactgctggcttctgccctggctgtaggcgtcaacacgtgtgacatcatcaccctctatatctctgccatcaaggcgctgcgcgtgctggacccttccatggtcatcctggaggtggcctgtgagcctatccgccgctacctgaggtgagggctgcagctggcccaggagccactgggaccctgggcatcctgctgagctcctcgtggtcctggggggcagccggagggtgtgttcggccgtcaggacacaaggtctcccccggctgggctgagtgcacgggatcaggcccgaggctctttcctttcctcttgcccgtgccgggcacctgtccttgtcacacggtgtcaccgtgccctctgtgtgcagctgccagaggcccaccacagcccttcctcagcctccccatctccagcacagagagaagctcttccacttggcctcgccttggtgctgaccagtccccaaggccgaccaggcaaggggagtgggctctgctgtcctggcctttcccacggcaaggaacagacactcctggggctgttcggtggagaatgtgttgggatgaggaccttgacatggctgcctgggaattcctcaggggtcgcagaggccctggcccggggctggcaggcacagtggcccccaggagccgagcagcaggagccggtggagtctggcccctacctggactcctttggtgctttgtggctgtaactggcctggcttctgagccagttctttgttttttcttttttttttgagatggagtctcactctttcgcccaggctggagtgcagtggcacgatctctgctcactgcaagctccgcctcccgggttcacgccattctcctgcctcagcctcccgagtaactgagactacaggccgccaccaagcctggctaactttttgtatttttaatagagatggggtttcaccatgttagccaggatagtcttgatctcctgacctcgtgatccgcctgcctcggcctcctgaagtgctgggattacaggcgtgagccaccgtgcccggcccttttttctttttctttttcttttttttgaggcaggctctcgctctgttggagtgcagtggcagaatcctgtctccctgcagcctcggacacctgggcttaggtcttctggcttagtgtccctatgtgctgggattgcaggtgcgcaggccggccttgcgctcgcagctcctgctgctcccaagtaacgttgggtttatttgtttttaaggagtctgacgggcctgtgtttagtacatagcccatcaccactgagtgtagaggcagggtcggtggtgctggcctagatggggccgggactggaatgagtggtgggaggtgcgcgcggggtgtccacactgtgggccacagcagcactcacatcggcaggacgcgggaggacacagtgcggcagattgtggctgggctgacgggggactcggacgggacaggggacctggctgttgagctgtccaagaccgacccggcgagcctggagacaggccaggacagtgaggatgactcaggcgagccagaggactgggtcccggaccctgtggatgccgatccaggttagcttgccccacatggtccctttcaccagtgtggggggcgcttcagccaggccgtccgctctggactcatcccttgtcacagagcttggctgtgtcaggtgtcgctagtgtctcagaggcttgagggtgtcaaaggtcagggcagtgctccgccacctgccagcctgggcaggccggtgatgggctgttttcctctgtggctggtcactctggccgtgggggatgccctgcctcccaccgcttgtgagctgtggggtgtccctgccccgccactgcacctggcagaggagtgaagatgtgggtgacccctgagctctgtactgatttgggcctcaaagtcccgttagggtgccagctcctgctcagagcccatctgtgcctggccctcgtctgcgagggctctgagggctatggggcccaggcctggcccctgccctggcacagatggtaagtcttcaacacatctttagtctctctcagaggaaaaccccaggacctttggcttgtcccctaagcctgcatgggagtcccggaaggtccctgtggggtgagaggggctggggattgaagctgttgctccaggacctgactccaggtctcccgggaggctcagggctgctcccagcctcgagggccttcaggaagagccatgctgggctgtgccgtctggctgggcgggatgggaggagggcggccctgtccttgcccaggtgcctgtcaggtgacacccctgcccccaccatgccagggaagtcgagctccaagcggcgttcatcggacatcatcagcctgctggtcagcatctacggcagcaaggacctcttcatcaatgagtaccgctcgctgctggccgaccgcctgctgcaccagttcagcttcagccccgagcggtgaggcctgtgacgcgctggccatctccaggggtgccggggcctttgcccagcctctctcgggacagggccctgacgccgtgcctggggcctggttggagctgtgcttccgcccccactcctggctgggggtgtgctagccattggggtgcccacacaggctccctgctctgcctggggggcacccccgtgccctgccacaggtgctccttggggctggggctcatcacgaccccctgcccagacactcgtctttccagggagatccgcaacgtggagctgctgaagctgcgctttggcgaggccccaatgcacttctgtgaagtcatgctgaaggtgggtcccagccccgcccgctgcccggccgccccgcaggtcccccgtgacaccggctcctcctcaggacatggcggactcccgccgcatcaatgccaacatccgggaggaggatgagaagcggccagcagaggagcagccaccgttcggggtctacgctgtcatcctgtccagtgagttctggccgcccttcaaggacgagaagctggaggtccccgaggatatcagggcagccctggaggcttactgcaagaagtatgagcagctcaaggtacctccatgccaggccaccccatgggctcttggcacccctaccctgcactgcggggctcccagcagcctggtgcctgtggctgccccgttgtcacccgagtgtctctgggttggtcctgtctcgcagccgcctctgcaggagagggagtgggcctggcccacgctctctccgccttcctcccagcaaccccgtgtcccctgtgagcgagcgtccgcgcggcccacaggcgcttgggtgggctgtgctgggcccaggtctcctgaactgcttcagggggacccctgtggccacagcaggccctgccctctgagcgtttcctcctcttttgctatccaccctctgcctctcagaaccggggcttggggtgccttgcgtcactgcagggaggcagctagggagccagggctgccctctgcccagggcagcactcccaggcgcacctgacccccaggaccccagccctgcccccttctccaggtctgtttcctcgagaactgcctttgcaggctccagtggtacttgaggaccggggctatgggtctgtggtgggagtaggaggggagcagatgtggggagtggaggagtgagccctggcctggaggtcactggcagatggggacagtgtgcccagaggatggtattggccacgtttggctcacttcccctggcagcactgctgagatcccagcagtcccagtacaggcgtccagagcctgagggatggaactaggcttggcggttctttccctgagctcatagtcaggtgggaggtgtcagctcggggaggaagggttaggatggtcgtcacaggtgggaggtgtcggctcggggaggaaggggtcgggatggtcgtcacaggcgggttccagggctttctgtctgatgtgtggggcctgtgaggcctccagtgtgcccagcgagtgctcaggactggggggaggcgggcaccccagcgggggacatgtgaggagagggttctggggcacagccagcatccagtctgcagaccccaaccccaggtaccccaggaaggggatggtccagcctcggcccaggcaggaggagcagcctcaggacagagccgccaggaggccggcgggcgggcggggctgagttcaagggagggtccacagcttctccaggtctgctgtgaaggaggctggacctagatgtgttttcctttttcttttgcaagtaagagggccttgctgtgttgacaaaccaagggaacttactcctaggggagggcagggcgatgtgtccactttagaaaccaagggggaagcttccttccggagacagacaaggggagggccaggcggaggcccccagggcaggaggccaaggggctgtggtagggccgggctgctgaccatggtggcgaatgcctgctgcctccctccaggcctcagcttggctctggaagagtccaggtgtcccttgcagcttgtggagggtctgtgtggcttgcacctgctctcggtggaaaggagcaccctggccatccccacacctcgagctctggcctgtgatacagcctggtgtctctggagcctgcgggcaccgtgccccgctgtgttctggtacaaatcatccgtgtggcccggctccgtgctcggtccctttccccctgcccctctggctgcctcaggctctccagcgttgcttccaggcaaggccccaatggcctccctccagggtcctgccttgggtcccaggcatgactcagccacttcctgttgctcaggcctgatgtgctgggacagccacactctagtgccctttgtcttaacttcagtgggacacaggagtggctcagggaggccccggggctgtgctgagaggtcccaccagcagagctcctggccgagcgaccttgttggacacgtggctggccatgcagcccacagcgtcacccctgagcccttgcatgtgtcctgcggcaggctgaccagtggcggcgtttgtggaggtcatggccttggagccagaactaggacctagcaagccactgactccacttccattttctgtccataaagaggggtttgtttccattagaagctgccggatcctggaaggactcaggagcccttggcccacagagcaggtgtgtcagtgccccagtgctaccagaacaaagtaccacaaaccagcgggcttaaaagaaacatatcattttacagaagtcagaagtctaaagtcagggtcagcagggccctccgaaggctctaggggaggctgcttcctcccctcttccagcttctgggggctccaggagctccggggcctgtgggtgcctcgctctggtctctgccgcgtcgcccgtgatgttcccccgtgtctctgttcctatctccctcttagaagaacactctctctattccagggtgacgtcatcttaattatatctttaatgaccgtatttccaaataagatctcatcagaggcaccgggagttaggggttcatgtgtcatttttcgaggggcacaattcagtgcatgacaatttgccccatggtgggcccctcccacgtgcaagtgacagccccagtgtccccaaaagtcttcaccatttcagcatcaactccaagtccaaaatctcatctaactaccatccacacaaagttccacacacatctcagcctgtaaatgcatcttaacgaggtccaggtgaggctggagtgtgcgccattcctctacgtaaatagatctaaacaaggtacaggtgaggctggagtgcgcgccattcctccagctgggacgccgtgaaatcagccaacagatgatctgtttcaaaagttcagccgtaagacaagcatacacattcccaccccaaaagggaaaactgggaggaaaaaggacagcgagtccaaacccagcagccgaaattccacttgacttccaggcctgcgaatcctctttggccccctgctccgtcagccttggcctcggcggctctgctcttggagcctgccttcctttcactccagcctggcagcacttctgcgggtgtaaaattctcacaccttgttggcttatgcagctcaccagtgccgaagccttcagacaggcgggtccgcagccctttcccggaggccccacctgtccctgtctgctgctgagatggttagttggatacacaggtcacacctcatgtctagcaaaccctggtccagccacacccttggccacgtctcagagctgcctggatagagtatttttcagatccccaagggctggtgcctttttgcttaatggtccctgcctcactgattgtttccctcttgcattctgctataagtagcaaggagaagccaggtggcaccttccacactgcttggaaatctcagcttgatgtccaggctcatcagctgcaggtcccacttcgcacccaacagcagagcagcagccagccaagctctctgctgcctcctccggttcccagtagcacggtcatttccatctgagacctcactggaagcacctgttgggtcggcattgctgccgacatccagtctgtgatgctgtgtgcattctccaagacggcggcagctctcctcttccagccatttccaggcttgtcttcatgcctttctaccagcagtcgtgcaggcctcaccagttcttccagcctctccccatcacccacttccaaagctgctgccacagttcttggtgttaggttttggcagcacccctcctggcccttcctggtaccaaaatctgttcgtttactgtggctgctgtaacaaagtgtcacaaactgggtggcttaaaaaacagaaatagattgtcttagttttggaggctggaagtccaagatgaaagtactggcagccccgttccctctgaaccctcttagagacctccgttgccccccagcttctggtgtttgccacagcccttggtgtttcttggcttgtggccgcgttgctccaggtggtctctgtcttcgtgtggccccctccccgcctgcctgtgtcttcctatctttccttttcttagaaggaccccagtcagttgggttaggatgcacctcagttacatctgcatcaaccctgtttgcaaatatggccacatttccaagcactgggggtcaggaggcccctgtagccttttcgggacacaccttatgatgctggccccattgcccttccatggtggctgagcaggtggggaccccacccagtcctgtgctctcgctgctcacctgcctgccagggtggggtggggcaggtggctctgggagcccctttctcactggtaccaggtggcagagcccacgggcctgagcgccctgcagccgagctgcccgtgctgaccctggccctccttaggccatgcggaccctcagttggaagcacaccctgggcctggtgaccatggacgtggagctggccgaccgcacgctgtctgtggcggtcaccccagtacaggcggtgatcttgctgtattttcaggaccaaggtgagcccaccagcccctagctggcctgccccggccacacggcccagctgtgggtgaggggctgttccccagtgagggtgtggtttggggcagctgcgccagcaggcggcacccttccctttcccacgggcaaggcagggtggcccgggagccccccgacctctcggctgacgggaggcaggggaggtgcagcccgtgcccaggctgcccagcgtcccggtgactctgcacgcagccagctggaccctggaggaactgagcaaggcggtgaagatgcccgtggcgctgctgcggcggcggatgtccgtgtggctgcagcagggtgtgctgcgtgaggagccccccggcaccttctctgtcattgaggaggagcggcctcaggaccgggacaacatggtgctcattgacagtgacgacgagagcgactccggcatggcctcccaggccgaccagaaggaggaggagctgctggtgcgcgtgcaggccccacggggggccagggggcgggggcgaggcctgcaggtgcctgacgggggctggcctgtgtccgcagctcttctggacgtacatccaggccatgctgaccaacctggagagcctctcactggatcgtatctacaacatgctccgcatgtttgtggtgactgggcctgcactggccgagattgacctgcaggagctgcagggctacctgcagaagaaggtgcgggaccagcagctcgtctactcggccggcgtctaccgcctgcccaagaactgcagctgacacatcgcccgcccgcccgcccgcccgccaggcgctgccctgcaggtgctctcgtcctcccgtgccagcccccgcccgcccgtgtcccagaatgcactgctgaggagcatgcccacccccacccccgcagtgtgcagattaaagcaagtcagatcatc

SEQ ID NO: 38399 - DNA, 20629 bp, Homo sapiens
ccgtagcgacgccgcggtccgccggatctccagcgctcagtccgcgccgcaggtggtgcttgtctgcagagtcatgacctgtaagtggcgcggccgcgcgctgcagctcgagttcgggccgcgggggaggctttggagcggcgccggcggtggctcggccggctcagcccctccgccccgcgtccccgccgtgcgcggccttccctgaggcgggcgtccgcgtgggtccgggatcgcgtggccgggcggccgggcgcactcccgggattccaggcttccggggtggcgggcgaggcccagaaagcaccaggccacccggccgcgccggcacccgccgcgtcctgcttgacagaggctgatggacgtgtatttctccacggtgtgggccgcggtggtaggatccaactcccttgggtgttttcaagttgcgtgacctcctccagccccgccctgcacaaaggtgcccaggcggttcttcgtctccccactcactttccagctccagattttgacttggattcttgctgtgtcacttactttgttcagtgactttgtgcagctttccccctgcaagtcccctgtttctttatttgtaaaatgatgttaatgatacctcacacaatgatgttaatgtgtgaaggacctggcacattgctttaaatgttattcctttgttgtttccttcgctcacagtattttattctttttttccgccccttggtaaggtcttcgttgttagattatgatgaatattagggcagccttaaaagtcttcactttacagatgagatggagtgacgggcgtctcctcctcagcatgaggaactgcccagtggcggggtttccctgctgcagcatgtctgtagagtgggtcatttgcagaatgataggcagtcctaagcttagttgaggaccccgcccttgtgggtgagatgtgtaggagaggaagccatcagcgtagccatggtgagctttatctttcccaccctcggaagcacagacatggcccggcacgtggctcacgcctgtaatcccaacagtttgggaagctgaggcacgaggatcgcttgagttcacgagtcaagagttggagaccagcctgggcaacatggcgacaccttgtctgtactaaaaaatacaaaattagcccggtgtggtggcacgcccctttagtcccaaactacttgggaagctgaggagggagaatggcttaacgctgggaaatggaggggagacgtttagtggatttatctgctgttctgataacagctcaaaatatctgtttgccccagaataatcccagcttttatttcctgttttagtttcccttcagattctataactatttagcaggctgccttcagggttaaatttagtgcttctcactatatttaggatagatcaaggaatgggacatctgagttttccttttagttaaccctgagccaaacaggccttcatcagaggccagggtttgtcattgttgccttttctggagacatttgcgttgttacaggaaacacccaaaagagatagctctctaatggtaggattttcagactctggagcagaggtgggatgggaagttcgggcaggccattactaattgaaggggtgggttgcccctccacacctgtgggtgtttctcgttaggtggaacgagagacttggaaaagaaaaagacacaaacaaagtatagagaaagaagtaggggggcccaggggaccagcgttcggcatacggaggatcccgtcggcctctgagttcccttagtatttatgatcattcttgggtgtttctcggagagggggatgtggcagggtcataggataatagtggagagaaggtcagcagataaacacgtgaacaaaggtctctgcatcatgaacaaggtaaagaattaagtgctgtgctttagatatgcatacacataaacatctcaatgtcttaaagagcagtattgctgcccgcctgtcccccttccagccctaaggcggttttccctatcttagtagatgggacatagaatcgggttttataccgagacattccgttgcccagggacgggcaggagacagatgcctgccttcctcttgtctcaactgcaaagaggcgttccttcctcttgcactaatcctcctcagcacagaccctttacgggtgtcgggctgggggacggtcaggtctttcccttcccacgaggccatatttcagactatcacatggggagaaaccttggagaatacctggctttcctaggcagaggtccctgcggccttccgcagtgtttgtgtccctgggtacttgagattagggagtggtgatgactcttaaggagcatgctgccttcatgcatctgtaacaaagcacatcttgcacagcccttaatccatttaaccctgagtggacacagcacatgtttcagagagctcggggttgggagtaaggttatagtttaacagcatctcaaggcagaagaatttttcgtagtacagaacaaaatggagtctcctatgtctacttctttctacacagacacagtaataatctgatcgctctttcttttccctacactaataattcctgaagttttgcagagcttcatagattataatgtgctttggatcctttactgctgcgtcccaccagaccataagcaggaactatgtatccatcagggtccagacaggacatggaaacaacactagtaactcgaacaaggaaaattatttatttatttatttatttttttggagactgagtctcactctgtcgtccaggctggagtgcagtggcgcgatcttggctcactgtaacctccaactcccaggttcaactgattctcctgcctcagcctcctgagtagctgggattacaggtgcccaccaccacacctggctaatttttgtatttttagtagagacggggtttcaccacgttggccaggctggtctgaaactcctgacctcaggtgatcacctgccttggcctcccaaagtgctgggattacaggcgtgagccatcacacccggcggaaaattttatataaaaaattattatctggccaggcgtggtggctcatgcttataatcgcagcagtttgagaggctgaggcaggaggatcgcttgagcccaggagttcgagaccagcctgggcaacaaagtgagaccctgtctctacaaaaaattacataattaaaaaattagcccggcatggtggtgcatacctgtggtcccagctacataagaggctgagacaagaggattgcctgaactgagtaggtcaaggctgcagtggaccatgtttgtgccactgcactccagcctaggcgacagaacaaggccctgcctcaaaataaaaaatattagctaatggaaagtgattatcataaaagctaaaagggaactttaaagaacagaagaaaagcaaatatgatgtatagctactacctccaggaagaaataagcttggaagagcccccaacctccttgctccagggctgagcacagaccttgtcagggctggctacataatttgtggggcccagttcccttgttcagatagcaagagaaaagtgctgttagcttttccttctgcagtatctctttcaacctctcatggtgttatttgctgtttaatatcatgttctcttggacacatgaatacttatggggtaagtgcagacttttagaggtgcctgggacccctgtcctgtgaataggcatgtgtgcagctcactggctgccaggttttccctctgccagcagcgggatcgatgtgctgtgacccagccagtagtggggaaactgagacagacatcttcccttcccatgagctgggctgctcatgggaattatgtgagcagcttccaaggaatcacactttctgtgctgggacatactcagtatatggattggaggtagacgagaggcccatgaacaaacagtaagggacaggaccatattcaaacccagtctttttactttaagccatattctcatttcattccctacactgcgtagtaagaagctggttcactctagattcttgtgcctggcatgggactttgcccatggatattgctctatctccagatagattttagactattgacattttggacaggataattcttcgttgtgttatggagggggttgtcctatgcattgtaggatgtttggcagtatccttggtctctattcattagatgccactcatacctcatcagttgtggcatcaaaggtatcttcagacattgtcagatgtccccccggggacataactgccttccatttgagaactatggctctgtctgaatccagcagttcgatcttctgatagctgttttcttttgtctttgttctcagctttccgcttggccctcatccagcttcagatttcttccatcaaatcagataacgtcactcgcgcttgtagcttcatccgggaggcagcaacgcaaggagccaaaatagtttctttgccggtcagtatgggagcagccattctgttctagccactgtacacccaagcagaacggtgtttgctagctctggttgtcctcttgtatcctggggtccagcagtgtcccttggagcccatagattgttccgagtctgactggaggatgaccttagcaaggttctttgtgagataggatgtgccaacacggtcataggtctttaggttttggatcttcctctttgttcagatgaggaagccaaaatcctagtatattgagggacttacggaaaactaaaatactcagtgcttggatactttgttccttatttaactaagtctttatagaaccagaacatattggttttagcactaagcctccaacattttttttttaaatgagctctgggagaacacctgtgatttgtctcctccaacccactaggctagctttgtagtcttacctgtggctacaggctctttacccttgagatgtcagtgtttttcttattagctgtgttttaacccttcgactgaaagcagagctagaagcagcagctatggcctcttacagcagaactttaaaatgggtgggtgttttgatctttttttttctctgccaatatttttctaggaatgctttaattctccatatggagcgaaatattttcctgaatatgcagagaaaattcctggtgaatccacacagaagctttctgaagtagcaaaggaatgcagcatatatctcattggaggtaacttcctacccacaaggtataatgacctaaacattagaaacatctgaatgagtcaggtgtggtggcgtgcgcctgtattccctacttgggaagcttcagcttgggaagctgaagcagagagtttctttttcttatttatttattttttttgaggtgaggtcttgctttgtcacccgtgctagagtacagtggtgtgatcatggcccactgcagcctcaccctacgaggctcaagtgattctcccacctcctgagtagctaggactgcaggtgtgcgccaccatgcctggctgatttttgtatttttttgtaaagacagagtttcaccttgttgcccaggctggttttgaactcctaggctcaagcagtctgcccaccttggccttccaaagtgctaggattacaggtgtgagccatcatgccaggactgttttttactatactaatagaggattgagaaaaaaaatttttttccatagaggccacatacataaaggtagctttatttttgtggttttggaataaatgtttaaaggttttatttgcttaaataaaaaataaacacagaaaaattctataaatatagcaaatacaattttttctgtatgatgatatattaagaattagaaatgaaggcaaagcaagaagcctggagatgaaactgcattcagtgatggagaggcttctgactttacgttctcatcttttgggacacagttttgttgcagaacctggtgaattcaagttaagcaatgggaaatttctcattttgccctaatgttacagattaagtgttactcaagatcatggctgaatttcaggaacagtttggttattttttaaacctgtctttggcatctaacctaatcatatcccatctacactctggagtttatctctgaaagatcatattcaagaaggaaaaaaaaaaccatgattaagtaacccatagaagggaatacttattctgtattatagaatgaggtgttgccttattctaaaaacaaaatgaataaataaaccgtaaaagataggttctttatttttggacccaagttatcaggcttttatccctttctcacaaaagaattgctctattctttttcttatggtatgtttcttctctcaatgaaaggctctatccctgaagaggatgctgggaaattatataacacctgtgctgtgtttgggcctgatggaactttactagcaaagtatagaaaggtaagtaggaagtgtggcataagaatttgttatctctaagccagcaacaatgtgtggaaaaaaaatttgctatgaagttccctagtccctctcattatatcacacatgtattagggttttgactgattggcacaggtggttattcttggccatttgcatttttatataagttttagactcagcctgtcaatttctgcaaaggaacaagctatagtaattttttttttgacagaatctcgctctgtcacccaggctggagtatagtggcacaatcttggctcactgctagctctgcctcctgggttcacaccattctcctgcctcagcctcccgagtagctgggactacaggtgcccaccaccatgcccagctaattttttgtatttttagtagagacttggtttcaccgtgttagccaggatggtctcaatctcctgacctcatgatccacccgcctcagcctcctaaagtgctgggattacaggcatgagccaccgtgcccagccaacctatagtaatttttattagtatttcattgaatatatagagaacactgtgggaagagttgccatctttttagtattaaatgcgtatacatgaccaggtgcagtggcccatgcctgtaatcccagcactttgggaggtctgagtaagtggatcacctgaggtcaggagttcaagaccagcctggccaacatggtgaaaccccatctctactaaaaatacaaaattggctgggtgtagtggtgcacacctatatagtcccagctactcaggaagctgagacaggagaattgcttgaacccaggaggtggacgctgcagtgagccaagattgcgccactgcactccaacctgggcaagacagagcaagactccatctcaaaaaaaaaaatcatatacatttagtatcattaagtcttcttgatgagttgacccttttatcattatgaaatatctcttttttttcttgtaatacctcttgtcttgaattctgctttatctctgctatcactatagccactccagccttcttatgcctaatgtttgctggtacgtggtttttccagttctttgttctcaagctatatgtgtttttatattttaagtggatctcttttgtcaacagcatataattgtatcttaattttttctttattctgacaatctgtgtcttttaattgaagtggttagtccatttatatttaatgcacttattgatatgattgaatttagggatagagacattttacttttttttccctttgttcatcttttctgtattattttggattaattgaatattttttagagttctgttttaatttatctattggctttttagttatacatcttagctttttttttttttccagttgttgccctgggaattatcatatgcatccttaacttttcacaggctacttaagagttcatattatatcatttcatgtgaaatttaagaaccttataatgatataggtccatttttctaccccactgcccctgccctcattctttatgctatagttgtcatttgtattccatgtatatatgttataaatcccacaaaacaggaatacttgatttaaatagtcatatgtattttaaggaaattaagaagaaaaaaatctttatgtttacccaaatatttatcatttctggtgtttttctttccttcctgaagatcctccttctatctggtatatccttcagaccaaaggatctcatttagaatttttgttctgaggatctgttagctaggaattctgttagtttttctttatgaatatatctttacattgttttcattcttgaaagatatttttgctggaatagaattttggattgatagttttcctttttttccactagtagttgttatctagcctttttttttttcttccctgatgagaagtgagtagtaatttgtattgttccctcggatataatttgttgttttttctctccttctttcaagtgttttcataatctttagttcttagtattttgactctgatatgcctagatgtggtttcctttgtctttgccttccttggtacttcttgaaactgtaaatttaaatctttcactgtgtttgggaagttttttgacactattttgttaaatatttttctgttcctttttcttatggagctccagtatatgtatattatatttttaaatatttttccaaggtcaccaggctctgtttttctgtttttgtctttccaatactttttccttctcttctacagattagataatttctgttgatctttcagacttattcactgtttcttctgtcttcttcaatttcccgtaagccaacccagtgaaattttaaaaaattgagatattaaaattttcagttctgaaatacccctttgcttcttttttatagtttttattactctatgatattttctatttgttcattaaaagcatatttttctttacagtgttgagcttagttagtttctatagctgctttaaagtctgataattatcacatctgtgtgccacagaatgagactattaggcctttaaaaggcccctgatgtaaataaactcatatccaagcaaacaacaagaaaaaaattataacatctgggtcatggcaggatctgtgttcatttgattgccttttctttgcagtttggatcacacttctgtttctttgagtatctactaatttaagattgtacagtggattatatattgtagagattcaagatgctattacagtcttccaaaaagtgttgaatattttgttttaactgatggttaacttggccgcacccaaacaccaaactcttatcttctttgaaacgtgggcagcaactttagctgctctgttctatctggttgttctgccccacttctatttaactcagtgatcagccagagatttagaaagattttatatgcagaatttagggctctccctctttgctttctccatttcaggatttccccccttggtttccagctctggttcttcaagccagtgtgattatgggtcattttcaccactacttatcacagcaactgggaccttgcttcagggtagcagctgtaaatagcaccaggaagttcacccagggctgttccctgcttccacatgtctgtgttcttctcttcagattttgtctgctttgttttggtcattcttcagtgctttaagtagttgtgccttttattttgtccagagttcatagttaaccacaagaaaactggtctgataggagctactgtgtacctgctggaagaacagccagcattggactattaacccaactctttgaagtatatctttttagtattaagttttccagtccatgaatgtggtatatatcctgacatttattacgctttctttactttctctcaatttctttttatagttttttgggtataattttgtttaacatttgtgagatttattcctcattggtgtttttagatgctctttcattttctgtttttgtttttgtttttttgagatggagtcttgctctgtcgcttaggctggagtgcagtggtgtgatcttggctcactgcaacctccacctccctggttcaagctgttctcttctttcagcttcccaagtggctgggattataggcatgcaccaccatgtctggcaaatttttgtatttttagtagagacggggtttcaccatgttggccaggctggtcttgaactcctgacctcaggtgatttttaaatgcccacctactttccacctctcctgtcaatttgtcagtttgattctgataagtattttttttttctttttttttttgagagagagagtcttgctctgtcacccaggctggagtgcaatggcgtgatctcggctcactgcaacctccacctcccaggtttgagcaattctcctgcctcagcctcctgggtagctgggactacaggcacgcacaaccacccccggctaatttttttttctatttttagtagagacaaggtttcactactttggccaggctggtctcgaacccctgacctcaggtgatccgcccacctcggcctcccaaagtgctgggattacaggcatgagccaccgtgtccggcctgattctgagaagtctttatttagcatttatatttttaaaaagcaacatattagttacctcccatgagaaacctagaggttgatttgcagactgctagaaaataggggttataaaaggtacagtatcatttttccagttccctgtggtagaattcattttgataaggtgtcagccagcttgtggggtggattataagcagtttgggggtgctgtttgtatagttaatcttagagcaccttccgtatctgcccggggaaagatattgtcattactgccatggaccctgctggaaaagaggtaaccaaatccattatttgtgatgcagatccatctgtttgacattgatgttcctggaaaaattacatttcaagaatctaaaacattgagtccgggtgatagtttctccacatttgatactcgtatgtaccagataagtttgcctctttagcaatctcagtagaagacaatcaggtatttatttcttttttgtctctctccgatttcttcacataacctaactgaaagaccataagtgagaaaggcagagaatcatcacagatctggaaagttcgggcttatttgagaactaaggatttgacacgattttgccctttgatttgattgtagcttcctgttacggcttccagagtatacctattaggctacagttgagtacctcccatctagataataagcattcaattagaatgaatttctcatctttactccgctgatgtaaatgatgtctttatgagatgaagtccaagtaggaatgagcttgtaaattatctctgtcctcaggtcctgtgttaatttatccctgtcagtgttttgtgatcattatgtcatggaggatttcccctgccacaccatgctgtagggagttaacttttcatttgtgcattttctgtttggaaacagcttactgcagagtgggtctgggcatctgctacgacatgcggtttgcagagcttgcacaaatctacgcacagagaggtgaggcagtgtaatagctgtgttatgtgggtgcttggaggcttggttctaggctggtctatgtgggatccttagtcaagaaaagctgggagagggctctttaatttctccatcttcagccctttcacccccatgaggcttcccagacttttgctgtgtatggatgacagggtttttggggggttgtaattaaacacatcatgtagctaaggtaggagctgtgctcataaaggtctggtctacccttgagtccttgttactgtgtttggagagtcacttgaagcccagtagaaatgaagtggatttcaccactcagtacccctagacattgggtacaagtagaaatgtggtctgtgatattttggtccagacgaggagaaatgtgccagtatctgggaagagcgagttcaaaagatgtgggttctagttccaactcttccctttaattggcacagtactttgctaaaatgatttcacctctagagcagtgtggttctcagtttagtcacaggaatgatatgaggattaagaagagagaacctataaagcccctcgtgtggtactcaacaaataccagcatccttactagactgcttgaagctacttccaaatagactgtcacttaaccaagtgaagtgggtggaaatggtttgactgcctgctcagaaggtggaggtgcatgggctctggggtcagtagtctctgttgagccatatatcaataagccttagggcaactcctcggcccctaatttcagttgaaaagaattacaaaacgtggtcattggccatgtggagctgacatatggagctgagataaatttgtttttttttgtttgtttgtttgtttgtttttttgagacagagtttagctcttgtcgcccaggctggagtgcaatggtgcaatctcgactcactgcaacctccacctcccaggttcaagtgattctcctgtctcagcctcctgagtagctgggattacaggtgcccaccaccaggcccagctaatttttgtatttttagtagttatggggtttcaccgtgttggccagactggtcttgaactcctgacttcaggtgatctacccgcctcggcctcccaaagtgctgggattacaggcatgagccaccgcacccagccagagctgagagaaatttgaatgacagttctctaccttatttttgtttgtttgttttgaggcagggtctcactgtcacccaggctagagtgcaggcgtgatcatggctcactgaagccttggtctcctggactcaagtgatcctcccacctcagcctcccaagtagctgggactctaggcatgtgccaccacacctggctaatttttaaattttttgtagagatggggtctctctatgtcgcccaggctttccgtcctttttttaagtgaagttgataccggtgggctaggggaggcccccaaacaccagtctgaccttgaccccagccagtgtccatgctattgacactattgcaagaaggaattcaaggatgagtcagaaaatagtggaagtatggagatttattgcaaagtgaaaagtacacactcaaaaaagggagggtgtgtgtactcaagagagtcatgcgcaaggaggtttgggccatctacctttatgggtttcctttttttttttgagacagagtctcaatctgttgcccaggctggagtgcagtggtgcgatcttggctcactgcaacttctgcttcacagattcaagcaattctcctgcctcagcctccccagtagctgggattataggcgctcgccaccacgcccagctaattttttgtatttttaatagaggtagggtttcatcatgttggccaggctggtctcgaactcctgacctcaggtgatctgcccacctcggcctcccaaagtgctgggattacaggcgtgagccagcgcacccaccgcctttatgagtttctttaccaaggggtgaaatattcatgacgcttcctagaaaaaggtggagatttctcggaattgtgccactcattttttcaccaaatacgggtgttccagaaactatcatggcacgggtgggtgtgtgatttagtatgttaatgagcttataatgaggataatgaagtcctaggtgaaacctaggtcaaacccagcaccatattgagtccactgggtcttagccctagtttctcagggtcttagcccctagcgtaggcagctatttcaacagtttctttttgctagtcatatgaaactgctgcctggaattttctgttctcttgcgaccgtcctgtattatttctgtctcaaagtcacatgtgattttggtcatcaacaccacttttcttgtgtgtccatatgtgtgtgacttacgtgttcgtattaaaggaattcagagccatatcttaattgctgctggcactgtctgacttggctgacatctttttatgtttgggaaagtttgagttcagttcctgctagataaggaacagtggggaggactggttttgttgagtgctcactgcatccactgttctttggcttttctctccccaaggctgccagctgttggtatatccaggagcttttaatctgaccactggaccagcccattgggagttacttcagcgaagccggtaagaaaggaaccatatattcaagcctctcggcatgtcctctttgtagaaagatttccggttgggtggaggtgccagccttcctgatgtggattctgtccctgactcaggatgcccttgtatccaaatgcagttggaaaggatgaagctataaggaggacttctactgcacgtcactttctcctcagaagccacaataccaacctcatggattttggaaactgtacttttttttttttttttttctttttaagagacgggtcttaccattgcccaggctggagtgcagtggtgtaatcatagctcattacagccttgaaatcctgggctcaagagatcgtcctgcctcagcctcctgagtagctgggactacaaacatgcgccaccatgccttgctaattttttattttttgtagagatagagcctcactctgttgatcaagctggtctcaatctcctggcctcaagcgatcttcccgcctcagcttttcaaagtgctgggattacaggtgtgagccccaagccctgccggaactgtggttttggcattttcaatattcagtgtattagatgggaagggatttcatttttctgtgattagatgtggattggtccctcttaagtcagttccagcaacttttacagagaaattgagaaccacagagcttatgtcttcagagccccagaagccaattaaaaggcagggattagtttagcttgacctagggagagatttgtggtctgtacccagctgattctatgccattcagatcaggatgcttatcctaccccctccttcacaccatcctactagtcctgagggtactgtgccaagaaactcatgagaagctcttgttcttctaacctataactccagggctttgcacaagcatctttggcaggtcacaggtgcctttccttagtcttctaaggctgagaggtggtgaagggcaaatagcataggtggacataagatggaagggaaaatgaatgtgactgtgagtgtgtctgtctgtctgtaaagtgctctacagcccatgaaatgctggtctgagatgatggttttctttagaatttttaaaagttgaagtaatacaaaaaaagtgtactaattttaagcatagaggttggtgaatttttgtgtattcacctgccaccaagatgaacataacagaacatttccagcccccgaggatgctcccttttttgcccctttctagttagtactcctccctctgcctagaggtagctgctgttctcacttctagagatggtggtaatgtttaatgtaagggaaagaggttttagctggttgcatggtggaagatgggggtaggggtataagatgccatgagtatcagtgaaggtacagttttgtcaaaagtgagaagtttctgggatactgagatgacccagcatgggtctgttaagtctcgagggctccgaggtgaggtgctttggtgtacctggactgcgagctgcaatttttgttctatttgaggtggtgggactgccaccatgggcatggaagcgccatgtggcctgcaaggtgtattgctctcataaggccactccattctctccggccaccttgacttgctttaaccagagaagctcttctcttatgttagcttatagcaggctttctcagcagtggcactgttgacatttaggtgtgtaattctttgtgtgggggctgtcctgtgcatggtaggatgtttagcagcatctgtggcctctacctgctcgatgtcagtagcatctccttagtcacgacagtcaggaagatctctagacattgtcaaatttggtgggcaacattgctccttgctgagaaccactggcttatgcagtaaggtaactttgcacaatgtgcaggttagttacatatgtatacgtgtgccatgctggtgtgctgcacccattaactcgtcatttagcattaggtatatctcctaaagctatctctcccccctgcccccaccccacaacagtccccagagtgtgatgttccccttcgtgtgtccatgtgttctcattgttcaattcccacctatgagtgagaatatgcggtgtttggttttttgtgcttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgttattgtgaatagtgctgcaataaacatatgtgtgcatgtgtctttatagcagcatgatttatagtcctttgggtatatacccagctaccaatgactttcttcacagaattggaaaaaactaaagttcatatggaaccaaaaaagagcccgcatcgccaagtcaatcctaagccaacagaacaaagctggaggcatcacgctacctgacttcaaactatactacaaggctacagtaatcaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacactttatacaaaagttaattcaagatggattaaagacttaaacgttggacctaaaaccataaaaaccctagaagaaaacctaggcattaccattcaggacataggcatgggcaaggacttcatgtctaaaacaccaaaagcaatgacaacaaaagccaaaattgacaaatgggatctaattaaactaaaagagcttctgcacagcaaaagaaactaccatcagagtgaataggcaacctacaaaatgggagaaaattttcgcaacctactcatctgacaaagggctaatatccagaatctacaatgaactccaacaaatttacaagaaaaaaacaaacaaccccatcaaaaagtgggcgaaggacatgaacagacacttctcaaaagaagacatttatgcagccaaaaaacacatgaaaaaaatgctcaccatcagtggccatcagagaaatgcaaatcaaaaccacaatgagataccatctcacaccagttagaatggcaatcattaaaaagtcaggaaacagcaggtgctggaaaggatgtggagaaataggaacacttttacactgttggtgggactgtaaactagttcaacccttgtggaagtcagtgtggtgattcctcagggatctagaactagaaataccatttgagtaaggtaactttttaaagagaaggttccatggctctggcttccttctacatctgagttagcctgaactatcctattttttaaaagaaggatctatctacttgggttagaaaaatgtcagatttataatgtacgatttacctctttcctgtctattgactacagggctgttgataatcaggtgtatgtggccacagcctctcctgcccgggatgacaaagcctcctatgttgcctggggacacagcaccgtggtgaacccttggtgagtaaggctaagtgagaataggctcagtcggagcttgagcttgagtggtggctcgttggcagatgggttttctggttcctgagcagccaggcgctcacttctcactcccatttccccacatatcctgccagctttctgcctgtctctgtgagaggagcttccatttgaaaaccatgtgagaagcaaatcaccctgctctcatgatcaagcacttggccttagccctcttctgagtttctggtgaccttcactgtcagtcatacttggatcacatggggaaacaaggcagcagtgacaggcaggttgtagtaagagactctgaaatttttggttaaaatttaagttggctgactagtcccagggtaggaatgagttacagggtgaggactttgcttccagcataatgatcagaggagcagtcaggatggttcaataagtgaaactatgaccctctccccaacaaaagggtgaagcattttattactcagtggagccagcacataagcctgcccagacagaattacagtcatacgctcatacgcattccttacagtctacatttgtacagtttacatcctactttcacaacatggtctcaacttgaactctcaggaaattgttcttattaagcccagtttatagatggtagaattacagaggaagcgactggaattccagatgtagcggctagacccagtgtttgaatccaggatatttgccttcagaacttggatgtattccacactagttctctgtatgaaagcacacacacacactggtatgtatgtctacatttcaggatgagtataccagtaacaagactgagaagagttaaatgttactgtggggttcctgagggttctgtcttctgcctttataggtagggctcagagctcaatgtgtgtggtggggaggccttggaagatatgactagtgtgagattccagttggcctcctgcacattaggcttggggacattgaaggactaagttgacttgaaaattttcttgaacttgcatcaggttccactgtccagaaatctttgaatgccagggcaaatggggaagaatcagaaaagaattcagttacgtgtcataaatggtggtgcttgtatttgtaactcatttgtgccaaaagtctgtctgtggctatctggtaaacagaatcagttgttatgtcagattattttggagaaggttcatttctctaggtaagggtttgaacccttgctctgggccaagagactagacactggagatagtttcttttttcttttttttttttttgagatggagtttcactctgtcgcccaggctggagtgcagtggtgcaatctcagctcactgctgcaacctctgcctcccgggttcgagccattctcctgcctcagcctccgagtagctgagattacaggtgcacaccaccacgcccagataatttttgcatttttagtactgatggggtttcgctttgttagccaggctggtctcgatctcctgacctcaagcgatccacccaccttggcctcccaaagtgctggggttacaggcgtgagctaccgcacccttcctggagatggttttacaggtcagccttaccctggattgatgaaggagtgtggctgttccctagtgcagggctcctgccagtgtgaggttaccctccatccccccatgccacttctacccagtcgccagaggttgaactctttccctcaaatctgaaactgaagcccattaacacaggggttcaggtatcacagccaccagggcagagaccccagcagatctggggccctgcctaggcccagcttcaccactctcagggagggtagcagcccaggcaggtatgaagagtgggtctggactgccattgtaaagggggggtccactgaaatgcactcatgagggcatgagatggagcttcctgttggtggtaggtagctctattgccagatctttataatcatcagataaccaccgtctcctagtgatttgcaatttatgaaacatgatccataattttatcactaagccctcacagagctcttatttccactttatagattaggaaatggagatttaaaatgccttcccataaggtcacagagctatttaaatgatagaacataaatctgtacgactaccttcttgttttcaatctcatactttcccctttggcctgtgagcttgggaggaaaaaacagagaccttgaatatcaccaaacatcagtgaatccactcattctcttctgcatctttttcaggggggaggttctagccaaagctggcacagaagaagcaatcgtgtattcagacataggtaagattttcctgggcatggtttaggtctctgatgtccccattgttctgaggccagactccatggctgggaagtccctgtcatttggaggggttcctttatgccccttctcattgatctctggggatattctagggtctggttctctggccaatccctggggagtgtatcagcttgaattttcttggtttggtttgaaatgatgccaggccatctgtgcacctagataagacctatgttactaagttacttactaagactctggtggtttatacagtcaggggaagaaatccccttggttagtgaggagttgcaaattattaatagtgcactttcctgttttttgcagacctgaagaagctggctgaaatacgccagcaaatccccgtttttagacagaagcgatcagacctctatgctgtggagatgaaaaagccctaaagtttatgtttctaatgtgtcacagaataggacgatatgattctacaacataatcaactccctattaaattctttaatg

SEQ ID NO: 38400 - DNA, 1461 bp, Homo sapiens
gcgtggcaggagaggcggggccaattttgctgagctttctcgcgggcttgcagctgcggcaagtgctggcggcggctgctcgcgcaagtcagctggcgtgggaactaccctttgtagctgagaacggcttgtttattgctacaaagactctattgacattggtagcttcagcggcagcagcttcttacggtataaagctgttgcttcctgaagaggctacaagcatccttccctaggactgctgtaagctttgagcctctagcaggagacatgcctcggggacgaaagagtcggcgccgccgtaatgcgagagccgcagaagagaaccgcaacaatcgcaaaatccaggcctcagaggcctccgagacccctatggccgcctctgtggtagcgagcacccccgaagacgacctgagcggccccgaggaagacccgagcactccagaggaggcctctaccacccctgaagaagcctcgagcactgcccaagcacaaaagccttcagtgccccggagcaattttcagggcaccaagaaaagtctcctgatgtctatattagcgctcatcttcatcatgggcaacagcgccaaggaagctctggtctggaaagtgctggggaagttaggaatgcagcctggacgtcagcacagcatctttggagatccgaagaagatcgtcacagaagagtttgtgcgcagagggtacctgatttataaaccggtgccccgtagcagtccggtggagtatgagttcttctgggggccccgagcacacgtggaatcgagcaaactgaaagtcatgcattttgtggcaagggttcgtaaccgatgctctaaagactggccttgtaattatgactgggattcggacgatgatgcagaggttgaggctatcctcaattcaggtgctaggggttattccgccccttaagtagatctgaggcagacccttgggggtgtaaaagagagtcacaggtaccccaaggagtagatgccagggtcctaagttgaaaatgatgtcgattgggggcgggggacactgtatttgatatttgtgatcagtgatcattgttcaactgcgaaatagagtgtttgcttttgataatggaaaattgtattcgttttaaaattccgtttgttgagaataacaatatgtttaaaaatataattgaacaaatttttttctttgtttcctgtcattgacatttagtataacagttttgctaacgttctaaaatgaagtcgttccatcataatctatgatcttgtacagcacttatagaaataagctgttcttttgaagttgaaatacccagtaaaatgttgaagaaggatggaggatttcttcatatctgacgtttctgaaaccctttgtgtctgctgttgtgtgaagattgacatttaccatgattttccttagttactgcagaacatagagaaaaataaaagcctaacgaatagt

SEQ ID NO: 38401 - DNA, 66299 bp, Homo sapiens
gcgcacagagctccctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaaggtgagtggaaagctgtttgtatttacccagattcttactttttcttgttccccttcccatctgttcgcggaaacttcccaaaaggtaatgagaagggaactctttaaattccaaaactgcatggaaaacaaatagttgggaatacatgtttgagctaacaggcacacacaccccaaacccaatgttgtgtaaaatatttgcaaagggtcttatgtctttggtgatgctagttaaagtttaattaaggttttacatatatatacaatatatataaaatgtatataaaatatatatataaaatatatataatatatattatatataatatataaaatatatattatatataatatatattatatataaaatatataatatatattatataaaatatatataatatatattatatataaaatatatataatatataatatatatatatgaaatcttatggtctgtaaaggaaaaacccctagcttcctcactccctgtcctcaggtggctgaagtaagggttgagagcatgtaatatttactcacagtctcccttttgctattatcccagtgttttgtgtgtttcccccaatacacacacacacacacacacacacacacacacacacacgcacgcagtttctttagttggtgatgttggcagtggcagcagttccagcataagggaactgatttctgtccccagggtctgcacgtttcccttacaagaagggctggcccggagcccagaaggtcatgggtaaactcctgcacaggagcctgcggctgtgcctatagctccaataccacttgttgcctacctgaatgcagctgggagaaggcacaggctggagacttagagaacatgtgaacgggaagggaacagagagacaacctaggctttacagatcgggaaactgaggcccggggtcacagagagttggttctaacaggcagctgactgtaaggcaagccctaggcatccagactcagtccctgccactttttaactgcacatgattcaccaggtcacttttctgagcctcagtttccttgtctctgatgtggggaggataggcctaacctccctcatggcagtggtagcagggatactgacactgtgagttaatttcccaaagcagtcattgttaaactctgatttcacagggtttagtcttgaagggcaaagtcttccttaaatatctgccattaacctgcagggtagaatgagagggggaaaaacaaaagacgtgagaatcaaactaaagacacaaacagccactcagaggcacagcatgcactgtctaatttgtagctgtgctcttctgtagaccacctgcccagaccctgtcacagagtccagtggatccttctaaatgtgggtaccaagtcacattgaatctgggcatttgtctggaatgtatcatgcctcactgcatttgccaagctatttgcagaatcaagtcatttcccctcctacagaaattaccataacattttagactcttagaagatacctattaattgctacctagtagtgagttatgcatgcaatgctcttatttctctatacatttttctggactccttgagggcaaacctgtcttgttcatccctgtttgaacatagcacaccatgccacacagcaggactcaaaaacctgtgggtgactcatgagaatatctgtccagctaagaccacactgtttgcataggcttcattttatgcattattttttaacttgtagcattgatatttgtgtgtctgaactgcctccccaagttcagacacagaatagttcacggctaaaggtggcagagttccattgtcctctggaaagtgaaatgattctgagtatttttaatataagctggttgatagttactgtatgaggtgagatgaggtatatggagactcctcctcctcaccacagtcctgtgttgccacttggaggaagccttgtttttattttcctttgcataggggagtgtgattatcctgattagaggtggaacatgttctccttcttgtcaccccctagtgccaacttccttggcctgcaaagggtttgttttccatttagatccaattacaggcttagagaaagaatgtggtgggtagagatgaaagggcagattttttttatctcttgggactgcgacaatcaggaggaagatcaccattttgtaggttaaccaatgccttcaactcaaaatgtggaggggagggaggagagccgagaagctccccttgctgaactgaatgtcacagaagtgattaagtactacgtgatatcagcaacacgctgaaaagcttttactgcatatttattttttaaatctgcaacagtatgtgggggaggtttataacatttggcttcaggatgcataatcgcacttagacattttgaaacaatttcatagactcttagagctacaaggggcctatttacaaaatgagaaatggtttaaaatggcatacaggctgtttccgcttccctacccccgagggggctggggcgggaatccccaccaactggaaagtcataaaaagatcttcagcaaagaacataaaatctaaaaactggagtagacttaaaggtcatctaaccaaccccagacaggctggggaaagagactcactgggggccacatacatacatcgtggcagagcttacaagttccctaacttctctctttctttctaagtaaaatgcttccaccggctgctcttgaaccatctttttttttctattaggaaagagaaggtttcctagcacagacagttccctgagaatggtgaaatcgccaacatttcttggtaacaaagggccttgaaggccaaatgccatttttctgggtgaaaccaatctcgactatggatttgttcttgtttattaaggatgcaagttattagtgcaggctttggcttcagatctggtttaagtcccagctcccccacttactagctgtgtgctcttgggcaagctaattaactttgagtcagtatcctcacctcatttgaaagttgaagaaacagtaacagcatctacctcccaagatggctgtgataattaagtgagatgatgtacataaaaggctcagcatatgggcactcagagttagccatggcagtccttggtggtggcggtacatttcagtgggtgcatggatgcggaaaggaattttctggtgaatgaggacacttttatttataactgccccatctgaagagcacctaactttcattcagctgaacctaagccattgctcagctttgacaagctaagacaatgaccaaatgctgttgccttcattctcacccaacgggtgcaaaatctgcttacatggaacagtctttccttctgaacatggattgccagttattgagcatttcactttggagttatataatgttaggcctcgaaggggacttggagtgccttactttttagataaggaaactgaggcccagagggatcaagctccttatcagaagttgcagagaaaatgtactgaagcctattaggctctgcaagaatacagaccccttgactgtcaaggaaccatctgtaggaatttagaagggattagaagaaagagagctaggaacctgttcatagttgactgtgcagtcaccagtgggctggctccagagggatccaattagaaattctcacccctcaacacaatgcccaaggggcattaaatgatggtacttctaagtccattgccaggtccacctggatgtctctctccatgcttctctacatcacatccctcttggctttcctgtccttcaggctaggccttccctctgtactcagcccttcctgctttcacctccacttcctgcagtgtgccaaactactggcacatcacccgggtgagctgatccaatgtaaacacagctcctcgtgaattgtcgttggctctctcaatcttaaaaacatattaaactgtcacttaaagaccttaatagccaagacattggagacatgcccataggtgtataagcaacttttttgccataatagagccttgttttttaaaaacagaaattatccaagtcccttttacatgctttctaaaaacagatgctgaaaccattactttgtgaattgcagatttttgtcctaagctgcaggtgtgtctgactatgcggagttgggggctgacagttgactttcaccaatgtatctgccactgtggtagtgggaggcaggaaagagcttcatcagattatcttcaggctttaatctaagcatctcagctccaaggctaggaatttgctcagagcttaccaacactcctacgagttggaaagtggaaaaatgactttggcattcccctctgaggatgcttggtttgatcctctcttcatgctaactgaccaaaggtgacaaggatgaaaaaagaataggctgaattcagcaaaggctggggaccaggaaggaggggctgcacacaggcttttgtgtgtgtctttccttccgcccttacgcaggccacttcccaagaggaaaaggtaaagagtagagaagtaagggaatagttcctctcgcaactcactagagctgacagggctccaggagaagtattcaatttgactttaggaaggcaaatcgtcctctttttagcttgcacattcaaaatagtttgtgtctcataaagtggagatttgccttgataagtaacagaccttgagagctcttatctcccaaccattcatccaacaccatttaaatctttattttaagaacagatttctggcaggggcgtgagtcattataataactgcaggcgtttactcactgggtgactttggataggtcacctttcctaggaagtggcagaatttggatgagaaccagggttccttctgcctccagcccactgacttttcctttacaccagatcatctcccaaataacaaatgattatgacaaaataggcttaaaacttcgttccactgaaagcggaattgtggagcagcttttcaggacatccaaaatgaagagacagctgttgctcttgaagagccttcgtttagaaatatcctcatatcccctaccatttgataacaggaagaggatttggccagcagctgctactgtctcaccaggtgcagggccaccagccacttttgcaggactccttcaagagcacaacatttccttaaatccacgtggaacaattggtgtgtcccaaaccattgttggatgtttacatatagcaatagcatagatctgcaaaagctctagaaaatgctctctataaaacttttatagaaagagttacatatgaagttgagtctcctgtgttcaccaaggctcctttagtggctgaaacacaaatttagtatctaatcctgtatatttgatgcagaaattgtgttttcacaaaaacagaagagacaaatcaattgtagtgctttgtgaaactcccaaatcaactccttgtctcatatctgctcttctgtatgagaagcaaacccttttacatttttttctcagaaaagagaaaggagtctgttcttacttttattatctatttggattcttgcctcccaacagacttgttctctgttaggacaggcaagtttggggctaggcaaaagagaggaaggaaagacatctctaagggtccggagatgattgacattttcctgtgtgttagctctttagcttcaaggactaccatgcaaaaatattggtgtccttttttacacatgagtaagttaagactaagagtttgaaacgacttgtctaaggtcacataatgacagattaagaactcaaactcaggcctctctgactccaaaacttcagttcttttcactctgcaagaaacagaaggcattcgtagaaagcagaaatctggtgaggagggactatgattattactgtgactttcatacacagatcaatttcttccagcccactgaactcattgatagtctggttcagaagcttcccagcatttgcaaaatgttgctaggcacctgtatctctttgatatctcttggtcaccaccaggagtatactgtcacctacaccaaatcagagccatttctcgggtatagaataaagactttcttgatttctcctggttttccagaaggctaatggacatctcccggcagaagactagtagagagaccttttaaagaataatacatgttatcctaatactctaaaaataattctagagaccttgtcccagagctttcaggaaactctgccctggggataaggttggccttgacatgtgcatttctacatgtctagtcagcctgacccatggcctacccaataatatataaatcatgaccaagccaaacatggcctgggcccccaccgggacatgctttaaaaggaaatataattgctaagggagaagaaacaaaggctccatttggcaagtaactctattgaaggacaaaggagtgccagtgtccaactcaaggtggctgtttcaaatccacatgctttgtgtatagattttgtctcctcctcctgtttaaaaaatattgaatcctttgtaaaatttatctctggagacaaaggctaatgagccattgtctaaaagagctgagcagaatcttgttatctgctcattcaaccccttcatgtcacaaatgggacagggggagaaatggcatatctgaaatttacaaagaaaaaaatggcacatctgaactttacataagaaatggcatatctgaaatttacaaacttacatttacatgagtggtgccacaaccaagatacattgactcacagcatcttttatgaatgaaggagaaaagagtgtctgctgtattctgtcacttccacccccagagtatcccagttttgtgtcaacctcataccttgaaactcagaagttcaggtggacattttggctgtgaacttagctttggccacaaggtccagaagccacttcgaggagccgttaaacacacaacatttgcaagcacaaagatctagatgtgacctgcagctcttcaatttgccaggtctgcaaacttcgccaagttactgatcctctctggacctctggttcctcatttgagaaagatagctcaccgtagttctacatttaaacgatagtttaatgaggtaaagtgcataaagtgcctggatacataatatacccttgataaacatttcctcctgctgttatggataccccctctcatcagcatgatgcaaaaatcccataggttattaagtattgggatgtggaagaccaaattcagtttacctacatcacatggggcttctaagctctcagactgcaggaccttctctttgtagttaaacttggacctagccataaatatactcaggccacatcacattgcaaaatcatgagaatagccacaattcgtcttgggtgtttggtcgctaccctttccatagcagccctcccctgctccattaccagtctttccctccaatgtcttgcttataagatagggcaacagtcactcatttctttatatagcaaatatttatttagcatctgttatgtgccagccactgtgctaagtactgaatacatgacaatgaataggaaagctttgatccctgccaagtaaacttgagtctggtagaatttatttttcataaggcaggagacaggccaaataatgtcagtgttctgtgagtctttgtgttccttgacctctcccctccccaacacacacacatacctctccttccttttccaaccaccctcagattttccaggacacacaccttcagagccacatctcaactctggtcatccctacagtgtaacagtagaatgagtgtagtagtcctcccagttgtcacattttaaatagggcctttgggaagaaaccaccagtggcactgagtgaaaaggaggctgaggcaagggggactattggcagctcttaggtcccaccagcagccagtggtccctcagccttcctacagcgatacagtggtagaccagttgtctttgctcagcatatgttttcagaggcagctgaatgtttgggttgtatttttcacagtactgatgtcagggacaccaaagggcaggagcatagggaaagggctcttggctgactaatgacctcataagaaacctgcccttagaagagagcatctgtttgggctgtatgactcagtggcgtttctaggtactgattcatgaggctgaccatcgaggtgactgacccgtgcaatctgctggctgaaagaggtgaaggcaaagtagatcccagctctgccctcatcctggaggagagccacccctcctaccacggcacacgggtgctccccaccccaaccctggctcggccagccagtctccttgttaagaggatctgacactaatgtgggcagaggtcagcatctgggggcttcttattttagaggaagtataagagagagatgttttgaaatcttgttagtgaatagaggacagccttttaacctaggatctgtagatagaattgagggtgtcagggaacttaaattaggaaaagtattgcattttttatccctaacctataactgaaatttagcatttctttctactgtgaataaagacaaacgccctagaagtttagcagctcctatgcctttgataccaatggaaagcaggtatttttatatcacattacagctgagatagatcctcatcctacaatttatactcatccctgctctgaaatggccataattatacccactgctagatcatattcattaacttagtaaaggcacatctgttagtaagtcacaaatttgtttttatatattgatactatctcagtaatattggttttctttgtatttttatcttatgcatttaagacatttcctaagaagagatattctcatgtcagatagacaaagaacctaaaaatataaagactctttccacatcaagctgaggcattagcagcattacacgccacacacacacaaatatacacatctatgcataggtaaacatatatgcacacacatacagctgtagtggattgaggtctgaggctcttggagtaaacaaactcaattcaaattccaactctgccactcatttcctattacctcgaacaagtcatattagttctgagccttagtttcttcatcaataaaaggggcctaaaagttattgtactcacaacaatcatctaagttcttggcacagtacttgacatataaggaatgtgtgttaaacacaaggcatcctcaccattaaaagacctaatgaaggtgaaatggtaaagagaataaacacattactttgttgaaactttttaaactcacctttgatttggccaactctaagaatttattttgtctaaacctgtattacacaaatattatatgccagggactgaggtgggaaatgaagaaataaaaggaaaggaattttaaaatctgatggtctcagaaaaggaatagcctaatcaaatcatcaaagaatcatagcagtgcctaaagaccttgatcggggtacatgtgtgggactgagagagatcagaagaggaaatacttaatcttacctggggaggtcaagaaaggcgtcccaaagaggggacatttgagctgagtgttgaaagacaaggatgaatgagctgttaggatcaggccatagtccagttttatgccttctgaatctgacacccatattctccatcctatttgatttccaacttggggaatatcacccatcttggactgtggagaaatacattccactgtattcatccagccacaaatgcacatcttttatcttcttatctgagaacctgttcctcttcctctcaagcaaaacccactggggtggcaggatagcaaggcctgtcaggctgcacatagaaaacttctcatgatggtgacttgaggctctcccaagccctgcaatggagttccagcaaactcccccaagttgagtttgaatttttgcaggaagatacaggtctgtgttttgacagcaggaaaaaaaggtagccaaaaatatgcaatatatatggaaagaaaggaacacacacgtatgtgcacacacatatacgtccgtgagatccagcacatggcacatgtgagcagaacatgaaaacaccgttcagaacaccacagcatgtgtgtgcaccctgagcttcactctgaagccatttaataacaagaggaaaagaaatctcaagtaagactttttgatgttaggaagtgaggaagcaaaccagcattctgaaatatgggaccttggttaacaagatctggaatcttgcatcaaaacaatttctttcacacagttcttacttcaaatatctgacttggtctgaaaatgtgagttccttcttgctgtattctagagcaggcgatgcactgaaatgaaacacatatggcttggatatctcagtgctgctaggatgattgtccttgatttttgtcagttgtacatggtacattaaacagagaaaaataaaatcccagatgattccctggcaattatctgaaaaataacattatggtgatcatccctgtgtttacaaggacatgaagaaagggcaaggtttgatggaaaagctttgtttcctctaatctgtcctcctacacagccaacagacctcaatggcccatggggaagatacaaccctataatgagattcccagctaattaaaatggctgtcatcacccaccttccacatttccatgagcccagcccagaaatgggaccatcacaggggaaatcatcctatatttatttgaataatgtttgtactgtgtatttcagcaattaaaattaacttttaagaggtaggaagaggcttagggattctctaggtcaactgccttctttaacagatgaggaaacagacccagcaaagccagatgacttgcttgaggtcacagagctagttagtgggagaggtaggattagaattcaaggtactatggcctttcaagttcagaaagacttttaaaaactgtgttgtgtagaatcacttccccataaacacaagatgagctgggcagctagttgctgtcagaataccactgaggaacactcacacctcctgaagatgtctaatttttttaactcctctgattattggaaagctctttgttattttgagctaaaatttctctgtatgtaacttctccttattggttttctttatttccttggcagattcaaggaggtaatggccatttttttctgaagtcccagtcccagttaacctactaagtcctacatattggtcaggatgaaggtcagagcatctatattttgggtttcttcctaccttcagggagacctggtgtcagttcttagctgagtgagatggccagcacgcatcccccagggtttgtctggggatccatcttgttacttgtgccagctcctccacctggctaggataattccctctcctgtcctcactcaggtggggaagcccttctgtgccaccagctatcctgtttcttgtaagaggatttttaatgtgggaaatcatggcaagaaagaggtgccaggcagctttaaagcaccaagagaagaactccaaacccatgtcataaacactcaagaaaaatcagcactgttctacatgcatacatgtagaacatgactttcaaagaaaaaagggagggatgtatacaaaatcaaagaaggctaaggaggcaaagaagaaatgattgataaatagaggtaatatcaaaaacttttaaaaattatttgtaaagttgtcatcgcttattactatatggaatgctaaaacagtaacagggtaatcaaattttgcatgcttgtgtcttttcctctggaggcagtactcaataaataactatgaaggctggccattaaaatgaacttgctttcatgaaaagataccactaagaaagtgaaaggcaatccacagaaagaaaatatttgcagtatttatatatactgatccccagacaaaccctgggggatgtctgctggccatctcactcagctaagagctgacaccaagtctccctgaaggtgggaagaaacccaagaaatagatgctttgaccttcattttgaatatttatgtgtgtgtgtgtgtgtatatatatttgtgtatatagatagatgattgatagatagatacatacatacatacatacatagagagatctgggttgtattcagaatatataaataacttctacaaatcaatttaaaaatccaatttttaaaaaacaggtgaagacttgaataagcatgtcacaaaagaagatatctaaatagctgaaagtataagaaaacatgttcaacatcattattcattacagaaaaacaaacgcacaatgagacagtgtcacatacccagcagaatggtaaaattaagtaccaacaggacagagtgctggagaggatgtggagcaactggaactcacagacattgccagggagaatataaaatgatacagccaccgtggaaagctgtctggtagtatctaaaaagttaaatatatatccactttgtattccaacaattacacttctaggtgtatgtccaaaagaaaggatcacagatattcacaaaaaaattttgggcaaaaatatttggagccatgttattcattatagccccaaactggaaataattcaaatctccatcaacgggagaatgaataaaccaatcattttatatttatacaacagaatattacttagtaacaaaaaatctaatatatgtaacaacatgggtaattttaaacatgttagacagaaaaagaaaccagacacaaaagaatacacaccgtgtaatttcatttttaccatgttcgaaaacaggcaaaactaatcaacagtgatagaaatcagaatagcaaccacctttataagaagaggtgtttattgaatagaaagtggcctgagggaactttctgggccactgaaaatattctacgtgtttatctagatggtgatcacatgggatatacatataaagtaatcgagcgaatactggagattggtgcatttcgaccgcatgtaagttttcctttgaagtactgttagataataatagaggcagtatttgataaacagttggaaagtgatatgtatccaggcagcagattaatgtgaggccaaagcatggaaagtgagttcctgctgcagccccctggaggtgtcacgttaggggagaactttgtctccaggagctgccaccaggaccctttcaaatcttgccattgaatttagcctggcatccaggtttctttgtgatgggtcccttttcagccacatcttccactacaacattctgctgccccagaatgtcactcattccctgaacatacttttcttccttgtgggcgtgctgagagggtttcctcctccacggccccaaatcccaccccttcctcagtgccctcctccataaaaccatcagttctgactaagttctctgtcctgtgaagtcctcgtgtggacttactctcctgctgaatgcacgtttacttttctgaatggccctgaagcatctacagtggctgtcttgcctgcttaactcctgtaccatcatatcctgtttatgctgaaattctccatgttatgctccttgagaacagagaccattccgtcttcccctttgggtgtgccctggaaccctggcacatgttatgggctcagtgataataatggatagaaaagggagtgggatggaatcgggaaataggagacggaaaggcatcaaaagaggtaagagcagctttgttctcctttctgacagggacaaggaattctgaggggttagaaagaaggaaagagaccctaagagcgggggatacaaaaacaaaacagctgtggaatagaggaggggagaccattaacctatttaagcacccctcagtgtggccccttcccattctgcaccaagatcagaactggcaaagtaggagtgggtggggggagtggggaggagacttcgtggtagcatttaggaggaatcttaagatgaaaaggaaatgaaagtgagagaaattggggaagccagcgcaccaaaccagaccctgaatttttttatgctttcaagttttattctccttcttcaagcttgtctacaaaaagatgggctttaggatggtggacgagccaggccttgattcatttccctttttcaaacaactaacttgaaccttcatctgaacctcgaggccctctctttctggctggacatctcttgagaacaaactctagtgatttccgtggtctggggaagcggttggcctggatcacggaacaacagcagctgcatctcaggaggcttggccctcctgagagacaagagccggagggacaaccgaaaactggctgaaatttagtgcaaacctctcatagctcagacagctatctactttaagtttctagtccttgatgaatatttataccaaaatagggccagtggaaaagttccatctgcctggattttaagacttttgcctttcctcagccacgttgaccaaactcaggaaagtggcggaatcattgccaagtacatgctctttgaagtgcaagaaatcctgagaaggccttgaattcatcatatttcttcttatcctgaaaacttagagttggcactcctttaaaaaaaaaatgcttaatatcagcacctctcagtgctttataattttagccaagcccttgacaccatgttgaccacaacactcttgaaggagtggataggtctattcaaagttttgcagggagaaattgctttgttggttgatatttttaaaatccgaatgatccaattattcactttaattctcctctttagtttgctagtaagaaaaatggccccaagttttatccttagtgttattagtcatcctctactcctcagaaccaaaacaccagaaatttcaaccatgtcgtacctttgatgtgtgaagataaaatagaggccttactctagcacgaggcatagtgagtgctcttaccaagcacaggccaggtgccaggcattgtgctacatcattttttgctgaattttacaatcatcccattttgcagatgagtaaactaagatccagagggattaagtcccatggttacatacttagtcatggtgaatgtgaatgaaatgtgggcaattcaacccatagctcttccttttccttctgtacagtgggaggatcccttgtatgaaaatctgaaatgctctaaaatctgaaacttcctgagtgctgacatgaagccatgagtggaaaattccacacctgacctcatgtacatacactttgttttatgcaccaaaattatttaaaatattgtataaaattaccccccaagttgtgtgtataatgtgtatatgaaacataacaatttcaggttaaggcttggatcttgtccccaagatatcgtattacatatatgcaaatattccaaaactgaaaagtattcaaaatctgaaatacttctggtcctaagcattttggaaaagggatgctcaacctgtactatgtctaacctatatctaacatgttttcagtgttccagaagtttgggtcgtggacttgttggtctaaagatgaatttagttgatacacaggcatgcactgacaacattgaaccatgttagtcagcatctttctctcatttcagttctttcattcttctgattatatcaaggaggaagtctccttctgatgctaaaacgcctttatcatcccaaacacttgctgaacttcactttaaacaattggcaagtagttcccaggctcagaacttttaaaaggcaatcatacctagctagaatttaatgactcatatttattgcatttgttgtggttaccatctaatttttatacactttagagataatttttttcaagaaatatgtttttaaacatgtgtttaaagaaaagtcaataatcacacagatggtatatggagaacaaaattcatgaaggaggaacatgaggttttataaacatataatgcttaattattcttggttttcaaagcatcttacgtacattaaaatatttgattcctacaaccacctcatgaagctcatagggattatgatccattttaaagatgaaaaaaaaaaacaaggttcagagaacagaaactatttgccagggtccacacaggtagtaaaaatgtagccagggctcaggttcaacactaagctccaacatgcacagagctcccccaacactttgtcagcaaatcattcaagggcaggagtggatcaagggatattccaaagcaatgagcccagaccagaaatgccatggaaaggctgcaaggcttactgactcactgattgccttgagttttcacgatttcccagtgcttgtctgtattctatttcatggagaagcctgcagcagagtttttctagagcagtctgattttctctctctagtgagtcatcttccagaaggtcaagaaactggctgtcccatcagagggtcatctcctgccttctgagtataccacacaagggatgacacaaactagaaacggaccacttgatgaggaaaactgggttctgcagcaagaagacagcatttctttccaagtctccttgccttgagcagttgactgggattcagatgtcaggtctgggtggctggacaggcaaggataccataaacataggagaagcagggagagagcgagttggcagtctcatccgtctatccatgaagagattccaggagctgaaaacactcctggagataaagatgagagctggagagaatagttgaaactatgagtagattctaagaagagaggagaagagccagtgggagaaccttggggagagaagaaagttattgaggaaggcagagaaaggggtagtcagaggggctggcgtaaccagaggaggctaggatcctggaaaccagaggaaaccagggtgcctctctttccttctaactccccttttgggcatcatcctcagatgcaggatatctaacatatattagcttttgatgtgccaagaagcatagatgatggcatagatgaagcatagatgagggcatgggtgaagcatagatgaaggtgttttatataaatgtttattgaggagccactatgtgcaaggcattattctagacactggtaatagagcaatgaactagacataaagtgaccctgccctcatggagcttacagtctagcaggaaacaatgacattgaggagttatatacataattaaataattaccatcatggtagatactacaaaatacaaggtacggggttttctaagaccatatgataggagtgtctgagggataaatagaagtttgttaggtaaaggaagagagaaatggtctaaacagaaggaactgtatgtgggcaggctcagaagtatgcaggaatttggcatctttcctgggacatatggttaaatgaataattctgaatgtactcaagagataattttctggaaagtaacttggcttctgtagttctgttttacatctgaattgtggcaaatgagttttaaaaacaagaccttgaaagtgaattatttgcaacgtgaaggaccgttcactagtttctgtttcataaaactgagcttagaaaaatgtggcctaaatactctgtaagttccttttagtcctaaagatctatgactttcttacatgcagaatccaagtatatatagtgtgtacaattagatcattatgcagggggaaaatcaaggaaaggataaaacatctgaaccaaaaagtgtatttagtgttagttttaaaaacatatgatagcaaaaaaaaaaaaagaaaagaaaagaaaaaggagtcttttataagaaggatgcttgtttaaaaccaggaaaacatcttgctgaaggcactacactaaaacacaagtggtattttaccatcaagactccaatgttggttgaaggaaatccttttccatgtgcacacacgtgtgtgtgtgagagagagtgtgtgtgtgtgtgtgtgtcaatgcttccattgtcataatagttaacccaggaatttaggtgtgagattcccagcaggaagcatttgcataagcaaagccttaagacttttaataatagtgctgtacgtttatacaacacatttccttttaagatactaagattcagacaggcaagattaaaaatccaccaacttggtgtgttatgtctcccctatttccaaaattaactccaataaaagtgtgttatccttggaaagatcagtaggactgcaaatttggaattcagacacatgcatgcacaaacacacacacacaccaaatgacattcctacaggatgacattcttaagacatcaggctgctaaaatcaggagcatcttataaaactagggaggtataataagtaggtattgctgacctcaagcttacagatatatccttgagaaggagtctgttaagggcagaaacctaagaaccacaaaaccaattagattttaatttccaagtgtaacctgaagacactaggcctggggacaccaacagcttgttctaatttaggaaaggcagggtgggaggggagtaaggggtccccacagggaccttattttcttctatcttgatttccctcaagctacttggtaaatcactaaataagattcccagggagtttggataacttgtggctcatagtgatgctggtggctttactacattttccgaaaggctgacagggcatatctagggaaagaaaaagacaactccaagagaaaaaacaattgtgttggagcctctggaagcatttagtttggcaagaaatgccaggtcaacttttgccctataggaatccctttcataggcaattaaaacaatgcccaccctttgggactctgagtgatctcaaaagattcattaaaagtccacaaatggaaggagatcagaggaccatcctctcactgactgaattaagcaggtagcccctcaaataacgggctgacttttctagaaacgtggacaattctgaaacagcggaaaatggttttgcttcttggctgttttctcagtctgcctttgtacaattcactattcacgttagcctgagcagtgtctgtagctagttcaaagggagctggtgtcaaaggaaaatattagttcagccttaaaaatcctatcacttcagtccagtggggtcccttatacgtaagatttgtgggcctgctttggatacaacaacatgtaaacatcagctgtcagcaagaagctggcagccaaaaaggctggtttcctttccccctcagtcatcttcgtgttcgccctgccaacagaatgttcaacaaggagcccgtgtcctgggccaggactgccagattcctagatgttccatgtgccatcacacagatccagtcacccagcaatgaatctttgaatttagaatttggaactttttgcctcgttccatactcctctttttcaaagtgaccccaactccatcccctttgacagataaaagagagatcctgtgactttttccatgcttccccttctcaaaggctgtcgcccatgccaactgggagaaggagcccagcctgcgaatgattttatagaattgcttatagctcctctgtccaaacgtccctcacatcaggctgttccaagagttgcaaacccttgaaaaatgtgctgatttgagtcttatcacctctttgtctatttttgatggaagtgctaaaaatacaaaagagtaaaattatccaaaaggcagacagaagaaaaagaaaaaggggcagatagtctcctatcttggctagcagagcactcatggtgtcttctcccttatgccaagtgatactgtgatgataggtagacagtgctggtagattcggttggtagaccagatgaccgagggaactgtgattgcaatcatagattcttaatcagaaggagagttgttttttcattttggttttggtttttgttttttttcaagatggatgcagatggtggggtcagcttctcaggtggagtacagttttagaaccaccaccatcacccaacccctcaaaaggaagcacaggcttctatacacttacttctttcatggcccagggtctgggtgttttggctttcctggaaccagtctcaaatcagtgaagcttggctagcagagatgggttggggggaggcaggagcaaggtcttaaacagagaaagctttcattttgtatttccctttccacatatggatttacttttctactctgtttttatagccagattaaccccttttgttcacagatgatgtcagccttggtggtctccaatcatcccctcccctggaggggaaggcagagctacacaagtgattacaagctcagcagtgttccatgaaagggcatccatggtggcttggagactgcagcggggaggagagtgggtaactagtctaggaaagtcaagagtctgccctgcggagctgataggaggaattggccggccttttccagaactgccccaggggtgtgttcctcaaggagcctgaacacggtgattggaacagagacttcagggacagctgctgtgggagtcacagaagcaacagttcccttccatcagttccccaaagggtctgggactaccatgcttcactccagcctctcacatgctccaccttggcaggttgggcttctgtgaatttattcctcctttgtgaccaacctgattttaacttaatctcacccattagacatgacatgtccagagagaggaacattaaggagaacatggtatatttggccccaaacctaaattctcccttgagttgaacctggaaaaactaatcctgagagaggaaagaaaaaaaggaatgattgaacaatttaattaatttttaaaaattaaaaattaaagggaatatatcatttgtcatagagagtaaaaactattctttcattcagcatttgcttaaaattttatttgggacaccagaaactcctgacatcacgagataaatccatctgactcttccaactacaaccagtccacgggataaatttaacacacacaaaccatgtaataggaaaaatcatggaatctttaccctgaagggctgccgattcaggcacttctgccatcagcacattatccaccaattgtgttctcattctgttgctttaaatagtattgatctttaaaagcaaaacaaaactaaacaaaagtttccatccatagaattctaagtactagatcagtagggctcatctcaatttgtttagtctgtgcatttttatcttcattacacaattcaggaaaagagtctctaaattaaagggatttcttcacatttgtgcttgtccagacagaggaataggaatgcccaaggagcaaccctggagtagaaatggtagatttgaacacacatacacactctcacacatacacatgcacacacatgcacaagcacacacagctccctgaagagcatctgtcatatgaccccaatgtaaacgaggtctttgttgctgtctgtgtgagactcactgtgttttaggatgcactttatccaagtcatttttttggttgatttctgccataaaagtgggctgcaagtctcactctttcatatcatacttgggaagacaggattctcttggccacagcctgaagccctagcgtgggggcttcccaaagcttggggaggtgagtgagcaagaagccaaaggataaacatggagcagcggttctgctttaagattggagggagcaagatggggaacatttgttttacattacaacaggaaaaatatagattgtggaataggatgcaaaaagtcaccctgatgtttaagagcaaatagactggaaagagtcattgttcaccttccctcagcatccctggctttccaaccccctggcatcctcctctggtgacacacaggacctgtctcaggaggagaggtcaggcagaggatttactttcaggaagggcaacaaatgtagactttaagttatggacaggcagttatcgtattggtaagtatgttgattccattactctgttaagattgtgtaaccctgttttggcaattccttgcttcaattcttgggagcttcaaacaatggaagaagtccagacccttgtcaagaccccagtcttccttttttttaaacttttaatttttgtgggtacatagtaggtataggccccaggattcttaagtgggaaagtgaaaaaagccttcctggccagggcactccccagaaaaatcatacttcttaaggaaaaaaaaaaaaaaaaaaaagacttcccatgcagcttgcaaccatttgggtgttgcacattcccaggttgggccccctcatctggtgggaatcctcagtcgaagcttccacctgaagttggggagggtttggggaccacccctcgcctcaggcagggcagagggtctcagtatccatgagtgccccagagaggagtcagccagtcagtgaaatttagaggaagaggaagggttgtggtttcccttcggtctggttaagagaatgactgcatttggcaccaaaacctgtggggcaggcttgtgccagggctgatgctgaaatgacaacaataaaagccagacttgctgtaaaaaactctccttgtagggaatggtggtccacaagctgcttatgaaaagggaatttttttcagccttattgaggtataactgacaaataaaaattgtatgtctttaagaggtataacttgatggatttgtgatgttgctgttgttgttgttgttgagacagggcttcactctgtcatccaggttggatgcagtggcacgatcacaggtcactacaacctcaacctcctgggctcaagcaatcctcccgcctcagcctcctgagtagctgggaccacagaagtgaaccaccatacccagctaattttttagttttctgtagagatgaggtgtcactatgttgcccagactggtctcaaactcctgggctcaagcaagtcaccctccttggcctgccaaagtgctgagattatagacgtgggccaccgagcctagcccaaattgatgttttgatattcatatacattgtgtactaatcaaactaatttttttacatggtgagaatacttaagatctaccctgttagcaaatttcaagtatagaatacagtattgttaactatagtcatgatgctttacattagatctccagaacttactcatcctgcctaattgaaactttgtaccctttgaccaacatcctcccatttctcttaatcctcagcctctggcaaccacagttctcttctgtgtttctatgagtttgactattttagattccacatataaatgagatcattatttgtctttctgtgcctgacttatttcacgtagcataatgtccttgagttcatccatgttgtcatgaatggcattattcttattcctttttgaggctgaatattattccattgtgtgtgtgtgtgtttgtgtgtgtgtacgtgggtgtatgtgccacattttctttttccatttatttgttgacagacacttaggttgtttccatatcttggctattgtgaatagcgctgcagtgaacttgggaaggcagttatctctttgagatactgatttcatttcctttggatgtatatccagatgtgggatttctggattgtatggaagttctacttttaattttttgaggaacctcatactgttttccataatggctgtaccaatttacattcctcacaacagtgcacaaaggtccaggaagggagattattaagacaatgagctgagagcctaaaagtccaagttggaacggttgaagttacaatggtgagaccaaatgattcccaaacttgtctgaacattggcatcccctgggaactttcagaaatactgatgcctgtaatcaacccccagagattgtggcaaaatttgcctggaatgcagcccaagttttggaagcattaaaagatccccaggagagtttaatgttgcagacaagttagggaaccactgttgtagcccctcgatactcaaagcgtggtccctgggacagcagaaatggtttctcctgggaggtaggtagaactatatgtcaggcttgcccagacttgctgaaccagagtgtgcatttgagctagatcccaggtgattttgtgctaatcagagtgtttacttaatttaaggagcactcccctcctcacacacccagaacaggcaaaatcccctgctaaaggacaatctcatgacacactgtttctccttcctagcactgattccatttgtaattttacatttgtgtgagttgagaaaaacgtgtgagggccccaaaatatctggaagaggctctttggcatggaactgtagtgcattggttaaattaaaatgtggatctggaattcagatacctgtgtccaaatctaagctctagcactttaatttgacccctttgaaccccacttaactagagatactggatttttccaggcttttctggttttcatactaaaaagttctacatcctaggcaccaaacagtctagtgcaaaccaggacagttagttacccttcagttaactcatatgcaacctagaggcactaacaatgtatcagtggtctcaaactttaattgtttatcaaaatcacctggaggtcttgaacagcgatgtctgggccccacctgcagaatgtttgatttcataggtctggggtgaggcttgagaatttgcagtgctcacaagttcgctgctgctgtgctgctgcttagagaccacaccttgagaaccactgcaacatacctcccttgtagagttgttgtaagatttgtacaaggtcagccttcacacagtgcctggaaaaccacaaatcctagtacttgttacagctactattgttacttttgattatggaaaagatgggactaaagatggtccctaaagagtcggcaggttttaagttctctgaggtttagatgagcataagcaaaatcccagagtttgcgtggatttagttctgcaagaggctcaggtggttggaaagagaatctgggtggaaacagtaaataatatggaaatagagacaaatttggacaggttactagctgttgaatcttgaagaagagcttaacctctctgagcctcagtttccttatctgaaaatgaggctaatgaaattatctcataaggttgtcaagaagtttagatgaaatatcatgaaaatgtttggcatgtgcctggcacataggaagtactcaataaatgttaactatgatcatgatcactgggaaagataaaacacttttgattaaaggccagtataggaaaaggtagatttaggataccccaccaccactgccttcaaaggagctccaatggagaccatctggatgggcaagttgcttctccactctcagactcaaggtcattcatcatcttttgactgggaataatgatgataataattatacttcagtgggaagtcatattattaaataagagaattactaagtaaaatcactgagtaaaattcatggcagtagggtagtttcagggtcatatttttaaatacaattccagtcctttcctggaccttctgataattttattccactcaacccatctcactccagcttctctcccagaacccctagggaagggtttgttttaaataacaagtcatgttgaccaataatctttaataacatgtatgcttatagaacttaacctgtaaaagacacgtctgcattgaatagaattttgtgtcaatttggaacgcaccacctcagaaaggaaacctgtgagtaatcattagggcgtgtgatagtactaagataccactttcaaaaagatagaatcacaattgttgtgcaaatatgaagtgaaacttaacaaagattgtgttctacccattaatgagggaacccgtatgatatttaggccagtttaaaaagcgcttgaggagttaggtatttataagtaatttaatgttaggacaagattgatgggttagttacaaaactagttaatgtcttccagaacagtaaaccataacatttggggttatcttttttgaaaggacagaaattgtttgtgtctctattggaccaagatctgcaagttaacgtgttacttcagaaagacttggagctgagcaaagtaaatttctctagataatcctatggggatgaggagagccagtgccatattgcctccatatgacattgaaaggatgtgccactcacctttctgccttatgtctgagttttaagtacttttctagggggccggggggacaggatggagtgcagtggcgtggtcatagctcactgcagccttaaactgctgagttcaagtgatcctccagcctcagcctctcaagtaagctggaactacaggcacatactaccacacctagtttttttttgttgttgttttcctgtagggattggggtctcactatgttgcacaggctggtcttgagctcctggcctcaagcaatccccctgcctcagcctcccagagtgctgggattacaggaatgagccaccacatctaattatttttttaacaatggcaaatacttatttcaatttactgccttttaatgttacgtgatgcttacaacagccctattgagacaaagaaagggcagggataattcatttttcagaggaggcaattgagttactccatgaggaagaagctgagctggaaggagaacccccattttctaattccaaatcccatgctcatccctaaattcccagttgcattttctcttttacattcctcttcctctcaaccctacattgttcttggtgacattttttttccctctaagacttcccttgggattcacctgaaggcaaatgcttgagagaggagtcccagagttgcccctgctccttgcatccccaggggtctcctggtctaatctaagtccttttaagtccctgccaccattcagtttcacgataatatcaaatgaaccacatcctactaacccaagccaaggaaaatcgtcaaaacatttctttctgttctcgggagaaaggacagattagatgctgcattccaagaaacctttttttaagtgatggtttcttttaaactcttctattctcagctactgtgagacactgtgccgtctttcaagagacagagcccacatcagaaaaacctactgtttataaaccagagtatctcacttgggactgtggctgactgatgttttcccctcctcagtaaacaagatcgttctctctgtgttgaagatagcggggtctgtctggcttctggatgaatggcatgcagtggacaaatgactatttattgcattaaacagtcagccaggaaactagctgcaagtgtggcctgatgacctgaatcaatttcttccttgcaaggccatttatttttctctcccacatacttctgttgccatggaaactgtcccactagcagatggagaccagggccaactctcgcttcctgaacctccatttagtttagcgttcttgcccaactaggccagtcgcctgtgtcttcacttgcctgactgcatgggctttctttgtgcttgttgagattttaacgtcgattctcttcaggtgattggtagcagagcaccgcgagggcaaagggctagggatggcctcacttaatgagttaatcattaagtatgggacatgtgtgagcttattttgtttttacattttgtaggaaaacctagtcagagaggcaactctttttacaagtcaaaaaagtagagaataagaaagtatagggggtgtgtatttagaaaaaatagttcctctgaagtcccctagcattttgaagctagaaaaaaatgtgttgagaatatctaattcagggtctctcaaacttttcttcacaagatgtaattaatgacaacaacaaagaacgctcagtgcataataagtgtgtgccaagcccttttcaggcagcatcccgtttaacctcctggtaaccctgcaaggcaagttgcattcttgttatccccatgacgcaggtcatggaactcaacaagcctacttgcccaagtacagtggaggaaaggggaaaaactgagactaaaacccgggactaaagcctgggtctccaaacccgaaacagttgcttgctctctacctcacttcttgcttctaacgtaggctggcctgttaaaggctcgggagcctctacacatccagtgcctgccatttgtatttgatcaggtaattctctgtcccactcccaaccaggaaccacttcgtaacatctcaccaagtgaggatcctgcagaacagaatgtgggcaaccccagtgcaagccagttccttatttttcagaagagatgctttaggctgggcaaggaaatgactcatctccagttacacagctaataaatgccagagttggcacccaaaggccagacccccgcatcaccggcgagtgctctgctctgctctgctgtgctacctacatcactattctaaatcaaaccccgagtttgcagacagattgcagctccactctccaagccaagcatcagaactaatccccttgtagaatgagggttaaatcagcctctcattagaagaacaataaagctgaagtgtgcagggtgctttgccacttggaaatgcttccacctacctctccggtttccagccttctgagtatatctgaaatggtccaacaatgaagccttattcacaagttgtatatctcccaaaataaactttgagtgactccaatattaagtgtgtaaggatcactgcatttcaactaggagaactgaaggtgtcaaggggaggtggaaatgagcaaggttatatgccagtggctttagggagcaaagtcctacctgtgaaagaaagctcccagcttaggagaatgagttagcagtgggtgttgtcttaattttcacttttcacatgaatctagcattgaataggcctaaatataaacctgcttccctccacactccacatatgtgcaacatgactctcactccctgaagctgtaaatatgtattgaacaaaatgacaaagtgtgtggggacatggtgtacacagcagtcaccaaatagaaggcatggagtgaggcattattgtgagaagatttggtgctgaagagaagtattgtgaaggacagctgtctctttccatacgtctgaattctaccactggcaatgaggatggcttcacaagtttcactgcttgtattttccctcttaaatgcaaagagagtagactagtagcatccaaaggacatgctcacattgcataccctactcatcatgcctttcataccttttttaccttgcacattttcttccttctgctaggcatctcctttcccttttctgcctgtccatcttgcacagcccaaatccaaagtcacctcctctaagaagaagtagtctgctctaataaactcatatttcccatatgaatttattaacactttcccctgtgcttctaaaatctgtggcaaaataagagcagttaccatgtctagtgcctaatgtggtcctgcacgttactatattatctcggtatccacttggcagataaggaaactgaggctcagtatgtccaaggctaggcagccaataagttactgaaaagctcgatttggaatccaagtctctcagactccaaaattcgtgcctcttttactacacaacatgcagcttcctttacctcagacttgccccttacaggagcaggagatgaatgtgtttttctctccatatccccctagctaacagtgagttccactagggcacacctgagtcttatgttgtattcctgtgtctggtacatagtagatgctaaataaatggtatgtttgttggataagaagcttatccctttacattactagttgattgagccctgcttcaggtgaaatcataataaagtacatccctgtaccaagtcgtccccaccccaaccccaatggagagttgggtaagtttctcagccagcagatccatattactaacccacttcttctccaatgttaatgtaatgcagatctcctgggaattttgttaaagtacagattctgattcaaacaggctggagtcgggtctaagggtctgtatttctggcaagccccaggtgacgcttctggtttgaagatgccatttgggtttaaacacctcagcagcagcagcaaatgcacttttggtacctttggctggtagcaagtaataaaacctgtctcatgcattgttctccttccaaaggagattttaagtgctcatgtgatttttcagtgttttagcaaaatatttaagttatgcttcaagctataaacatttggcaaaatgcacatttgtttgtgcctgtagctttggtttaatcacactctatcaataaatcacaaataaatgagggagaggagacactcactgaagattccattccagtgacaagtgagagtgggtgagggtgggggatggaatagatagatggtcactcacagcagggcgtttccaaccagtcttgctgttttgaaacagcactggaggctgggaaagaacccccattgcattcttattgggaagagccccacccttccacaattgcctaccctctggccccattccatgttcctgtttggtcttctcagttcccggtaaacagtttgtgatggcttattgatctcaagccctttgaaccccacacagtccctttgccagcacgccaagtcttttagaggtcaagcatctccggtccaagatgtttggaaggaaaacaccctcttttctgttccttttccagatgtccctgggccagctgcagtcagcaagaggtgtggcatgtttgggatgcaaggggacgtgttcgggcttcgagccacattcatggaggtaacagattttgtcaggagggtccctgtctgcctttgttacttggctgtcctctcggggaaccctggttgctttcttcgctgagactgctttggttgtatgcgttgtcagggaaggatggctgcagagggaaggcactcctgcttggtccaattcagaaacgaaaaaagtccttgggggagtgtggcgggggcagtaaagatgtgaagaaggagtttagcacttcctaaaccatttcaaggtagagtccaccaaacccagcccagcaagaattgctctgggaagacccaagcagaggttagctggtcccttgtgcctttggggtatgcctcggggtttggtggatggggtgatctcccctcactgcaccaacttcgctgtggatgggttttggtctagagtggcccctgggacagaaagagaggtcattctgtccacagtacttaaaaaccaggacctggtattcatatctgcacaggaggaccataagatccagctggagttggattcgcagaggttttctttctttttttccactgaggattctgaggttaagaatgaggctgccacaatgcagcgtccctgggcagcattcatgtcagcatctatgtggatggcacctctggagtgtgcagggaacagactgtaagtctgtccctgcggccctgggagaggaaagttaagttctgtggagcacatagcaaagaaagagtttttatcaccactgctgtagcgttgccttgagcgctcagtggggggacaaagtttggaaggtgttttcgcagcaatactgacttccattatgagatgggaattataaaaataactacgtatgaactgaatgaaatcttttttatttaaatgttgaaataaacctaagcagtaggtattagtatctccattttgttgatcaggacattgaaggtaggcaatggggcaacaactaccagatggcaggatttgaactcagatctgcatgaatcccaatcccatgctcctaatcgttctgcagtacacagggctatgagctttcagagcagaacactgttccctgactccattccctgacagttcccaacctcagaggagctcgcaccgtcttctggttgctagggaccttcaaggtcctccaactcaggcttctatccccttcaaaaactccttctataatttaaacactcctaggaggagttctccacacttactatattttggccatttgagctctttctggcctggaaagaaagtcaacttccttatcatttcaaccccactggtcctgaatctcaggacagcgttgattcctcctcagcaatttgaagacagctaggacgtctccttttatatttcttgagccaggggaaaatgttatctaaatgcacccaccgagtcaattcaatcagttttcccttctctcaaggacctcaatcctgtgctccctgctgtccaacatctgaaaatgatcatttggtatattttttctggttttccagttgttcaggaagagaggacaattctggaccctatttttcatggcaacaagcagaagtctcttagcattgttttaatccctccattttcttgtcatcgtacaaatgatttgaacatcaagtgaatttgtctttgagaaatacagattgaagcttgcaggtcctgcatatcaagtgtcatccttggtttgaagaatccaaatagggacttaaattagactcaaattgaagcagtaacatcacagaagcttaggagggaaatcctgttaaacttttttatgctccaggttttaaactctcaattgtttgtaagacatttaaatgaccaaagtgccaaccaacatggtttaataggaaagcccttcaactaatcatcacaggacagaattcagtcccagattaccaatgacagattacagaaatggctgttttaataccgttgaggatattttggggtgtgcctgtgtcctctataatctgggcacctggaaagagtggggtggggtgagaggggtggatcactcatgtataaagtcctagaaatgtgcctggccacatgaagagtgtgaataaaaggagaaattgtgttgacaccatttcaaggaacatctcagatctgttaacttttttttgttttgaaatgttttgcattcccagcctctctaattatcatcctgaaattccacattaactgcaaaagctatgcgcagcctcctcatctagttccatttatggaaagtattggggaggtcagaaggtcagatgggacactgaagagtcaggttcctccatgtccctctatgccaggatttccttcactttctgcctcttccttctccttccacttccagccctgctgttctcactcccctgatactgcctagtgcctgtcttcttaaagaagcaggcttctcatgcctggctctgaaaatggataagcaagagaatattattgattgtgaataaaatgcaaaacaaaacaacccatttttatttttatttatttaattttttttgagaaggaaaaccttctcatttattccctgcagcaccctgagggtcattttctcctttttgctactggaacacatccttgagattgtcaattttaacatctctcaaattgcagcccactgaatgtgaacttgtactgcaagcttctccagtagcattcaaaatgtcatgctgcacatcaccgtatcaaagtcaaaggagtagctttgcactaaagagaggtgtttaacctcccttaacccactgttttccaaactcatgaccactaagcaccaagcctttttctatgtaccacatactaatctcctggagaactggcccaggccagtagaactactcccagattttaggcaactctcttctgccctgaatgtattctactttatataatttccatctgattttctctccctgtcccatcccaactgtaagctccttaaaggtcacaacaaggccttcttctcttcatattcagtaaggggttcccaacctctcagcacaattgacattttgggcctcataattctttgttgttggagctattctgtggaatgtagaatgtttacagcatccctggcctctacccaccagacaccaatagcactcctctaccccactgggacaatcgaagatgtctccagacattgctaattctgtcctttgggacagaattgaccttagttgagaaccactaatttagaccatcagggcttgcccccactagccccacaatcaacgtttgtgatattcgatcagacgtatttacctcctgactgtaggagggaaaaggagggttccctcagccttgccgatcattcagctgcagtgacctcccttgctgggcctccctcatccctgcagttggccttgacattgctcactttactgtacaagctctcaagttgcatgcagaagagcatctgagacccagcacagcctgcccatggtgacaggccggaaagggaggggagcgattttcctctcacgccgtggaactctcttgatttctaaaccttaacagcatgacaccaagtagccacagatttttgtttttaattgtcaaagagaagcatgaggctttttagtaaatctgaaccctccccaggatgtgtttccttcttctgacaaagccttcccaatacacatccatctccccagccagaggggttttctgacctctctccctgctgggtcctgttcacaaatttcttgaagaaaatattcactgcattctaacggcagtatttatgctaaagagtttaaaagttgctgaagctccgaggctatgatcttggaaaacaattttaataattctttagagcaggagtttgcaaactttttttgtaaagggccagaaagtacatattttaggctttgtaagccagatactctctgttgtaactactaactctgctgttgttgccccagatcaaccacagacaatatgttaatgagtggtcatggctgtgttccaataaaactttatttacaagagcagattgtgggccaagtttaggctatgggccacacagactccagcccagctttagagcatctctgatgaacaaatcagcctttgccgtggcaaccaccaggagggaaaacataccactctttttaccagcacaagttatatcctacattcctcactgatagattaatacaaacactgtcatttcccaaatgcagttcccaattccaaaggcctttttgtctcaggttaccatttgtccgctgctagtttttccaacttaaagttttagcttgctttcaaaagggtagatgctgctagcaggagaatgtgcctctttttcctggaggttaatctcactggtccccatccacccacccccaggaaaatatgcaagtcttgcaaatgcagccaagaggaccactgcctaacatctgacctagaagacgatcggaaaattggccgcttgctgatggactccaagtattccaccctcactgctcgggtgaaaggcggggacggcatccggatttacaagaggaaccggatgatcatgaccaaccctattgctactgggaaagatcccacttttgacaccatcacctacgagtgggctccccctggagtcacccagaaactggtaagagagcttccccaaccaagcagttgttttcctatcctcataaatactagccatgtcaagtgtttctgaatttcaaacatggggtggcaagagctcaaggtcacaaaaatgacaggagtggctgtggttttagccctgcccttatatcatgtgatgttgagaaatgaagactatctgggcctcggttttccttatccatgaaatgggtagaggtgttcatatggaccccaagaggccttgcagctctagtacaggggcatttattgttccatttgggctcctcacttctgaacaggagatagtttatcactcaaaattctgagtgcttatctccatctgcaagatattcattttcccttgaagtagcctgggatatgccctttgcaaacctgtaggagagcagagaaacatttctctcttctgcctaaatgctgaaacctattggtcttaggagggagagccaaactggttttatataaccttgaacaaaagcaaccagagaaatctcaagtaaatgatcagagaaaccctgaggagggcagaaaggacacaggtccagagagagcaagtgactcacacaaggttacaccctagctgctcgctggaatccccgggacctgcagaaggtctccatacccaggtctcatcccagaccattgagtcagaagctccagactacaaaatccaaatcatcagatgtgaccatttaaatgactccccgtgcagccaccttcaagatccaatgcaccagatcagggctcctacaatctcaacatgggtagatatcacctggggagctcatcagaatgcatccagcaagttcagggccatcctgagataccgcacgcctgacatactcccaggtgatgttgatgctactggtccccagaaccttacatgtggagtaacaagaggctggatgatttctatatgttaatacaatttgtagaaggttcaacaattttaaaaatgcaagcatggcatttaattgaatatctgctggaagaaaaggagtgcctttggagcccttcatggccctatccttcaggctcctccatggctcccatcactgtgctctcactcccaacatctcaacaccttaagacactctgacttcctccttccagtgctagaacacaccaagctcctgccctccttggggccttcgcacgtcctgctccttttctgaaaggttctttccttgctcttcccaaatagtccttctccagatattcagtttacaatagatgtcacctgccatcctatcacattttttatttcttttcgtttctttaacaacttttattgcaaacagattatcttttttctgtgcctagatatgagggcagacaccctgcctgtcctgtaaaccgtaacatccctgcacccaggacggtgcagggtgcaggacaggtgtgacgagtgttagtgcaatgtcaccttttaggccagagatgctctaagtgtgggctgtggactggagctcttccgcacagtctttgtgacctggacccaatgaaaaaagttgagaaattgagaatatatgttgggaaaatgttacagcaatttgacatgcaactgtgtgatgggatgagaactcatatcagaacagaattccactgtggtaagactcacactgaaatctcatggggtatgcgctacattctaatcacatgagagagaccacaaatcactctgcaataagtaaaaaacaaacaaaccttgatccttcgccatagagagtttcagaggcacagttctaagctgttgccttaggggggaaaatcccttccagataaaatgaaaagagactaagatttttttcttaatctgtactttttgataaagaagagcacattttaaaagaacacttcagcatccatggactcgatcaccctgtaaggccgagttgttttacatgtaaggaaacacagaatggttaattggctttcaaaagtttttagtactagacaggggcttgtcccgggccacagagtgtggccacagaacaacagcagagccaggacatgcccggtagttcagagctcaggtctccctccagccccaggtctgggtaagctatcaagcacgtctccaggatgtcagtggaaactaaagcaagcagctcatgaaagagctggctgcgggcttcagggaccggctggtgaaaaccccaaacacattgaccccagactaatcaggggaagccatcgtcaggcagtgattaatgctggctcataaaaccacatggctgtaaagaacccctctgtctgctcttcatctgggcgtccagggcaagtcccatttctgagattggacaactcccccttcccactcaccttcccaacatttttattattattattattattattattattattattattattattgtactttaagttctagggtacatgtgcacaacgtgcaggtttgttacatatgtatacatgtgccatgttggcgtgctgcacccattaactcatcatttacattaggtattctcctaatgctatccctcccccaggcccccaccccaccacaggccccagtgtgtgatgttccccatcctgtgtccaagtgttcttattgttcaatgcagccataaaaaaggatgagttcatatcctttgtagggacatggatgaagctggaaaccatcattctgagcaaattatcgcaaggacagaaaaccaaacaccgcatgttctcactcatagctgggaattgaccaacttttttttaattaccgaatgatcaagactgattatattttgggaatgggaccgaattttgctatctctcatcctttgcaaccagaatgaaagtctgagcaattcttaagccttcaaatgctgataacaataagcctaattgtggatatttgttaagtatttactgtatactagccaccatactaggagctatccatgcacaatctcatctaattatccagcactgttagaagtatactatcattaccctcagctacaaagaaggaaactgaggctcagagagatgatgcaacgatgcagctagcccaatgtcccacagccgatgtaagtgacagagccaggtcttgaactcaggccaccctgactccaaagtttgggctcttccctaccaatccaggccaggccaggcgaactggcaggtgggaggggaggcaggaaggagcagataccctgggttagcattttcagggaaggctatcatgaacaggaagcagcttgagtgtggctttgaaagctgccaggatttgggggaaggaaagagggagaagacaaaggagaccagcatccactgagcatttgtatgtgtatctcatgaacacctcaccgcgccctatgtgctgagtatgttacaggctcattttacagaggagcagacagaggcccgtgaggagccaatgcaggggtggcacttactcatacctcgccctctgcttccagacccatggcaggcattacttatcagtcagagtactgtttcccattgacttcttatcggccctcaggatccttcttcacatagcactctcggtcaccactatggactggggttgacttgtcagatgaagcccatttactgttcttggctgccagcagaagaatcaggaagagaagaatcagaacagggtctccggattccagagcccatgtgtgtttcactgcctaatccagggtacaggagtgccttcccttccactttgctttgcatttttagtttctttcctgatacaggcagattcctggaacctctccacccaagatgtcccgaccaggttgcagagcaccaagtaactcagaaaggtcctcagggggccaggtgcagtggctcgcacctgtaatcctagcactttgggaagccgaggcaggtggatcacctgaggtcaggagtttgagaccagcctgaccaacatggtgaaacccctctctactaaaaatacaaaaattagccgggtgtggtagcaggcgcctgtaatcccagctacttgggaggctgaggctggataatcgcttgaacccgggaggcagaggttgcagtgagccgagattgtgccactgcactccagcctgggcaacaagagcaaaactccatctcagaaaaaagaaaaatcaagaaaggtccttaggaaaaacataaaacctaaaccaacctttccaactggtctgagaaaatgcttcctgctaaaggttatgggaacaagatttagctcctatgacgtagtcaggtatgagacgtagataacatgacgtagtcgggtatcagagagatacctgggagattctgtttcagagtcagagcagtgccaggtcgttgactccggcccaaacctctgtccctgtcatccccttcccaagtccgtgccagtcaatagtggttgcttggagggctgtgttaagagggattctgagggcttgattagcaacgtttgtgaatagggagcagtggtggaagtctcagaccagccaggcaaggccaggatcacaaagtacacaccagtggcagctggatgcagtggcattgaccatgcaaagacagagaggctggagcttttttttttttttttttttttttgtgactgcttcttcctctgtcgcagtggcaggatctgatctcactacaacctccgcctcctgggttcaagcgattctcatgtctcagcttcccaattagctggggctataggcacacaccaccatgcccagctaatttttttgttgttgtttttaagtagagatggggttttaccatgttggccaggctggtctcaaactcctgacctcaagccatctgcccgccttggcctcccaaagtgcttggattacaggcatgaaccaccatgcccagccccagctggagctttgagctgcaaaaggatcactgggtccttgggaagggaaactccctttctccaaggctccagccaggaagcacattagccctgcagccacagacacccaatgccagtgcagagccgtgaaaggacaccgtgaacgcaggggtcaactaacatctggctggcgaagccgctgccccaggatccctagcacaccatttattgtaaagctcagaagaaaagggtgcaggccctggaaagccagagaaacagacacatccagggaatgggggatcctgttaccacttgatgcttacccagcccgctcactctgaaatgatgacaaaaggaaatgcctccagagattggggaatatttttcctcttggaaaatcatccgtcttctagagaggcagcagagaagggcttgagacccatgctgctgggttcatagctgtctctatcacatactagctgtgtgaccttggggaggttacttaacttctctgtgcctctgttttccaaaaggtaacattagtaccttcctcctagggttgttgtgagaattaaatgggttaacgtgtgtgaagcacttggaagagtgcctggatcatagcaagccctccctaagagttggctgttcctatcatctcttcaactgctgaacatggagaagtcagcagtcttcccaggaagggcaattactctcccatgagccgaatcagcctggatggggctgcttcggaacttggtgttagtaagatgctagtcaggcctgatccccactctggcagagtgagccaagctcttctttccacttctccgaaatccttctttagattctggaagcaggggcaggccctgggcaagaaataggaaggggacggtgtgagcaaagttgccacccaaggctacaccctaacgcatctctgcagggctctgtgcctgccctcgcctgttggccgtccggctgccacttctcactgtctctgatggtcacatcctctttccccactcactgccccgagagaagccccaaccctggggtatcctgtgtcagagccacccaggagaaactgttttaaactgctgatagatagatagatagatgatagatagatagatagatagatagatagatagatagatagatagacagacagacagagagatagacagacagacagatagacagacagacagacagatagatagatagattttgagacatgctgcccaggctagactgcagtggtgtgatcacagctcactataaccttaagctcctgagctcaagcgatcctcccacctcagccactgaagtagccaggtctacaggcatgtgccaccacacctggctgatttttcagtattttgtagagatgaggtctctctgtttcccaggttggcttcaagcaatcctcctgtgtcagccttggaagtgctgagattacaggcatgtgccaccgctcctggcttaaagtgctcatttctagggctctccagacctcctaaatcagaacctaaggatagacccagaaaacttttcacaaggtctcccagtgattcttatgcaccctaaagtttgaggttcttcagacctacctgactgacatatttgtgctaaaagccacctgtaatttcatactgatcaagaagaaaactaccagataccccagtctcctaagacggggtcaggacgaagcccttcccagatgttgctgcagttgtgtgatgcacaggggcttctgctcgtccacatggttggtggactatcttggcctctttgacaggaatccaccgtctccttcccctttcctgaactgtaacctcgggttagtgatattgctcttctctctctcttggttatggtgaccattgaatgagattgccagggacttctcatgacggtcagaaccctagggattacataatctaccctgaactttgtagatgaggaaactgaggcccaggagatactttctcagtctgacatagagagcagcaggagaactggacctaaaaccctgacttccagacactccaccacccaggtcttctcttctgtctgagaaagcaccttgaaaagcattcagaggtgtgcagacatacctgggattagctgggtatgctgtgagcttacagtgccagaaggtgtctcagataggtgtcctctgggatttagggcagagtgaccaatggggcgtctgcagccacccctcaattggagtcccacaggagctcaggtcacctgcctttcccctttctatgctgtttcccagaatttatttactatgaatcccagcaggtaccaagccctagacttgtactcccccaccccacaacaaccctagcttcctcaccactgctccctaaaatcagacagcaacagggtctgtacaatatgcatttcagcatgaatttccatgttcactcccacagttcccaaatgagtccagccccaagcgataagctatgggccagatgggttctaggaggatgaacctagcagcagccacctcagtgataggaatcaggagactgggtactaaggttcagagtcagggtcaggcacagaaatggaaaatggttgtccaggatgagcaatttgcctctcacggtttctcaggccgtggtcctgacctgtatcttcccctaatctccccgtccctgggactcacccatgcataagaattacgttcaataaaaacaaatatataaatgaggccaaattggacagttacttgtgaacacattaatattcagacagttaccagtcatattaatggggaaatgttactgacctgagaccttgtcgattctactattagaagttgactttgcatattttttaattaataaaccatgaaataccttatgtccataatgatttaattatacttttctaagaaaaagcgattttagacaaggttgactttttttttaattaggaatgttgcccaggaggtaaatgaaataaaaatattcagttttgagagaaacaaaattcatgttgcaaagccagcaaatctaaaatgatcatctacttaaattacaccattctgatcaagaatgtgaatctctgactataacttggagcagagtaagagctcatttaggcatctctcaggtattagcaaaattcatatttcttccttgagaattcttacattttgcaaaagcctgaagcagctaggaatcgtcctctggcctttcctcagatctctgtccagtgctcgagaatcccagttgtttatctcactaatttttttgtttgccagtattttattgaaacagtagtgcaagtaaagtccaggagccaacttcttgcatcagatttaccaggattcttgttaaaaatgcagattcctgtaccccacacctcacctactggatggagatcttgactggggcttggtgcctgggaatctgcatgttagtaatttttcgcagggttattgtacactgtgtccattgagagacactactttgacatatgtagctggtgagtctaactgtaatcagagatttgaaaagagaaaagccacagatagaaaagcaaacagggtcaggtgcggtggctcacacctgtaatcccagcattttgggaggccgaggttggtggaggtcagaagttcaagaccaacctgccaacatggcgaaaccccgtctctactaaaaatacaaaaattagccgggtgtaatggctcacgcctataatcccagccactccggattctcctgctgaggcaggagaatcgcttgaagctgggaggcagagattgcagtgagctaagatcaggccattgcactccagcctgggtgacagagcgagactctgtctcaaaaaaacaaaacaaaacaaaaaaaaagagaaagtcagtagcatgtagatcaggagtgtccaatcttttggctcctctggaagaagaattgtcttgggccacacataaaatacaccatcacctaacgatagctgatgagcttaaaaaaaatcacagaaaaatatcataatgttttaagaatgtttatgaattttttacaaatttctgttgggccacattcaaagctgtcctgggccatatgtggcccatgggctgtggttggagcagcttggtaggcgctgtggttcttttaagtaatcctatagccaccctagggtttacgatcctcctttttacagctgaagaacctgtgcaaagagacggcatgacatggccacagtcacaccgccggcatgcctacaaccaggatttcagttcaggacaagccgattccagagcctttgctcttgctactatggtagaagggacatggcctgccctcagggattgaactgtcccgctagagggtcagctcaaatacactaggaatggttaaggactagggagagaccaaagcatacagtgctgcttgtaagaacaggaaagaagagagagggcttttccttccaggggcagggggaggtgtaagtccatgagtgaaggtagaaatcaagcctatcaattgtggggccagtgagaagagagcgccgagtgggacacaggttttgtgagggcagccagctggcataacttttgtcattatactgttaagagttttatcaactggctaccgtctagcaaatgatactaaagaagaggtttaaaagcagcaacttttctttggtgatagaggcaaactagtaaatgtaattattaccattaattgaaagtcagagaacagagcaaaatgagctttattcaaattctgatggaaaacctagcccatgagtaaatgtagactcctttttctttccactgccatccaaaattgaaaactacagtgttccttggagaataagcaataaaataatgattattattagcaagtagacagctagctacttaaccaacagatagagcacacaatagcagatgcaaacaagtgtctctttctcacacgcaagattgttccctgtcccacaccatgacatgggctggcccagtcacaggagaaacagaacccactgaccaaggactcatgttaaatggtacacacgcacagaaaatagcatttaaatacattaagtacaaccctacttgttatttgttccaggcagaaagaagactgggtgcccttatttaataaatatactattgtctggaacgataaacacaaagttgttggcaagctgttaccatgagccaataaggtgtaagtttttaaaatcctttttaaaacaaaggacagtcatacaccacttaatgctggggtttcgttctgagaaatgtgtcctcaggtgatgttgtctttgtgtgaatgtcaaagaatgcacttacacagccaggcgcggtggctcatgcctgtaatcccagcactttgggagaccgaggcgggtgcatcactaggtcaggagatcaagaccatcccggctaacacggtgaaaccctgtctgtactaaaaatacaaaaaaattagcagtggcgggcacctgtagtcccagctactcgggaggctgaggcaggagaatggcgtgaacccgggaggcagagcttgcagtgagccgagatcacaccaccgcactccagcctgggcaacagagcgagactccatctcaaaaaaaaaagaaaagaatgcacttacacaaacctagatggtgtagcctgctacgcatctaggctacgcagtatagcctattgctcctaggccacaaattgtacagcatgtgactgtactgaatactataggcaattgtaacacaatggtcagtcagtatttgtgtatataaacatatctaaacctagaaaaggtatagtgaaaatagagtatgataatcttatgggaccactatggtatatgtggcccatcgtggactgaaatgccgtcatgtagcacacgatcatacagtatgcatatggcaaagtgcgtgcatctgatgtgtacagcttgatgagctttgacacagatacatttccatggccctttcaccaagattgagacacagaacactccctacatacacaaggtagctaagggatgcgtgtttttcctttactaaagttttttctctcatgtgtgttttatttgtcacaatggacagtattgcttttgtaattttctaaaattacaaaagtaatctaactgcattaagttaagaaaataaagactgtgggtctttcagttgctgagaatgctggaagagaatgcattttcagttttaggtagattctgtcatagtttctttgactgatgaagccccatccacatcatgttgtctcttcctcctcctcctccctagggactgcagtacatggagctcatccccaaggagaagcagccagtgacaggcacagagggtgccttttaccgccgccgccagctcatgcaccagctccccatctatgaccaggatccctcgcgctgccgtggacttttggagaatgagttgaaactgatggaagaatttgtcaagcaatataagagcgaggccctcggcgtgggagaagtggccctcccggggcagggtggcttgcccaaggaggaggggaagcagcaggaaaagccagagggggcagagaccactgctgctaccaccaacggcagtctcagtgacccgtccaaagaagtggaatacgtaagtttctcccatgcttccagccaggctgaaaccatgcaggcccagggctggacagtcagggccccatcacggggctttgttccctcattcatgcatttattcatgaatttgtgcattcagcagatattgattgctcatttagtctgtgccaggcactgtcccatggaaaatgatacaataccactgcccttgaaaggctcatagtccagtggcggtcacaggcaaaaccgaaacagtttagagaagggacatctaagcctgcttggtggtgagggtaagcttcaagaagttggtgaggtacaagctggtctacgaagaatgtctaggggtcatccaagccttcaggctttgaggggaggatgtgtacccccttaaagaggtgagcatttgcaaaaagagccaggagttcaagaaagcacagtgcatttagaagattaaaagaagtcccacgtgattgaaagtgtggcatgcttggggagctggggacatgaggctagggagggcagcagaggctggattcctggagggttcattccatccatccattcatcagtcaaatactgattagcttgtattagctgcactgccccaggaaatcaaacaagcagaggacactgtccccaaactgcagaatgccatgaacttagttaggactttattccaaaggtcatagacaggcttttggtcagaggtacatggtccatgctgtgcttacaaaagtttcctctagcagtgtcttagtacattttctgttacttatagcagaatacctgaaactgggtaatttataaagaaaaggaatgtatttcatacatctgtggaggctgagaagtccaaggccaaggggctgcatctggtgagggacttcttcctggtgagcactctctgcagagtcctgaggtggctcagggcatcatgtggcaagggggctgggtgtgctaactcgggtctctcttcctcttcttagaagccagtcccactcgtgtgataacccattaatctattaagccataagtggattaatccattcctgaggacctgagccctcacgacccaatcatctcttaaaggccccacctctcaatactgccatgcagaggattatgtttcaacctgagtgtttggaggggatgttcaacccataggaagtggcagtgtggaagaagtgctgctgaggagtgagtcactgggggccattttgagaaaacagaaaggagaagccagagttggggagatgaaagcctcatggcttggtttgtcttaaactgccccacagaaggcgaaaggaatgcttgaggctggaccacgtgggtctagcgtgtactgcgtttctggtccccagcccctgttttaccttttgctcctcctgccccatcaaccaagtgtcttcatttgtttctatggcaattaacttttggagatagaagtcccagcacacgagatccccaagcacattatctaccttgctgaacaggctggcagtcacacatgagccaggcgacccagggaaatgccagcccaaacaaagctgctgccacatccagagagggccggactctttctcccttgtagtcactcaagctaatcatccaaaacctgcatcctccatctccaagccccatcttattagcaccatctgggattgccaaccaagaaactgttttatctgagaactctaagaccaaagaacaagatttatttcctctactacagatttggcagtgacgcataaaaggcccatttctcaggaagaatacatgtcctaaggatgtaaaaaagaaaaaaatattagatctagttaccatggtctataaactggtcttttcccgccccaccctgatcctggcttctgtccaccctcaaatagctgtttgttcataaaccctaaatactagataattctaagttggaaggagacctctaagtcactgtagcatttccaaatcgccattcccaagagacatgtggatctgacatcgtgttttattcttgactgagcctcgcatatttgttctgtgtggaacaaaggcaaaggcagcccaagaacccgggtccttgcctacagtcagctttaggaaatgattgtgaacttgggaagcatttaaatagcaatactagacagtaaatggaaaaggccaaagtcagaaaataagtagggattccaaaggaagcctttattggttgggctaggctgggctagctgtggaagatagacttctatgtccctgccccaaccacaattttactttaattattatgtaattagtgaatcgatgtctgtcaccgtctgtagatgctgaggtcttgttcatctctttatttgcattgatatacatagccattgctcaataaatatgtgacccatgaatgaaagtttgaacttaagccttaaaaaatgggatctatttggatggccaatttgcctaggcggacggtgcgattccagttccacatttattaagcccctgctctgtgccaaacactatgctcacactgtcagggtctatctttaattcttacagttgtctggtaggatgaattttaccaaacccattttacaggtgagattcaaggataataggtaacttttctaagatcccacggtttctatggggcagaacctggatccaataccctttctgtgataagatgctaagttgtaaaacccggcttgttatttgttccaggcaggaagaagactgtgtgcccttatttaactccctttttacctccttgaagcaggggaggtaatcctgaaaagggtagctagataggctgacaggccacagacagtgtgttcccagcaaccccgccattaggagtgggtgtgggctgcactccctgacccgtctgccttgcctcaccagcattcacatcaagtggacgtgtgtgctggctgccctgtatgcttgcaccctctcctttctcataaaagggcagcatagaacaattaccagagccaagcatcaggcaggaagcctgacttctgctcccctggtaaagggcaatgatttttgcaagaagtggtccaggcattcaacttgagaataaaggtgtggggaagaaattgtaggactcagcctgacaccccaaaaccgaacagagattaacgggagaaaaacgaagggcaaaaagagacatgaacatacgggaactgtatcggtaacacctgcctgtttatcatcttaatcgtgttcgttgtgtttgtcgttactgtcagcaagtccgtgggcattgcctgaaccaaggacaggactaagcaagtatctgatttaaagcttacaactgccccaagatgtgaagtggctgtgcctccccaggctgctgggcctcagaactgggattcagttgaacgtctgcctaaaatcaagtctatgttctttcccatttcccaaagcttattcctgggagagctaccagatattctggaccataaaaggatcatgtggctggctcaggagacgttagagtgaacatgaaactacgtgagtttctttacagcagaacttctcagagcctttagtaggcctatgctgtggtccttacactgaaatcacctggaaggcttgttcaactccagaaggctgggtccccttccagagcttatcagtaggtgtggggtggagccttagcatgtgcattgctaacaagtcctcgggtgatgctggtctggggctacactttgaggaccgctgctaacagtgttaaaaagtgccttacatgtgagctcaacagaaatgatatcaccaatttggcctatagtgagagtctagatggtaacatgggcattttccagatgtatttggcctgctggctctatgtatgtatgtattttgagatggagtctcactctgtcgcccgggctggagtgcagtggcacagtctcggctcactgcaagctccgcctccgaggttcacgccattctcctgcctcagccttccgagtagctgggactacaggcacctgccaccatgcccggctaattttttgtatttttagtagagatggggtttcatcgtgttagccaggatggtctcgatctcctgacctcgtgatccacccgcctcagcctcccaaggttatgtatgtatttatttatgtgggatagggggtggattaccccaagcgagcccacctttgagaatactgcataaccctccctgttcctggagagctctggaagcacaggtgcagaatctaccacactatgctctgtaacctaccttgacggcccccatccctgatgacactaagtctctgcaatctgaggccagggccccactttcccctacacccaccccccgacacacacaccagctgtgagctccctcggctccctcccaccttgtccacctgctgggggacgtccttcctctgagtccttgggaggtggcctattggagcaatggcagggtcagcctgccaagttctcccacccagccccccacctaaccatcctcattggaaaaaaatgtccacaccagagaagcgttattgcaaaaatgcctgtatggaattcctactaaggggccatgttctgagtgagcccagataacagtggtggccaggttgcaggacacactgctgtctgagcccagcccacctgcatggccggggctgtcagttacacagatctgaacacagtgagcagaatctgaccccacccccagcttcccaaccccaggccagcagacgggccctactgacgagacggggccacctaaaattagccttggcacctcggtccacttcagaaatgaaccaaaagctgtggctgtccatgcctacctcagggcagtcctctgaaagtgttattattacactgaggttaggagaggcaggatatcatgggaaggtcctccggccaccaagttgtcagagttgccctcttcatggggcaataccaagcctgaaaaatcccagtgccagatgctactgcacccactgtcacccctgaagaagcgagcccttttccatcagtgaggccaatacaattcaaaaatatttagtctccctcttttcctcacatgtcccattgtgcggggatggagggtaggaaagaagacaagttgagaatcaagggaagaaaggggaaactgtgaggctgcagcaggcactgtgtaaggtctcaatctctttatttttatttttttagatacacggctctcactctctcacccaggctggagtgccgtggcaggatcatagctcactgcagccacaaactcccgggttcaaaccatcctcccgcctcaacctcccaagtaataaacctctttaactcttggtaacaaccagtgagagaggttggggttgtgatacccatttcgcagatgaggaccctggggcgcagtgaggttaccccacgtgctgatgagagcggggcttcggttcaatccccagtccttctgcttcaccggcagagtgaagtctgaagccgtgttggggtggggcctcggcagggtgggtccgaccatgccaggggatatatatgtgagtgtttaggttctccagggtgggcagccgtgtatggggtagcttgcagctcagcccactgagcatttgggagcctcttatctgcgtactgagaacaatgaaaggattcccatgtccacccccagttccacccactgtgggttcttgtgggccttttgagtatcagagatctccgtggccagggagctgccgactccagcaacctggacccattcacaccaggctggtgggagcccctcgcgcactctccaagccctgcgctccccacctggatggaactgatgggcccctgagctgggtgggcaatgatcttcatgttctgactcttagcagctccaccaagccattgccttgcgtttagagagctcgctgaatattttctcagaaattaaatacacagatttcccgggtatggtcattttgcccaggaatttccgcctttctccacaccccgaacttgtaactgaagaaaggggaaagaaagccagagcatagcctttaatgtgatctctactctttagcatttaccattcctgccgggcgcctccccgtcttgccccttccccaaccactccttcctcaggccaagtgactgccccaaaagagcaaacttaagaggaggacagcccattgagagaagtgaagatgttccccacagtcataaaaacgcgtgaatatggtccgaaatcatcctccaggatcctgggagcacagtctgacccctctgccccatttccccacaagaatgctgagagggggacgggaggcctccgtcccctccctcccccccgccaaaggtctgcttttcagatggaaacttacagcagctggcggctcagcccaactccagccccaatagaaggacatatttgtgggcaagggacttccaagtctttgtctaagcagatgtttggcttgtgggctcggcaggcaggctggctggctttcctgccagccccacttgggaatttgaaactgccactcctccccacttagtgagccccatctgagctggaggacaggagggtaagaggcccagagacaagcctggggtcattcacccagaggaatccctgctccccacagtcccgccacccctggctcaggcaccatgggcaggagcctgggggcagccgcaaaatcactatggttaccagcttctcggcatctgcctgcctcttgctttgcagtggagatactttagtgactttcagggagatctttttttttgttccaaagaaacttccctttctcccactttttatactatactataaatacttttccatgttgccacatggccttcaacgagcttttttttttttttttttttttttgagtgggctgcatattattccattgattaaaacagggattggtaaactttttctgtacagggcatatagtgaatattgaaggtttttcaggccacatggtctctgtcacgactaattaacacagctcttgaagcactaaagccgccataggcaatatctaaacagatgaccctggctgtgttccaatcaaactgtatttacataaacaggcggtgggctagatttggcccacagatggatgcagtttgctgacccctgaactggaagaatcataaagaatagttttagctttttattaatctctttggttttactcaattttgttttgctaatatgagctaaatgatgacgatgatgatgatgctgtcatctcccattcattgactacctaggttatgccaggcactgtgccagatattttgcatgttattttacttaatcctaagaattatcctacaaagtatatcatcctcctttttacaaacaagggaattaaaagacactcttagcaaagttaaacagtgttttcaaacttcaggtcacaatccgtcagtgggtaatacatcaatttagtggactacaaccagaattttttttaactgaaaagggaagagtgtttcaggagtagtaaatatttttccaggaagcttttttttttcaggagtgtgtgtgtgtatgtgtgtgtgtgttggatcaggacgtgtaatgtatttgctactgtggattacagacaaaaacaaaaatttcaaaaaacaaagctgaggaaattgtctagtcacctagatggtgagtagttaatccagaactaggatccagacctgcctcactccaaacctgacacagactctaattaacaggtgttcccatctctggagcacccacgcagttctaagccccgggcaaagccgttgcaattggaatgaacacatctgagactccgtccctgctcagctgtggaccaagcagcatccttttgcaaggagccagtccttgggcccatgcttgtcagagctggatttgagaacaacccacactgatgttctcttacacgtgtagcatttatgaagcctttccatctccctcacttcatcacataaccagggagggagattcagttagaaatgtttaatattttgccttgcttggcagagagccccataatggataatctgccccaagaagaaatgtaaggtgaaggggtcagttaacagtagtgaccaccaacaccaggctaaggcatttcgtatgagccagggcctgccacgatgtgctacagatgagaaaactgaggttcagagggttggatgatttttccaagagcttcaccagtgatgaagccatggcatgaaccatgttccaaagcacatgacccaaaccgttgcctacccaccctgcccattctgcaccatagggagccttgggaagactatacagtgtggggaaacagaactcaagagagctaaagatgccagaaatgatgttagactacagaagaaagaaacacacacataaaaacctctgggatacatgaggctgcaaagcaaagatggtaaatagtcaccataagaggaaatggagagatgctgtttataaacaaattgttgagtatttgtgttggaaagaacccagtgcctgaattcaaggcccttgtgttaatatttactgtattgtagtagtgagatttccacgaggcactctgggtttagactggataggcctttggataagagccttttggaggaaaacaacacaattcagacagaacttctggcaaacccgagacagagattattgctgatttagagccttctcatatctgctgatccctctctgaaggccaacacagttcagtccttcgagacagttcttcagctgagtaacccttggccattgtcccgagtctgctgttgcctaaaacactttgtgtcttggttactcctatttcagaaaccttaataattctgcatgtacacatttgatgtttctgtcacctagggctgcatatcaaagcatcccaaggcatatggctgaaaccaacatgtattttgctcacaaatcaccattttggcagggttcagtgaggacagcttgtctctgtccattcggtgtcacttggaggagcttgcaggccagagactggaatcacctgaagctcgttcactcatgtgcttgagctagaggctgggaagacacacacagcagggaccctccattgacctccttgacctccgaggtctctccacgtggttgccctcagatggaagcttcaggataccaagacttctttcctgtcagctgagggctcccaaggtgtgtgtactgagagagagagcccaggggaaaacactgcctttattactaccctgggagctgcatagcatcacttcatccatgttctgttctatagaattgagtcactaaggtgggaccatattcatggaaaaggaattaaattctatgttggttggaagggtatccaagaaatttgccaacatgacttaaacacccatggctgagggaaccccacaactctgcagggtcttagcttttgagcagctgaatctaaaatgttcctcagctttcttgaggcaggtgtttacaaattgcaaaggccccaatattcaaaatctttcatttcaattaagaatctcatgccattagaataaggaacaaggcaacactttactggcacaggaagaaacttcccatttgttctatttctgaaaggtttgtttcacacatcctctacccaggtgggaaatagtctgcaaacaaggtcacatgacaaatgttggaaacgttctcacgagcaagctccaatcttagatatttgggaacatgaacaagaaacaactgatatgctaattataaagcattcttctccatgccttttaccatagtcccaaagaacttccatttgaccatactagctccttaataggggaagtaacctgagaatggcctcattggtctttcttaaaaaatagtgttgagtttaaacatcccaggaattcaaatgagcctttgttgtaactgaactgaattggtgatatcagttttgctgagcttatgtataaagttatttttaaacagtctataacagcggttctcaaagtgtggccccaaccacaccagcatcccctaggaacttgcaaattcttgtgccccaccccagatctactgtatcagacactgtggggaggtggtggcggtgggggagcagagatatgttttaaccagccctctaggggatactgaggcaggctcaaccctgagaaccactgtctccaggggcaggatcagatatggggaggagcaggccctccaagcaggggatgagtggagctgagtctggagcagtggcaaatgatgaaaaactcacacgactcgattctctggccttgcacaaatggagagaactgataggggaaaaaatagagctcatcagtggcaggaatgacttcctgctagtctacatgcccttggtatcatggaaggaaatccaggcctccaaacctgccttcaacatatctttgtcattttaggaaagtggtttaatccctctgggctttacatttctagcctgcaaggtgggcagagttaaggaatacacgagattttagcaaatcattattgagcccttataaagtccaaaaattccattatgtcatttaactcacaccacaatcctatgaggttgctatcattactatcgccattcaacaggtgaaaaaacagaggcacaggtaagttagttcatttgcccaaggtcacacagctatgaacccaggcagtctgacttggtatctcccctctcagccacctgttgcaatttagaaattgcaaacctcgctacaaagaattgtgggagagactaagtttgtgctgagaaagggccaggatgatgagacccaagtaggctggcattctgactctcggctgctagcttgtctctcgtggctgagggaccaccagacgatagatccaggacaacctcaggtctctcatcctttgagatgactgagttaaggatacagaaaatggcttagaggcaagaagagcacatttcatcctgacacatgttgagagggctccttacctggacatcttgttttcatggagtgataatgatactgtttgcttaaaggggctggctactggtagaaaccagtccaagagccagggatgctagggagaacagtgagggaagaaatgctcctccaagaggggcttcacaaagtgctttccaacggatgagaaggttgcaaacaagctctgtgaacaagaattttccttccttccttcatactgctgcgagaatatctccctacagtgcaaattagaaccttgaactcctcatctcaagaaccagtaacgggttaggtgcagtggctcatgcctataatcccagcactttaggaggccaaggcgggaggatcctttgagctccggagttcaagaccagtctgcgtaacatagtgggaccccatctctacaaaaaatttaaatatttttaaaatgtcttaaaaagaaccagtcgtggctacccattgcctccagagtgaagtcccaacccataacctgggttcaaagccacccatgatcaccctaaactgccttttggacctgatatccccctccttccttcagtgtatcatcagggtgcctgccggtgctccccagaccaatccaggtgcatttctatccctctccctttccctactttcatgtcaattcacatttgtaaatgtggagtggggagccccattgatatatcatggtgttacccaatggggtgtagtttggtgaactgacacgaagtcccttttgtgtgggagggaaagagctggaaatttcattctgtagaaataagaagccagacagacaactcactttgtattcagacagccctggccaaagagtttacagttcccagctatgcaggagggagggtgaaaataagtagatgatgactggtcactgattttttgtctagaccccctgatgggctccaagccagctgagtctcaatcatgtgaagaggaacagggttttcatttgagcgaaaaactcacaccactcattcttgggggtgtaactgaaaccacaaatctagcatgttctaaggaacattatcaggcacagtcaggatccagttcaagatatatctagttgaccaaacacattccttatataggcagtcattcaagagctcctacgctcagaaactgctatcagtacatgacgttccttgttattcagtgttcttttcctaattttcaccattttaatgtttatttcctcttcaatatatgagtatattaagtatgtaatcaaagtatataagttaagaatagtaagtgtgcaaactcttatgtgcttccctgtcttcacatggcaaaaaagtaaatatttctattttggctgaaacatagttgatacttactaagtttaaattagcatctaaagccaggctcagcaaacactttctttggagggccaggtgataaatattttaggagatgtgagccaagagccaaaattgcaatatcatgtgggcactttatgtaacaagagagaaaacaactttccatgggttttttaaatgaaattcaaaagataataataattgagcacagagtttttttttttttttttccaatataggtctactaatgagaaaagcagaaggggttctttcttgggagaaaacatttcactgaattggagggcaaatgtaaaatccagtcttcattctcatggggcttgcgagaacagacagtggctgggtttggccatgggccgtagcttactgatgccggatctcaagtccacatgatggagtagaaagaactttggctttggagtcaggtttggcctttgttcaaatcctagctttgcctcccatcagctgtgcattactgagcaaatcactgaatctccctgaccttcagttttgtaatttctaagagagaagataatgattttccgaatagaaaaataactctagaaggagaaataactctctcgggcttatgtaaggggtaatagtaatgcgagcaaagtcctgagcacagtgctggatgcagacacgctgtagggacatgacagccattgtcgtttccatcatcatcggggcttacaggagcaggggataactccaaaatgactcaaaagattgtgtggattgagaatgtcaagttcccattctttagaggatgagaataggcaagttataaatgtgcgatggatggatacctgaatgaaccagtgaatgaatgagcatttagcaactttcactgctcctgggaactggcagaagacagaaatctagagctctcacagagaacttctcccaggcacactcaccctccccacaaagccccaatcctaactgaagctgaggaacaacatgagttgaggtccaccttgtcatggtttctgagcaggccagtgaaaatgttactggcagtaaaagacagataaaggagccccagatggaaagaggatgacaaacagccaggcactggctacattaactgctgagaggccctgtagggaagctgcttctcacctctagccattgggcatgctgctcctttgccatgccagaatgcattctcctgggagccctcctagcccttcagacaattccctgagtttagtctccccacccgacccagctcagttcccatagaaagccacagagccaagggcggcagtttgaatcccagctctgtttcttggctgtgccccccttcacaagctattttgtctccttgggcctcgctggtcttatctataaaatgagtgcatttcctgtgtacctacatctcctatccagaggattgctgtgagataaataggaatgtggttgatccctagagcccctcatccctcagagaggcctctcctgctaaggtggtccctgctatccacccccaaagtcactctccattcccttaccctgtgattgttttcctagtatttatcacactccatgattatctcatctgtttttttatatatttattttctgcctccacacacacaaagctccagtttccctgaaggctctggcattatctgcctgggtcactgctgtatccccagcatctagtccagggcctagcacacagtagatgctcagtaaacatggatgagcccctgaaaggcaagagtgttttgaaagctcccaagaactttccacaactgtctctggagcccagctctctgctgcacttagtctaaacctgtctctaaggtgcagacagatgcatcatctgctagtgtcttccacactcatctgttgtcccctaagtaggaagtatgaggtgggagggcagaggtttccaaatatttattgttcatctactatgtgcctggcaccgaggagatgtgaaagcaagcatagttggatgtggctcctgcttccatctagtgtagaaagaacaggtatcaaacaaccatacagagaaaggtaagcagagaagctttattatggacttaattgcccctggaaggaggtcagagaagatttcccagaaccaaagatctttaagtctcacatctgaagaatgaaagggagttaatcaggcaaacaggaacgggaacaatgtaccagacatcctgaacagcaacggcaaaggcctcatggcagggtggagcattccttcattcagcaactattgatggggaatttatgtgtgcggggcccagtagagggtcctgggtcagagctgcaaccaagcagcctctctctgccctctgcagctagccgcttagtggagagaacagatataaattagataattccataggtatttaaaaaataatgttagctaacatacatggagtccttttgggggatctgccaaaatcatgcatgggttccaaataacttatgtagatacttggccctggaggagatggagcactctttagacatggagggcttggtgacttccttccaaagaggatagtatggaagtggggagaagagtcactttacagtgaagaatctgacaaacactgcctccaccagaaggtcaaagtcaaccgcaacagtgacaagtgagggcgacagtatgtacccttgaaggatgtgataagaggagcagtttgccccgtgatcttcctcccaacgtactcatcatagtaacatcaggcaaatcccaactgagggacattctacaaaacacctgaccagtactcctcaaaactgtcatggtggccaaaaacaaagtctgagaaactgtcccagctaggaggagcctcaggagacatgacagttaagtgaatctgggatcctggaatagaaaaaggacattgggtaaagtttatgaacacgtgaataaagtttggactttagttaataatagcatatcaatattggttaattaattatgacaaatataccttattaatgtaagatgctaataactcaagaaactgagtgtggaatatatagaaattctctgtgctgtttttgcaatttttctgtaactctagaactactcaaatattattattattattatttgagacaaggtctcactctgtcacctaggctggaatgcagtggcacgatcatagctcactgcagcctcaaactcaaactcctgggctccagcagtcctcccacctcagtcttctgagtagctaggactacagatgagcaccatcacaactggctaatttttcaatttttttgtagagatggggtcttgctatgttgcccaggctggtctcaaactcctggcctcaaatgatcctcctacctccagttcccaacgtgctagaattaaaggcataaggcaccacttctaggcaaaaatattatttattaaatattatttaaaactcttcatgcacgggtaaaaagatccattcaaagtgcaaggtaaacaaacaggttttaatgtaaacaaatatgaaaggttcactgatgtgctttcagatttcacactgcaactaacttgagaaagtatcctgtgtcaaattttactgtagtatcaaagaagaatatccacagttgcctggaaggtcctttaaaatgcatcgtcctcctttttccaactttatgtcagtgtgagttcagattttcttcatgtatttcaaccaaaacaacagcatgcaaaagatgggctgcagaagcagttatgggaatccagcaatcttctgcaagtcattgaagagatttgcagatatataaaacaatgtcttaaaattttcttctactttttttgttttgaaacatatagttattttagtaacaagataggtatgttaatgtattacaggtttagtattgtcatttttaaatgaattaaaaaaatttaaattgttctcagttttaatttctcttatggtaaatatcaatagctattacccacatgaacaaaaactctgtaggggtcttgataatttttaagagtataaagggtactgagaccaaacaatttgggaatcactgtgctaaataaataactttatttagtcctcgtgaatagcctgttaggtaggcaatattattgtgtcgctttgcagatgacaaaactgaggcacgaagaggtatagtgacttgcccaaggtcacccaggaagtagaaaggctggagctggaattcgaacccatgtcactgtgctctcctgacttccttgtctcctatggtccttccccatccttccaggtctgcgagctctgcaagggagcggcccctcctgacagccccgtggtctactcggacagggcaggctacaacaagcagtggcaccccacctgctttgtgtgtgccaagtgctccgagccgctggtggacctcatctacttctggaaggatggtgcaccctggtgcggccgccattactgcgagagtctgcggccccggtgctccggctgcgatgaggtgggagatagccgcgagatgggttagggggcttgagggacactgctgagggtaaaagcccagaggccaagaggagcatggctttgtggatgatgtgttctacagattgggaaactgaagtcaggcctcactgcatgctctcaaccttcattttctcatctgcaaaatgaggcagacaaccatgggattgttgggaggggtcagacacagtgccggtgaatcttgtccttggcataatgcctagcacttagtaagtactcagaacatagcaggatgaaccaggaggcattgcccacgttcaaacctgtatctgcatctcttattattattatcatgtggttacctaactccggagcctcagctgagtctcagttttactacttataaaatagggatgagaccagcgcccatcccatagagtggctatgaggatagatgagataatgcatgaaaatgcttgccacagggcctgacctaggaacttataaatggtagctgctgttagtcttacgataatatactataatatgagacttaacattaatatgacacaatacaatacaatatgatagagatgctatgaaagagattcaagtctctgatactggtttgatgaaagtaactctaaggtgtattaataatggcaatactaattatgatcatagtatgtactatttgcatgcctttggttgcaggcaatatactaacttcatctttggcatgtatgaaggttagaaatgtcttctttatattgaaccaacatctattttctaccaccttctacgaattggtcaccatatgaagttaagaccctgtagtcctcttacctaataactctgttattaagtgatattaagaaggaaaaggactgtcacaggcctgccctggagcctcatttttgaagtgacaacagtatatgcacaataacaattctctatcatttattaagggcttacggtgggtcagtaatttgctacatactttacgtacaacatgctatttatatcacaacaatcctttagggagagataagcatgattttttctcatttcacgtttaagaaaagtgcagctctgaaaggtcaatgctaattagatagccctgactttgtgtcagtcaacattctaagcctttcatatgtagttggtcatttggcaatcatagaaccttgtgggatggaaagtatttatatccccattttacagatgtggaagctgaggcacagggggattaagtaatttgcccaaagtcacaaagctggtagatgtcttaagtgaaaactcatacccagttcttgtttgactccaatactagaaggcccattaaacattatgctcctctgcacttcctgagcctcaggggatccttacaatatgtctattccaagtgtcacttcattccaagcccaagtgaccctctgtattcttgctcttgatgattggccattggcagtttatctatccttaagctttcttcaccagggtgtgtaatcccaccttggaactaaactttagatttgacccaaagagtatcacagatacctagataagtaaaacctgcctgtagtggaggattttttttattccgtctgagaagctaagatgcaaccacaaccttcaccaaatattatccttactgcctcaaatttatgccagatttttccactaaggctttaaaaggtcaaaacaagaataggatgggatgaaccaccaccctataacttgtcctagatataccgtctctacctagggacagaaactgagtcatgcatttctcctgctcccctccccagataatattcgctgaggactaccagcgtgtggaagatctggcctggcaccgaaagcactttgtctgtgagggttgtgagcagctgctgagcggccgggcgtacatcgtcaccaagggtcagcttctgtgcccaacttgcagcaagtccaaacgctcctgaagggctgcccacccacagccagaatccacaggatcccaccgagaaggagagccaggtgtgccgagaccatcctaagggtccgatgtgacagcaagcaagtgaaataaacaatgatttgcttttcagtgagaatatatatatgagatatatatagatatatattctaggttgggtggtggtagatccttgagggtcagtagtttcaaaaccaaaaatattctaagaagtcttaggatggagttccttttctttctgttgttgtttcccagctacaaccaactaaagacacaaatggcgttctgcaaggggactctgggaggagttttccagaatgcaattccgagtgagcaaatcgcatagctgtagaatgtgcgtgcttttttgtggacacaggagctcctccaggagcaggctgggatcccaactatcgcttgttgcctctttttcaagtggaatttgaattttaaataaacaactttttttggcatgataaacagatcaataaaagttttgtgaattcc

SEQ ID NO: 38402 - DNA, 1471 bp, Homo sapiens
aagtgcccgagggcggccgcagaacggtcaatttgagccgcgtcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcggtgcgtccgagcgcgacaccgcccgcgtcgggggcttgggagcctcggggcgcgagctgtgttggaagcaaagtcctccttgtgggttggggtggcggagggagaagggaagcgagggtcgcggcgggaccagacgccccagtcccggcccgcccgcgactactgaaggcgctgccgcctgacctgaacgggcacttgtgttccagctcccctgggacctgtggccgccgcccacagaccatgctcctggggcgcctgacttcccagctgttgagggccgttccttgggcaggtaggaagccgcgcgggggcggatgggaggatgcacacctggttaggagtgcgggtctcagcagctccgctggggcagggccggtggccacacacacactctttcccctctaagcttccgatgctcacagagggaacctcaggggttcaggccaggaatgaggtgcgggggatcctcgctgggacgaacctgctgctcctcaacccgacgggcctgtgtggtctcgcgagcggtgaccgtggcgtctggttttctgcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcaggtgagtggccccctgcttggccctgggagggcaaagtgctgagaacacgtttctttgccacgaattacttggcggtccctctctctgcgtcttgcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagccttt

SEQ ID NO: 38403 - DNA, 1471 bp, Homo sapiens
aagtgcccgagggcggccgcagaacggtcaatttgagccgcgtcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcggtgcgtccgagcgcgacaccgcccgcgtcgggggcttgggagcctcggggcgcgagctgtgttggaagcaaagtcctccttgtgggttggggtggcggagggagaagggaagcgagggtcgcggcgggaccagacgccccagtcccggcccgcccgcgactactgaaggcgctgccgcctgacctgaacgggcacttgtgttccagctcccctgggacctgtggccgccgcccacagaccatgctcctggggcgcctgacttcccagctgttgagggccgttccttgggcaggtaggaagccccgcgggggcggatgggaggatgcacacctggttaggagtgcgggtctcagcagctccgctggggcagggccggtggccacacacacactctttcccttctaagcttccgatgctcacagagggaacctcaggggttcaggccaggaatgaggtgcgggggatcctcgctgggacgaacctgctgctcctcaacccgacgggcctgtgtggtctcgcgagcggtgaccgtggcgtctggttttctgcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcaggtgagtggccccctgcttggccctgggagggcaaagtgctgagaacacgtttctttgccacgaattacttggcggtccctctctctgcgtcttgcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagccttt

SEQ ID NO: 38404 - DNA, 14119 bp, Homo sapiens
ctcccgggtcagctggtgctggcgtcaggcgctgggcgggctcgccaggacctggcaaggcttgtttactatggccgatgatctggagcagcagtgagttaatcctgtccctttctctctttctctctctctctctgggccatgatcctgggactgtctgtggctgaggaacagttgtagacaccttcccgctcttccttttccaggtcggcctccggggagggcggggggtgggtgcgttgcttgctttgcatttgcccagaagaggcagcggctgagcctggggagccatgggagacgcgctcgcccgcagcccggggatcctggctttctaccttagtcctcgcgagtgcccctcattctcctctggcctctggagagattccatgttgatgtgtgagatccccgaaagcaagcttgtgggacgcgggtgcggaggtagcagccaggcgtgctcgtctcgacttgccccccagaacggcagtcgtggggatggagagagcctcctccctccgcccggcaaagagaagatgtggagagactggagaggtctccatcgcgctgaaattggtgtggaacaacgggcttgcaagtttctttagctgtcgcccaccgagacacgtagccgcatgtgatcctagttgataatgcttttaataatcgtaacaacatctttaatgcaatggtttcagatttagagctattgggatttgctaccactctttcaagggcatcaggtttgggataccacctgtaggtggtgtgactagcagttcgcaatctgacaggagtaagaaaaagttgctacgagaagaatgactcagctcccagccgagccttggtttcaccagaactgggcctttcctggacccagtaatcctgtttttcagacctgtagaactggaagtccggggaactaattaactttatgaccataattaatagcttgctgggcttgaaagaaatgtccaggggaatgttttactttctaagatgacttttccaagaggaaatttgcaatgctttaaaggacttagggaggcagaatattagagctggaggacatgcaggtagttcagctcctttttaaaaatgaagaagctggtgtccatagaaattaggagacttgcccaagatcacagaggtctagaacaggattctctcccagcacagaaccccttgtgcttcacccccatcaagttgacagagaccgtcctagccaggttaagttcatggctgaatgtcttttctgctccttgcctcaatttcccaccccagcccttacctcccgcatagttttgagcacatacagtgtgccaggcaccatttccagtgtttacttgtaacatttttggtgaagaaggaaagcaaagtaattctcccaccaaggactctctgctgagcagtctatgatgctgttccttgggtagcgtttctcctgaactctgctttgtacagtaacaggacaatgtgggatccaggtgttatgatctgacttgtcacagtctgtgatttagagagaaaatttgtctcttaaggctgacaaaatcctgtggtcttggtccccgtgcttcaagcctacaaggaattccagtagaatattaaaaggattctgagtctccctaggattagatcgattgatattgacaactctcatctggctaaaaccattgatgtatcactcccagctgcaaccccagtttttctttcaaacttcaaacatccactgagagttgctacttgcaaaacactgggaatgtagacaacttatgatttagctggggggaaagaaagttgattgggagtttgtgctaggcaatattctatgtgctttagatgcattaacacttttaatctttatagcaaccctatgaggtagatattattacctcccttttaaagatgaggaagctctgacacagaaaagctaaataatgtgcccacagtcacattgctggtaagtgacagtgctaaaattggaactctggccttcagagtttagatcacacctcccttgagaaaacagacataaatgtaaaaatgtggttatgttctgtgaatatttgtacatgaccttgaaaagctgaggctggaaggttcagggagagaaacctggatttgagataaggggctctagttctggttctttttttctaacttgtatgacctctttgggcatcagtttgctcatctgtaaaatacagaggctagactagttgattcctaaggaaacatcctaatctaaaattctgtgcttcaaatgatgtatcaggatgcccagtgtgggccaaggggatttggtaatggttcccctcactcccccttagagtgccctaccttgaatatgccagtgttcacaggcccttcctatagctgtagatatctgtcctgtaactcaggcagagttcaagaaaagagaaatatcatatggggttaacaaggaataatacaaactgtcattcattgagcatctcatttgtactgggcatcttacaagtgtccttacatatacagatgctcaaagacaggttatttaatgggccaaaaccattctactcatcaatgataacactatgattcacgtccagcaggggtgtgtgtgtgtgtgtgtgtgtgtgtgtgtgtgtgtgtgtgtgtaattccaaagctggtgcttttaacctctaccttgcaatgacttaaggtccctgggtatgaaggagaaaacaggatgagttatctgtgttaccgcatgtcattagaggtgaggacataggtgagctttctactcattttacaatctagaaaacaagaccagagggaacctgtgtcctgtcagtgaaccataacagaacttgaatccaggtctctcacctcctcctccctgcctaccccatctccatgggttggactgattgattacctgagagatcagttgggcacaacacagtattccacacttctaggggcttggaagagggcatacataaacaccaaccagtgccctgccagtagggcagatggcatgggaatttgtcctactgttaaggaacagctagtactggggacagcaaaggataactgaaacattagttaaaagatgcctctccctttaatctccttgaacataaattatgataatcagtaacaaggagaaattagaaagctgagataataaatgtgacagagctttgtaaactctaaagtattatatacaggatgttctgaatatctattgaaacaaggggcatgttgttaatacccatttaccaaaaagaaacaatctatcaggtagctagggaactgctgcctgccatggggggcaggtctctcaaggctaggaaacaccctgcttcctgagaactcttttgtaactctcagcaaggctaagagcatcaatgtttctttccaatgttgccaatgagtgtctctgtctcctcctcccaggtctcaaggctggctgagtagctggctgcccacgtggcgccccacttccatgtctcagctgaagaatgtggaagccaggatcctccagtgtaagtagaatggacagcttgtcccacctccctcatggagcccaagaaggattcaggatcttcccagagcctgctacattgagcccactgattcctaattaacagtgtgtatggggtgggaggaaaggatgtcagttgtgtgagggaagaggtgcatacagacggcaccatatctgataatagtgcttcctcaccatctccctagccatgtggatagttcctgccacttcctgcaacttcacctcaaaccctatgccagtgccggctaacacacacaaacacgtacattctccccttcctccttccttctcccccatttctctcttcctcccctcctctcttctcaccacacaagtacttcttagatttaccacctgcagatccttggccagcaatcttgcattctctgatgttacgattcctgtgttctacctggttttggccccccacctatctggttaccacagtagtttgtggtttgcagaccagctgtcatcggcactgttacattgcagcagggcatcccactagcggcagcagccactcgctcaaacaagccccttaagccacttcttcccatatttcccttatgatcttcaccacacccctactgccccagccatagctaccctttctcttctgggcccgagtaagtgcagacaaacagcagccagagctctcaggcctctgtccaggatccaggctgctccacccaggcagctcttcccgggagactgctgtcacaccagcagaacaagcactgccccacctcagtctctcacccgaggctcagtccacacccatcactccctccaactggctggaccacagttctgtccatccatcaagccccaagcacacacaggttcaagagcaatagatgcaagagctctgtggggttggtggtgtcactaccacctggggctaaagggagctgggcacgctgtttcaagggataagacggtcccgcttattatgtacagactacatggtctgtaaatgtgattggagttgaattctttagagtgtgtagtgttaaagaaaaagtgattctgacagattaaatcggtaaagatcattcaaaactactgcaataggggagagagatcaggctcaactcttgaatacattaaggactagtggggatttataaccaagcagcatggtgaggggggtcagtggatagaaaattgctgaggagatatcaaagataaagggagatatcaaagataaagggagttcttttcaaaccagtttaacaggatcattgctgaaggaaggtcaaaggtgagggatgaggaacttgatcaaatatgaaggaattcttactaactgatgtatgacttactcatcctgactttgcaggattcttgctaagactgagctagacatttggaagacaggccaggggccaaggtcaaagcctagtcaagaagagggctcagaagggcttgcctaaagtttggttaaggagagagttgttttcagtggtcagagggttgtgagaggaaggagctgagggaagttggggagggttcgggaatggagagaatgtgaagagtggtagtccaggcaaaatgatgatgccgtcaggaaacacttattgacttaccatgggattctttcctccccaggtctccagaataagttcctggccagatatgtatccctcccaaaccagaataagatctggacggtgactgtgagccccgagcaaaacgaccgcacccccttggtgatggtgcatggttttgggggcggcgtgggtctctggatcctcaacatggactcactgagtgcccgccgcacactgcacaccttcgatctgcttggcttcgggcgaagctcaaggccagcattcccaagggacccggagggggctgaggatgagtttgtgacatcgatagagacatggcgggagaccatggggatccccagcatgatcctcctggggcacagtttgggaggattcctggccacttcttactcaatcaagtaccctgataggtaataaggagatggctccatccctcgtgacctaattcctggccttactgggaactttccagtattcatttccaaacttctctcattcccaggcgatttaaggggctatggcaactaccagagaatataatgtgtcttctcctctttccgcctttaacatagagttaaacacctcatcctggtggacccatggggctttcccctccgaccaactaaccccagtgagatccgtgcacccccagcctgggtcaaagccgtggcatctgtcctaggacgttccaatccattggctgttcttcgagtagctgggccctggggtgagtagcctgtagtatctccttaaaggaaggctataacgttctagaaggcccacagtgtctttcccacttattcctaaaaagtggaaattggcctagccttgttatttaaagctgttaatctgaaccagatcactttgttcaaggtttgagaaggttttttgtttttttgttttgttttgtttttttgagacaaagtctcgctctgtcgcccaggctggagtgcagtggtgcgatctcggctcactgcaagctccgcctcccaggttcatgccattctcctgcctcagcctcccaagtaactgggactacaggcacctgccaccatgcccggctaattttttgtgtttttagtagagacggggtttcatcgtgttaacgaggctggtctcgatctgacctcgtgatccgcctgcctcggcctcccgaagtgctgggattacaggcgtgagccaccgcgcctggcctgttttttgttttttgtatttttttctcttcatcggcatgggaaaagcttttcctatgccaggaacaggtggagcagaatagctaccagagtctcactctgtctcccaggctgatgtgcagtggtgtgatctcagctcactgcaacctccgcctcctgggttcaagccattcccctgcctgagcctcctgagtagctgggactgcaggtgtaccccaccacacctggctaatttttgtgttttcagtagagacggggtttcaccatgttggctaggctggtcttgaactcctagcctctagtgatccatccgcatcagcctcccaaagtgctgggattacaggcatgagccaccacacccaatctgtgtgaaattttatgaaaacctgctggtgattcatgcccagtaaccactggatcccatccctgtggttcacccaacacctgcagcagggagaggtcagaaccaaagcctccaacataacccacagtggcaggcaagcccctctgaaccatgcacttgtccaggcaagcaccacatcttcacctgctctgtgtcacctagcacttggtagctgtcagcaaattctgtgggtaaaagggagaaaaggaggtggaggaccatggggagctagccataatgaatagtatcaatatctccagccttctgacctcacactgccagcacccttctccgctggggagctttttactctgatgaagtgcaaagcagaaaagtgcaatcttttccaatggaaaagattggtgatgcctgtcttgtactgatgattgtgcttacagagtaatattcaatagccaattattatgagttaattgctgatggctaagtaagagttatctctctaggtccttcaagaaaaacagaatgattccagataaagaaaaaaagcatttgattagaagataggagtttaggagttctgagagagaggaaggataccaagacacgggtgccaaaggacagtaagtgggcagaggctcccagcaccgtggtctccaacagagtctatagtcctttgccaaaaagaaggtctgctcgagctactctcccctattctcacctctggccaggctcatgcaggagcatcagagctatcatagttggggaagttggccagcagccatgagggactatgcaggagggagggccaggcccatgcagatcctcatggcacccccaacccagccccttcttacctccctcttgcttctcataaacagagagaagaccagagagaaagagagagatcagggatcagaagttgaccagtagacctcatttttacagtctgttgttgcatgtatgtataccataatgaggtgaaacgaacagattgttgtaaaacagtgccctgagtctgagacacgattgtgtttagttcacctctccacatattctaatacaggcctgaaaatgagagcgctgtcgggaggtggtctagttccatccgctaccatcagaagattaaaaggccataagggtgtctgggagaaggagaacatagctcaggctataagagaagagcatctcagccatggattctgatggggagggcttgtgattcttgcagggaaagatctcggggcttcattgagctgaaaacaacctggctcctcagtgttgttagattgtctctaaattctctggtaatgagctgactttgtgatttgaagtcacctggaccttcccagtagattcctgcactctttctgccgctgtagtgttaaatgaataaagcaaacaaacccttaggagaaataaggtttagttaaagttctcaaaacatacacaggcaggagtcttccctgccccacctcccaaattggcctgtctgtgtttttctatcccctcccagggcctggtctggtgcagcgattccggccggacttcaaacgcaagtttgcagacttctttgaagatgataccatatcagagtatatttaccactgcaacgcacagaatcccaggtgagggccgctccccaggccagcttggggcagacagttgttaggagataaaactcttagctgctggagttctgggctttatttcttcttcaacaaagctctgactcagttaggtaaacacaggcactagcaagcctgatcatttccagagagttccccagggacagacacaaaggaatacagaagataatagattaattaaacatgctgcccatctctagaggaaggccctccctgttccctacaggtatgcaattggcctgatgaacaagagtctggaaaatattaatattttaaaagatttttttaactgaaaaattgatacaaacatggtattttttttctttttttaggtcaaaaataattagcaaaaacatgatatttttcaaaaggaaaggaagtcttctcctgtcccgggcctgtagtccctacatttccttattatttccagtctaacatagcacatgtaccatttcttcagagggcctccatgtacatattcctttgtacacacatgtgactgtatctgttgaacacattactaccaatagaatttctcaatgaaagagcatgcattttaaaatttaattatgtgcatttgaaatgccttatcattgagacagaaatttttttgcatctttgggagatttgggggtgtctcgagaactttgaaaagttcctatctggggctgcttatttacacagcaggccccacaagcctacctacctgcagtttgggcaccgtggatggcagggcagtcagggaggtaatcctcttatgtggaagtgccctgtgactggctgataccacgaggccatgttggtgacaccccgagctgctgggaggtatctcagcaaaggcaagcttactgccctactcctttctagggctgtccaagtcacttgttgggagcccaaagccatgagaaaggcagagatttgcattccagcaatactgtctgaacattaacctcaaaccccaacagctgttgggcagtgtgtgagctgtctgtccagcattccacatgagctcagctaattgaagaaccctgatcaaacagtagtatagaaactcccagctcagcagtcaaatcaggttcccctgtcttcctgccgttggcccttctctcagcccccatgggctcagtgcctgtctcatacccacctgaggccccacaggcccagccctagccctttccccagaactttccccatcccagacctagttctgtacaatgtcctcccaacctaagccacagagtatataagtttataattcattcacatcccagaggaagcaaaggtgacatcagtgacaaccagctccctcacccccaaacaccgtcactcaattttgtaactccctgagttttttgactttgtaaccctgacaagctcatggtaactcttatcatttccttggaaaacatgaaatttgaccaacatgtttgagggtatctacttcatctcacctaaacttaggggctttgtatatatttttattttcctaatgatgtcctagtgaagtaggtataatactctacatttatagatgaggaaactaaagtatattctggttacatgacttgctaagaaaacacagctgaggatttgaattcatttgactccaaattccatgctttttctgccgtgctgcagtatcttaaggaaaaatttatttctgatggcctgggcagaactcaggttccctttcatctgtacatgtaaaagagaatggagatctgatggtactaaacaggccaagcctaggaggcagcagtgtccccaacctgccctatctctagcagaagctgcagaccagccccagaaagctggctctgccccagccttgtggacacctcatgatacggcctcaattcattctacctgagcaaatgaccggggagtgaaatagattacattggcatttgttgtttcttgcttaacagaaactgctgctcccccagcccttggaagactgatttttaattccagagtcttctcaggaagccctttttactactatagtactcacttttaagcgttcacctcagatgaacttctgaccatgtctctagacccccaacaggctaaatccccagtctgtgttttcatagcactcgaccaccttttcatccttcttgggaaattttaagttgttttttgtttgtttgtttgtttgtttttgagatggaggtttgctcattgcccaggctggagtgcaatggcacgatctcggctcactgcaacctctgcctcccaggttcaagcgattctcctgcctcagcctcccaagtagctgggattgctggcatgcaccaccatgcctggctaattttgtatttttagtagagatgggtttcaccatgttggccaggctggtctcgaactcccgacctcaggtgatctgcccgcatcagcctcccaaagtgctgggattataggcatgagcctccatgcctggctgttcgtttgtttttttgagacagagtctcgctctgtcacccaggctagagtgcagtggcgtgatcttggctcactgcaacctctgtctcccaggctcaagcaattctcctacctcagcctcctgagtagctgggattacagaagcgcaccaccacgccccgctaatttttgtatttttagtagagacagggtctcaccatgttggccaggctggtcttaaacccctgacctcaaatgatccgcccgcctcggcctcccaaagtgctgggattacaggtgtgagccaccgtgcccagcccaagaaattttaaattaaataacaattaatcatatgattagttacttaatgcctacctccctaacacatgagctaaagtgtgtgagctccaggagggacagcatcctgcctttcttgttcatatgtcccctttcccagtccagggcatgacagaatatttgttgagtcaataataacccatttcattctcagattcttggacagttcgtactgccatggggtttttcacaagtgttcctccgaactcttctgtgatgggaggcctctggaattttggtcttcccctaatcttaccaatatttaatgagcccagtgtggggctttgacaggaatacaaaggtgactaagattctgcctcagtctctgaagagaccaacaagttgacatattctgctgtgaagtttattgctgttttgcttttgacagtggtgagacagcattcaaagccatgatggagtcctttggctgggcccggcgccctatgctggagcgaattcacttgattcgaaaagatgtgcctatcactatgatctacgggtccgacacctggatagataccagtacgggaaaaaaggtgaagatgcagcggccggattcctatgtccgagacatggtatgttgcaccacccaaggagtggaaatgatgactgagagtcaatcacctctcagccttggggtagagaagggtgatcaaggagaaagaggaatggacagactgagatagagcagtagatttgagaagtttggaaactctctttggaatatcttttttttttcgtgatggagtctcgctattgttgcccaggctggagggcaatggtacaatctcggctcactgcaacctccgcctcccgggttcaagcgattcttctgcctcagcctcccgagtagctgggattattagcatgcgccaccacgcccagctaattttgtatttttagtagagacgaggtttctccatgttggtcaggctggtctcgaactcctgacctcacgtgatccgcccaccttggcctcccaaagtgctcgtattgtactaccttcattaggggcttcctgcttttagcccagttcagctaaaaggctggttcttgtctagcagccaggcacctgctgctactccagcccccatgtagtttctaccccaaaaccagagccatgggcagtagagtgaatagtagaggctgccatgaagcttccccaccacacctcctccccttttttcttacccctctccgccatgtgccaatgagtgtgcttaatgaggctgggtgccaaccatgggcccaggtttactggacctttggattaaatgagcagatcagtggtggggctaacacagaaggaaagacacagtgaatgtttatcaagtaagtagaatgggaaagcattggctgtcaaaggaaaataccaagatccaagcgagaaaggtggagcattatctctgataagagctcgtgggtggcaggcaagcaagtctaaggggaaaagaaatagcgtgaaggcttcccagcaccaggaataaaaggccatcccacccctgcgggttctctctccacaggagattaagggtgcctcccaccatgtctatgctgaccagccacacatcttcaatgctgtggtggaggagatctgcgactcagttgattgagctgctctctgaagaggaagaggagaaagccagagagtcactcttacctccctgtctgcttactcacccactctgtcctttcctcaccaactaacatgtgccagccaggcagagtcttgtgctgttcccagaacaggacgacagtgaaaagaacactcttgaccctacactgaaggctgaaggcagaagccacaagaggccttgagtgccacccccagggaagaacataaagggttgcacaatgccacccatccactccttgccaagtgttacccagatggtggaggatgtgaagggattgcaccaagccacattcactctctctgtggcctttcttcctctgggcaaagaagggcttccagtggcctttcctcactctgtagtgtttgtggggataggttccatgcaagaacaccttcctcctccatcccccacttcaccccatcccataccagttccatccagggtctgcttaactgccaagagcaggtcctggagttcccttcacctgcagagtccttttcatgacctaggaggtcttattcaaagccctcattgacagaggaggaaacaggccaaggcaggacatggctggaccatggtgatacagctctgtgtgattcaagttctggcagagcttgtaaggctagagcccaggtctgccgacaccctgtgcttgttgcacacttgatttgctaaggctggagacaggcaccattgccatggggctggtcctagtcactggccgaggataagcccgtccctgtcccacattctagccccactatgcgggggtgctgttgtcctgcctgtgtctcatccccagctgcctaagctagggacactcaagtgcttccttccttgccccatcttcctcccaactggaggcctctgagcctcccctgtgccttgggccctgaagccccatatgtagtatagagcaaaggtggctcctggtgaagagagggtggaaaggcccttcagccccagggccatgtctgggttctccatgcccatcagtctctgcagtttctctacctgcccccagagctgaggccatctgcaagcccctgcccatggcccaatggggagcctccagccacaagttccctgtccttatcagccactgggtggttcccactgcatgaccctctatccctgccatctgtccccatggtttccagctcaatccacccctgacccatctgtcagctttttcccagggagccgtttcaggggttctgggcagtaggctgggcctggcctcagaacctggtggctcctgcctgctccttcacttttgtaaaaccatccccttcaccagaatggtattaactcctggtgctttgtactactggtccagctgccttgggctccttttctatattaataaagaaacgagtaaaaatt

SEQ ID NO: 38405 - DNA, 62802 bp, Homo sapiens
tcttacctcacaaaggtagctcctccgccggcagcaactcggcgcccgcggtccatggaccggaacctcgggccgacggacgggaacccgggccgcgatcgccgcctccccgcctcaggctcctcctcctcgctctccgccgcctccgccggactcccgcaggccctgcaccgccgccgccaggctagcggagctgccccgggaagctgggtgacgggttcgcggctgccgccggactgcggcctactccgccgcctctcagtgctattgtccctgggcctggccttgagcgggtccactggggaaggccgtgtgcgccggctccgcggaagatgccggaccaagccctacagcagatgctggacaggtacgggcagctgtgggggggaccgggagccgccgaccctcgctctggccctgcccgcgcccgccctcgaggctcttggtgagcagaacccggcgtgccgggaggagttccacggccagggggccgtgagaggggcaaaaagtttggagtctagacctgggggaggacagagcgagcggcctgggtcgtagactttgggtgaaacttagctaaggagtggcgtctggtttccttggaaccccgttttgacctgagagggactcctgttaatccacaaaattagttttccttaccctcttcccctcccccttccccctccccaacttgtgaagtgtttgtcagcgatgtcactggcaagaaccgggttatctttcaggggaatgacccccttataattttaagtctctgtctgagaaccaatgataagcattcttttggaaagcctgataggctgatttcattctcccactttccctgaacccgcaccccccgtcccccccgccccatcccgtccccacctccgaactgtaaggtcagagtatccgcaagggagatttaacggtcagaccagagtagaggttatggaaaacagccaaatgagtccaacgctgaacatttagtgtacttgacgatcgttgagttcattgaagacgtttcagctcgtacaggagtccagttgcccattcttggggggccccagtcggtaaaactctttgtgaagtcgggtgcaccgccctctgctgttgaaattctggtccgtgggtcctaccatgagtttttggagactctagatccacatttcccccgagccaagtcttacttcctggcatagcaagttgtacaagctaattcatgatgtttgtggttgcttacaattctcaatagacaccacttgccacccatttcagcaggtggtaccaactctttgtactcagtaaaattccaactgtaaggtgttaaatgaaggccctcccttaattgagtttatacccagttaaatgcttttgggcctgccacacccagaacacaaatgacccaagggtacacatccttccagagtgacagacatttttttggagcttagaattttgagccatctcagttaataggaattatgtcactgatttttttcagttgagataactggtgattcatccagcccttgtttcaggtcaacatcctgacaattgtattgactgctttatatatatatgtgtgtgatatgtgtgtggtttataagctcttggaagcagaaacttactattgtttatcttgaatcccagaacagagcctggtactcagtaggtaatcagtaagtatttgttgtatgaactaatgcacaaacttatttgtcagtttccccagttgtctagggggtctgataatttaccaggttttcctttcattgtaaattggcaaattgtggcaaattaaaatatgcccagaggaaaccacctgccactgccagttctattctgttgagaccctgttctgatgtggggtattttgtagttaatttttttcctttgagggcctcctgcttttcatttttacatagtgactttttttcttctttttttgagacagggtctctgttgcccagactggaatgcagtggcagtggcagtggcattggcatgatctcaactcactgcaacccccgcctcccaggctcaggtgatcctcctacctcagcctccctagtagctgggaccacaacacataccaccatgcccagctaattttttgtatttttatagagccagagttttgccatgttgcctgtgctggtctcaaactcctgggctcaagtgatcctcccgcctagcctcccaaagtgctggattgtcaggcatgagccatcgtgcccagcctagaaaagttcttatgtccaaaagctgacctaacttttcatatgctctttggatatttccataaaagtaagaagccaaagagtgagcctgggcacggtggctcacccttgtaatcccagcactttgggaggccaaggcaggcagatcactagagctcaggcctttgagaccagcctagccaacatggtgaaaccctgtctctactaaaaaaaaaaaaaaaaatacaaaaattaggcaggcgtagtggcgtgggcctgtagttccaactctcgggaggctgaggcatgagaattgcttgaacctgggagacggaggttgcagtgagctgagatcgcaccattgtactccagcctgagtgacagagtggaactccatctcaaaaaaaaaagctagtgaggcatttaaaacttattaacagaaatgcgaagattctggctgccatttactgaagtaggtgactatgacactggcttactctcatctttgtactactctcatctttgtactcttttgacataccttaaggtagatttttaacatgactttcaaagaccgttattgtctagattagtagttggcaacctacttccatgttagaattacctggggagcatttcagaatatgcatggatgctggactgtaagaccaataagatcaaaaatttctgtagggtagagcctgggcatctatattttaaagctttttaaatgttttagatatggcagaaacctactgccctaagtcctaagtcagtgatatctttcatgataagagatagtagggtatagtgagtaaagcttgggctcagagatagaaagtatgaaattcgaattttgccacttactagctatgtgactttgaacttagattctgacactatgtatattatcatttataaaatgagaaccctacttcacagggctacagcaaatgaaacatacatctctataaaacagcaaaacactctatgttagccaaatagaaggcacttaagactaatgtaaaccagtttggccatttttcccccatctactttatgtttacagctttcttcacctgggctggccctactgcaagttgaacacaaagatactcaacatggttcacttgaggaataccaacagggccaagagactaaaatatgtcagcctattaggacccagaattcttttcatgaatttggcttctccccaacctggtttttggtggcaatttttgagggacagaatttagctcagataactgttcatttgtttatttctttaatgcaggttttatcttcgtgaagactaaggaactgtgtgttacatattgttctgttgcttttaggttaagttacgtattttatttaggccaggcacagtagctcatgcctgtaatcccagcactttgggaggccgagatgagaggattgcttgagcccaggagttagacaccagtgtgggcaacatggcaagactcagtctttacaaaaatgttaaaaattaggccaggcctggtggcacatgcctgtggtcccaaatattcaggaagctgaggtggaaggattccttgggggtcgtggctgtagtgagctgtgtttgtgcccctgggtactacagcccaggtaacagagcaagaccctgtcttaaaaaaaaatgttatttttcagtaaatcaattattaaacatttacacttattgaatttatttaacaaatactgagtgtcttcatatgcccagtactattctaggcccttggtatatagtggtgaattgaacataacaaaaatgcccttatggagcttcaattccaggggtgtttgtgttgtctaaactgtcaaagtgaagactattttaattgtaatatgaatggtatgttcaatttataccatttaatctttcagggtttttaaactagaggcaacttttctttttttttttttttttttttttttgaggcgaagtctcactctgtcacttgggccaactggtgacaacttcttttatttatttatttatttattttttatttttttttttgagacagagtctcgctcagtcgcccaggctggagtgcagtggcgcaatcttggctcgctgcaaactgtgcctcttgggttcacgccattctcctgcctcagcctcccgagtggctgggactacaggcacccgccactaaggccagctaatttttttgtatttttagtagagacggggtttcaccgtgttagccaggatggtctcgatctcctgacgtcgtaatctgccggaattgacctcccacagtgctgggattacaggcgtgagccaccgtgcctggcctgtggcaacttcttaatagctgaagttgaattcccttgtcctttgcaaataactcactttagtttagctattatttgtttatattggtaactttgattactgtaatatttgtaggtggaaagaatacatatacatacgtatatatatacatacatacatatatatatggaatttttttttttttcatggaatttcgctcttgttgcccaggctgctggagggcagtggcgcgatctcggttcaccacaacctccgcctctcgggttcgcgtgattctcctgccttagcttccggagtagctgggattacaggcatgtgccaccacgcctggctaattttgtatttttagtagagactgggtatctctatgttggtcaggctggtctcgagctcctgacctcaggtgatccacctacctctgcttcccaaagtgctgggattacaggggtgagccaccactcctgaccatatggatatatattctttggattgcctttcgtttttataaactataagtgttttatgtaaatttattatttgaaccttttaagttgttgtggggaaacaagaatggtggaaaggggggtgatttttctagtgtcgtgaatgtttcagtgtcacaaatatcatttccctgaaatgataaccattcataagcccaaaccctttatgtcaggccttttgaaccttagttagctcttctgtctttcattgcttcaattctttaataagaagttgttatatattactttctctttgaccaccgacattctcatttttctctaaaacttctcaaagttaggagtgaatttacagagaacaatgcaaagaatattataacaaactgcaggaatggacctctgatttgaagcctggacctactgagaaatgcttttggaaactacttctgcttcccccgtcttaaaataaacacgcattaatttgttgaggttgttttgcatcacttacttgcatctagtaaataggcaaggagtgtagccagaatgtccccagaatggtcagatggcagaaagagcagagagagtggtctattcttccagccccctcccacaatggtatagtgaattagaattctgcctctgtgagagtgttatccacagatgtatacccctttgaagaccaaggaagctatactctgataggagcatgctgtataaacaatttcacattttctttgtcagttgacctctttttctcaatcacatcaccatgttgacaattacagaccaatgcccagaattaaaaatcatcatcaattatatttatttccagatatatgtaaaaaatggaaacatcatagataaaattaaatcccctttgaccaccatccccaatggcatatcttctcatccccactccactatcataaaatgggtttatattcttccatccttcttggtttaatgcttttatatagaaaagtatattaatagactacttttttttttttttttttgagtcagggtcttactccattgctcaggctggagtggagggtcacagtcacggctcactacagcctcaacctcccaggctcaagtgatcctcccacctcagcttccagagtagctgggactactggtgtgcaccaccacacctagctgattttttgtattttttttgtggagatggagtttcaccacgttgcccaggctggtctcaaactcctgggctcaagtgatccgctcgcctcggcctcccaaagctcccaaagtgggggactacaggtgtgttccaccacatccagctttcaactttttttttttttttttttttttgagacagagtctcaccctgccacccaagctggagtgcaatggcgtggtctcggctcactgttgcaacctccacctcctgagttcaattgattctcccacctcaacctcccaagtggctgggactacaagcacgtgccaccacacccagctaattttttgtatttttagtagagacagggtttcactgtgttggccagactggttcaaactcccgacctcgtgatccacctgcctcggcctcccaaagtgctgggatttcaggcatgagccgccacacctggccttttttcttttttaatccagtctcgtttatgacatttagattcttattttctctttattatttttcctgataatttgactttcattcccctttcttgtcattagctctactgaaagtgtactgaagggctgggtgcagtggctcacacctgtaatcccagcactttggaagaccgaggcaggccaatcacttgagctcaggagttcaagaccagcctggccaacatggcgaatccccatctctacaaaaaatacaaacattagtagggcatagtggcacatacctgtaatctcagctactcgggaggctgaggcacaagaatcgcttgaacctgggaggcaaaggttgcagtgagctgagatcgtgccactgcacgatctctctctctatatatgtatatgtatactaaaggtcaccaataatttcttagtaaatataatgacattttcttcaggactttttatccttcagaatcacgttacctttttcttccttcaatttctatgtatggttcaattctcagcatttactattttgagaaagtacacttactcactctctttcctgtttattcaaacaactcccagatctgtgtctttattcctgacctcttttcctcatttcctttagcacctaatttctacctgcccagtggacatttccatttgtgtgtatacagtattgccaatcaatctaaaactaagctacttatcttgacttctcaatttttggtctttgatattaccagtcttcttgtccaccagctataaaacataaattttatttgtttgtttgtttttgagacagggtctggctctgtcgcccaggctggagtgcagtggcccatctcggcttactgcaacctccatcccccaccctccggctcaaaatatcctcccacctcaccctcctgactagctgggactgcatgtccagctaatttttgtatttttagtagagacgggctttcgccgtgttgcccaggctggtctcaaactcctgagcttaagtgaccctcctgcctcagcctcccatagtgctgggattacaggcatgaagctagccaaaacataagtttttcttgttttctttgtttttgttaaagaaacagggtcttgcactcccaggctcaagcctcccaagtagctaggagcacagggcaagccagcatgcccagctaattttttttaaacttttttttttttggtggggagggggatagagacgggtctcactatgttgcccaggctgtctcaaactcctgttctccaccaatcctaccttggcctcccaaagtgttaggactacaggtatgagctaccttgcccggcctatttacatttttttgctgccttctttccttccagatccacttgttcatcacatattgttgattttcctttttctagcttcaatttttcacttggtccagtttggcctacagagtggcactagaattagcgaaggcacaattataatcatgcgatttctatacttaaaaatctgccagtctctgtgtcacgtaaaaggataaaacgtaaactttcaacggggtaacgtgctttgatctgttactataatccagccccaacctaccttaaccatcctttcctgcactccccttcattgacccctgaacatatcctgctctttcatttctttatttttgctttaggtgccttcctccctcctaacacctggtgaagtcttacccatattgaattcagctgaaataccacagtgacaccttgcacagctcccccaaacagagttaataactcctttctgtgtttcaatagaaccttgttgcatttattatagtgtatcacattgtactgtaaattttttaatatacttgtcccatgtctcagagcttcccacacacacacatattcatctggaagttcactgagaacagaaactgcctgtattccctatcctattttcccacaagggccttagtgcataggagaccctcttttgtatcatgatgtctttcttttcattctttgtgacatatcagtgcttagaataatcatgcagaagcaccatttttttaaattgcctcatttgctcaaaacttgtattttcttactgcttattgagattaagttcagggctgggcactttgggaggctgaggcaggaggatcgcctgatctcaggagtttgagacccacctgagcaaaatactaagacccccgtctctacaaaaaataaaaaagtaaccagtgtagtggtgcatgcctatactcccagctactcaggaggctgaagcgggaggttcacttgagcctgggagattgaggctgcagcaagccattatcacatcactgcactccagcctgggtataacaaagcaagaccttgtctcaaaaaaaaaaaagaaaagaaaagaaaaaaagatctggccgggctcagtggctcatgcctgtaatcccagcactttgggaggccgagaggagcagattgcttgagcccaagagtttgagaccagcgtgggcaacatggagaaaccctgtgtctacttaaaaaaaaaaagaaagaaagaaaaaatagctgggtgtggtggcccacacctgtaattgcagctgctggggaggctgagatgggaggatcacctgagcccaggttatggaggttgcagtgagctgagattgcaccatgccactgcactccagcctgggccacagagcaagaccctgtctcaaaaaaaaaaaagagatcatattctttagcctgtccttcaggacactcaccattattcacagaccatttattatgctccctattatgtttaagatatgccgtacatagctggcaccaactgcctttttaaagcctttcttctctttatgaataagtgtataagtacccaagtcttttgcccaagccaaactggcttgcgcactttcttccaaacataaggtggtttttgtttttgggttttgtttggcatcttttctttcaaagctctacccatttttcaagacctagttaggttctgccttgtttataatgctcttctgaccatgtctgcagaaatatttttctcttcttctccagactcatgtagcagttcatcttcagtgcctcctaattcttttttttttttttttttgaggcagagccttcactctgttgcccaagctggaatgcagtagtgcaaccttggctcactgcagcctccgggttcaagcgattctcatgcttcagcctcccaagtagctgggattacaggtgtgtgccatcatgctcagctaattttttgtatttttagtagaaacagggtttcactgttttggccaggctggccttgaactcctggtctcaagcagtcctccccactcagcctcccaaagtgctgggattacaggcatgagccaccacgcctgacctgcctcctaattctttacatgccgtagttcacatagatgacaatatttatatggcccattggagtaaactgaaagggatttgcctctctggaggaagcacattatggctgctttaaagtaccttagtaaaatgaaacacgtattttttgtactgctgtaattttctaagaaatgggaaatgtaaatgtgaatttttctctgaatacactatacatagggcagcatggtgcagtgaaaaaagctgatgatttggagtcatggcccaggttgcatccatgcctctctgcttactgtgtggccttggccagatcacttaacctttctgggcttttggttcttgtttaagatgggattaattgtgctttcagagtttatgaacatcaaagacaaaaggcacggcatgaatatactatactcaataaatgattgctcagtattcgtggggaattggttctgggacctcccaaggatgccaaactctgtagatgctcaagtccctgatataaaatggtgtagtatttgcatataacctatgcacatcctcctgtacactttacgttctctctagattacatataatacctaatacaggccgggtgcaggggctcacgcctgtaatcccagcactttgggagcctgaggcaggcggatcatctgaggtcaggagtttgagaccagcctggccaacatggtgaaaccccatctctactaaaaatacaaaaaaattagctgggcatggtggcacacacctgcaatcccagctacttgggaggctgaggcaggaggatcgcttgaacccgggaggcagagattgcggtgagctgagaccacgccattgcactccagcctgggtgacaagcaagactctgtctcaaaaaaaaaatacctaatgcagtgtaaatgctatgcaaatagttgttatactgtattgttatgaaataataacaaggaaaagtccctccatgttcagtacagactcttttttttccaaatgtattttacctgagattagttgaatgaacagatgcagaaccctcagttggagggctgactgtattctcaccttttctttttggtaatgtgtcatgattgtggttatatgtctttgatagatccaggtactttaacttccattccactaggatgaacggacatattagtctccctaatagtgtgctttctgtttcacaattcttgggtgtgacacttttaatcctgagacaaaataagcaacacgtagttttcttttttctttttttttctttttttttttttgagacggagttttgctcttgttgcccaggctggagtgcaatggcacgatctcggctcactgcaacctccgcctcccgagttcaagcgattttcctgcctcagcctcctgagtagctgggattacaggcatgcaccaccacacccggctaattttgtatttttagtagagacggggtttctctatgttggtcaggctggtgtccaactcctgacctcaggtgatccacccacctcggcctcccaaagtgctgggattataggcgtgagccaccgtgcccggcctaacatgtagtctttttctttgtcaaatagagccctccttacattaaccacagtatgaatctccaaacttgttctaaattgaggagtgcttgttctctttccttagagcagtcatgtaaatacactattatggcaccatatataatacaacagcagcaatttaaagcttattccacgcttgctttctatattctcactcttctattctgctacattccaattttcatcacagtgatttctcaggcaggagtctgatttcccagaatttcctaagaatccaaaagaaacacctgcagtttgagtctgcaaaggctttactaccagctgttttttaagttactgtacctatcttgcttaatttagtgccagtgagaaactatctttttgataaataaagcccccctcacttttttctacatactttaaaaataattaacctgtttgatcagatagactgtaaattagtcacaaatgaaccctgtgaagtgagattgtctttgttattcatcctttcccaactggtttgtaatatctagcttcatcttaaaatctttctgctccaaccacattggtctatgaatatatgttcatttccatctctaagcttgcttactctgtttttcttcaaataccttttctttccactctaacttgaattctcatctgtagttatttccttttcttgaaacctcagctgtttcatcctgtttcttggtctctcatcacatttctgtattaaggtttctaacaacttttcttggcacttaatgcttggtatagtggtttttttgtgatcctcgtatgcatgtttgttcgttaactagactggaagttccttacatgtagttccttgtggcatcaaataatgaatgtacttattaggtactcaagtggatttaggaggagatcttgaataatgttagatttagggcaattttgtcatgtatattccttaaactgtttataaattttactgtttactctttattagtttactatataactggcaaaaaccatcataattttaaaatcacatggaattatattacccataccagtaagactatacatctgttcttaggaataagtaatagtccttagatttgtctagtttagttctcttctgttgtcttcatataatgacagtgatttgttctttgttccctgaaccaatcatgatacttcccagatctccttttgctttgtaaatgaatatgccccaacttggtgaataggatggtgtaggagtaacatcagcaagtaggtggcatttagaaaagctaccagaagggtaataagggtgaaagaaaatgaattgaaagggtttaaatgaatcttaagatcttaagtagtggcgtggcctgttgaaaaattggggaaatgactaggaatccagaacattttccactgaatgccagggtgccaagtagaattgctttatgtgctaatggtaagaaaactgcatccataaattttaggaacttgaatggaaagctgacaccatcactgtcatcattgtcaatgttgttattgctagtggtcatatggaggttatatatgtgctaggcaatttttaagcagtttcttaatcacatgtttaatcttttacaataggggaccttaacataaaacattttttatgctaaaactcctttggtggtctggttaagcctatgggttccttctcagaatgtttttgaaagaataaaacaaaatatataggattagaaatgaaaccaattatattgaagtacagctatcaaaatattaaaagcctaaaatagtaatatgaactttaacacattaaaatacaagatttatcagttggcctgataacatttagctcattgtaatttgaaattagttatttcgggatctctacagctgtaaagtaatatgaaaatttctggttgctatactcatttctaattgctgtgctgctaatattactgtggtttgcttgcactcattattgaagaaaagctacattttatttagagcttagcaaaaataaacgtgatggtttttctcccctcattcagatttaccgatccccaccccctaagtttttcatggaccccagattaagaacccctgctttgcaacaactctgtgaaagagattctatcattaaacctatgtagttagcaggggtttgaacccagacaatctggctccaaagtccaggttctttaaccagctagaatatcctgaattcgcattatctttttccccaaattaatttaaccttgtttccttaggaaaaaataccttaagcattttacttattgtttaaaattaaaaaccaaataatttaaaaatgtttacagtgagcataaaacaatttgatttctatgttacggtgagttaagaatatttacagggccaggcacgatggctcacaccggtaatcccagcactttgggaggcctaagcaggcagatcacaaggtcaggagatggagaccatcctggctaacaagtgaaaccccgtctcttctgaaaatacaaaaaattagccagacgtggtggcacgtgcctgtagtcccagctactcgggagggtgagacaggagatttgcttgaacctggaaggcagaggttgcagtgagctgagatcgcaccactgtactccagcctggacaacagagcgagactccgtctccaaaaaaaaaaagaatatttacaaaggaaaaatcagaaaaaaggaaggaagaatggctagagcagaagttttcaaactttcgggatcatgatcacctgatgggcttattgaaacaaagtgctgggtacccccagagtttctgattctgtaggtctggggcaaggcctaaagatttgcatttctaatgagtccccaggtgatgcttatgcatcacactgaggactgagttctgagagagtcagaggattggagaaaacaagaggaaaaatagatgtaaggagaaactcttagtttggtcagaaattacaacttcctttttccttgggtatggactttgagtgttttggttttgactaataattaattggctattttccatttcaaaagacaaaaccaaaaactagtcccatctactcaggaggcggaggtgggaggatcactggagcccaggaggtccaggctgcagtgagccgtgattgtgccactgcagtctcacctgagcaacagagtgagaccctgtctcaaaaataataaaaactctttagagtttacattctatgattgtactgaggccatctcttagtacccaacacagtaacaagatcattttggttgcacatgatgcaatgcgaattggttaagtcaaaaacccaaaaatctactgctttatgtgagttaacagtacaagaatatatttagctttaggcacagcacatcttgatccatgtctcaatgccgtcagtttccaccttcacttcttctggattcttaaggctccacttagttggtggctctcctgtcagcaatagcctcacattctctgcttctaagcccagaagaagagagaaagtctgtataccacttttcccagcaaaagttctgaggttcactaagaccagctttatggacccagcctcccaatgatgtagtctggaagataggctacagcggccaatctgagtgtttctggggttggttatggtattcactgcctaaaccacacacacggctaatgttggagggaagagcgattttccatagaaagcatgggatactatttactcctagaaggtagaaggacttgtgttgtatgtacattaaacatcaaatttctactgtcccctccattccaagatgttgagaaattataaatgaatcattttcaaatagctcttctccatcttaaaaggaagggggtagagaattggggaataaatcgttgaagtagattaattacatagagtgggaggggtagggtatggagaagcaaaaagggaaagcataattataagaccttcccaggtgatgttcctggtcagtcggatgggcaggcgcagtggctcatgactgtaatctcagcactttgggaggccgaggcaggtggattacttgaggtcaggagtttaagacgagcctggccaaggtggtgaaaccccatctctactaaaaatacaaaaatgagccaggcgtggtggtggatgcctgtagtcccagttactagggaggctgaggcaggagaatcacttgaacccaggaggcagaggttgcagtgagtcaagattgcaccactgcactccagcctaggtggcagagtgagactcagtctcaaaaaagggcaggggagggggcaggaagctagactatatgcctgcagtcctaggtaatcaggacactgaggcaggaggatcacctgagcccaggatttcagttggagtctagcctggacaacagagccagacccatctcataaaataaggaaagaaaacatctgtgtgtgtgtgtgtgtgtgtgtgtgtgtgtgtgtgtgcgcgtgcatgcacgcacgtgccctcccctccttttttttagcccttaagactagtcacactcttatatgctgatatcggcctaaagacatttgtgtgaccatttttacatgctttaatttcccctttgcccagtcctcatttcatagactgctattctttccatactaggtagattaaatttaaacaactagtaagatagcaaatcagttaataaattctttagaacttaacatatttggccaggcacagtggctcacgcccaaaactttgggaatccaaggcaggagaattgcttgagcccaggagtttgagactggtctaggcaacataaggagatcctgtctctaaaaaaaaaatttttttttaattagctgtgtgtggccaggcgcagtgggtcatgcctgtaatcccagcatttgggagcctgaggtgggcagatcacttgaggtaaggagttcaagaccagcctagccagcatggtgaaaccctatctctactaaaaatacaaaaactagctgggcatggtggcgggcaccctgtaatcctactacttgggaggcggaggcatgagaatcgcttgaaccgggaggcggaggttgcagtgagccgagaccaccactgcactccagcctgggcaacagagcaagactttgggctgctggttgcccatttttatggttatttcttgatgatatgctaaacaaggagaggattatttatgcttccccccttttttttttttttgagatggagtctcactctgtcacccaggctggagtgcagtggcacgatctcagcttactgcaagctctgcctcctgggttcacaccattctcctgcctcagcctcccgagtagctgggactacaggcacctgccaccacgcctggctaatttttttgtatttttagtagagacggagtttcaccatattagccaggatggtctcgatctcctgacctcataatccgccctcctcagcctcccaaagtgctgggattataggcatgagccaccgcgcccagcctatgcttcccctttctagatcatatagggtaacttcgtgacgttgccgtggcatttgtaaactgtcatggtgctggtgggagtgtagcagtgaggacgaccaggggtcactcgtgagcatcttggttatggtgggttttagctggctttactgcaacctgttttatcagcagtatctttatgacctgtattttgtgctgacctcatatatcatcttgtgacttagaatgccttaaccatctgggaatgcagcccagtaggtttcagcctcattttacccagctcctattcaatcaagacggagttgctctggttcacatgcctctaatactgctatttcaactgaaagcctaactcctgataagtacgcactctgaatcatcattcagctatcttatttaccatagttgtgaaattaattagaaaaaaaactgaaagtgcataagtgcgtgcgttgtttgttttttgtttttttttttttttgagacggagtcttgctctgttgcccaggctggagtgcagtggcgcgatcttggctcactgcaagctccgcctcccgggttcacgccattctcctgtctcagcctcctgagtagctgggactgcagacacccgccaccatgcccaactaatttttttgtatttttagtagagacagggtttcaccgtgttagccaggatggtctcaatctcctgaccttgtgatccgcccgcttcagcctcccaaagtgctgggattacaggcttaagccacggcacccggccaagtgcatgctttaaatgtcagttctaaaaagtaaatctgtacaagtatttaggactgaaatatactgatgcctgcaactttgaaatgcagcaaaaaataagaataatgaatggatgtgtgagaaagcaaatatagcagaataagaattatagaatctaaatgttgggtatatgggtagtcactgaacagtttttaactttttttggaaagtttgaaatttttcataataaaatgtttgggaaaaataaaccttatctagaatttataaggaatataatagctacacaagtattctcattagatcaaaatatgaaatttgacctatcttttctgtaagtcagaaacagattaatgtagactatttcagttggttcaacctagtcctaacattgtattttatttttctgatgactgaaattggattaatttaaaatgtgattcaccataatactgattaattatgctgatgtagctattcttatttacgtttgtgttaagaaagtatgagactaaagagtctctaaatattctgccagtattttgttgctaaaatgatacattccatttcctagatgtatacaaatatgtccacaaaattacctcagttgtggggaaaaatatatactaacaacatcttaaccagcctgtgtgctagtatacttaccaattgaaattttatgcaaaaatcataggttagaacccagtcctactatgggtagtcttggtggttgcacaacagtatgaatatacttactgccactgaattatacacctaaaaaatggctaaaatggtagattttatgctatgtctatttgacgataaaattttttaaaaaagaacaaagtatttttggacaaccataagacaatgtgaaggcccagacagcttagctaaagtgggtcaaaagggtcagaatgctaaacaaatgctacctacgttctaattttacttagatcttatgaaacctgactgaatttgaaagctgaataaaacaactattttggatattgatgccctggattcagttcaactttttttctgttctaattgaaaaattgtaattggagcacacaattgaaattcatgttgttccacaaggactggagaacctcacccatctataatacctgagtatatagtctttcccactgagcatagttaagctagttgttctgacagaagccacttatccaattaattaaaaagtgcacagtaggtaacatgctttaattagcagttgtttccacttgtacaagttctaatggaggggaggagcgaagggtctcattgaattgaactgtatttgccctgatggaaatcgatgtcaaaacttgtgttaattgggagaaaaactgaggaattacaacctaattccacaagaaaaaattacaattcatgaagtacccttaaaagcaaagtgggaaaatgttttaaaattaccgatctcaatagaattttatttttattaatataagcaccccagacttgatacttctagatttcagatttcaagcatacacgcccaaatttatcatattgctattctaaaaaaaaaaatcttgatatatttatctcctttgtgcttttttgaaaatgtaatattgttttctctcatgtttatactttaccggaaagaaaaatgggtttttttttcctcagctgaaaaatggaatgagactgtatgtgaaatcactcgtgtaatactttgtttttccaagttcaagggattggtggtggtgaactggggagaacactgaatttaatatattactgtgcttactattcctcaaagaattattaggtcttataacaaaaacaacttgaggtttgtctccttgcactctggttcattagagaaggtgaagaattactgaaaagatagaggagattacataaaaacaaagttcagaaaacataagttctgtagaggaagacaaggaaaaacagaaaaagtagaaactgctctagtgggaatgtattggttgttttgtctccttagtcttttaatataggacagagattctgtaatataacatagcaggctcatcccattaagtaagagctgcagtatagaggaggctggagtcctaaagatataaatgtcatccttttctcttttaatttacagaagttgctgggtttgttttgctactgatgaagatgatagaacagctgaatgggtgagaccatgcaggtgcagaggatctacaaaatgggttcaccaggcctgtctacaacgctgggtggatgaaaagcaaagaggaaacagtacagccagagtggcatgtcctcagtgcaatgctgaatacctaatagtttttccaaaattgggtaagaatatctttaaaaacaacacagatatagttgatgttattatatataactttataagttcattttaaaatgaaccacctcttttttttagggtgtgaatttctatattccctttctcttgtttcctctctgaatgtcagacatttatttcttttgctaacagtttacagtatccttaatatatccccaaatttatccatttgcctgtgtattaactgtctgtttgatagaaaggagaaagaacttgcatacctgtgtggatataattgaataacaaagctctaataaaaagctgacttttaaaaaaaaaactaacttagcttaattatctggagacggtgtaagagaaagaaagcagtagtatgttctaatacttctccttaattcttccttttaaggaataaaagtagagaaattaaatatttaataagatgtgacgttaaactcatctttggaatccaatttatgtggtttctttcatgaaccctgctatcccttttctgtgaagtggcaggtaagaaataaccaaagatctttgagaacaggcctagcatggaaaaaaagtatagcagactgcttacaagaagcattctaaggctgcttctttagcagcagtataactaaggctgatatttagtgagcctgttccattacagccatacagttataaattggtgtcaatctcttggtttggtgtttataccatgccagttgttaaacatttttttataacccttgactgtaaccaagaggtataggaaggcagcttgggttctgggaaggtcataaggaaagaatgtctttgggggcagagggaattcaggaaaaattggaaataattattatatatattgttttttataagtgctattcatactgaaatcagaccaatgtttttgaaaatgtggcaacataaatgcagataatgaagtgcttttctaatatgagaagattaataataagggcaaacaaaatgtccttggttctctgtttttctctaacatgcacaggaagaaatgatagcttcctttgaaggggaagtagtgtagtagagaaagtagtgttttcaaacatttggaatttgtggaccatgtgatgggtcttcagtgcataccactgattttagataaacacaaaagaataattcaaaatgtttttattgtaagatcaaagaagtatttttaaatcagtatcaggaaaagcaatgattgttcacattattgtaccaccacatgaatggtgaaagactcactaaagtccaagttaaggtttcatatttaactgatttcttttcttgctcttagttgtactaaattagatagccccacctttgaattatagagttgggaagagcaacaattaaatatttctattagatgttttagatattcaaatggacacaaaaattattacaagaattctcactgaaaactacatcaagttgacaagtgtatggcactcgaaagcaaagttgagtattttaattttggagatggcaatgtgtagatctgtccttttggttgaattcagttctaggaaatatgttttcaggtttagtgcagtaattgaatatggttttaagtctacctagttgttagaaaagagtaaatcttggctgggcgtggcggctcacgcctgtaatcccagcactttgggaggcagaggcgggcagatcacgaggtcaggagttcgagaccaacccggccaatatggtgaaactatgtctttactaaaaatacaaaagttagctggacatggtggcgtgtgcctgtagtcccagctactcaggaggctgaggcagaagagttgcttgaacccaggaggcaaaggttgcagtgagccaagatcgtgccactgcacacaagcctgggcgacagagccgagactccatctcaaagaaaaaagaaaagagtaaaactctttggttaagccatttgtatcattatttagtctgcatattttgttactaagaattgtggccgggccgggcgcggtggctcacacctgtaatcccagcactttgggaggccaaggctggcagatcacgaggtcaggagatcgagaccatcctggctaacacagtgaaaccccatctctactaaaaatacaaaaaaattagccagccttggtggcaggtgcctctagttccagctactcgggaggctgaggcaggagaatggcgtaaacccgggaggcagagcttgcagtgagccaagatagcgccacagcactccagcctgggagatagagcgagacgccgtgctaaaaaaaaaaattgtggcgggtcacagtggctcacacctgtaatcccaacactttgggaagctggggcgagtagattgcttgagaccagcctgggcaacagggtgaaactccatctctaccaaaaataacaaaaaaaaattagctgggcatggtggcacacacctgtagtcccagctactcaggaggctgaggtgggaggattgccttagcctgtgaggtggaggccacagtgagctgtgattgcgccactgtactccagcttgggagacagagtgagaccctgtctgaacaacaaaaaagaattgtggccagtcatggtagctcacatctgtaatcccagcacttttgaggctcaggtgggtggattgcttgtggttacgaggtcaggatcagcctaggcaacatagcaaaaccttgtctctctacaaaaaagaaaaagaaaaagaaaaaaaattagccaagtgtgatggagcacacctgttgtaagtcctagctactcgggaggctcagctgggaggatcacttgagcccaggagtttggggctgcattgagctatgattgcgccactaccctctagcctgggtgacagagtgaaaccaatcttaaataaaagagagaattataattttactctcaaatgatatgttcaagctggtcactatactgtctgtcatagaggtatggcacttgagttagccgcttaaaatcatagatatgttttaatgacatcagtgttataaaaaaaaatgaatatccgctgggcacggtggctcacgcctgtaatcccaacactgggaggccaaggcaggcggatcacctgatatcaggagttcaagaccagcttggccaacatggtgaaaccttgtgtctactaaaaatacaaaaattagccaggcgtggtggcaggcgcctgtaatcccagctacttgggaggctgaggtaggacaatcacgtgaacctgggaggcagaggttgctgtgagccaagctcacaccattgcactccagcctgggcgacagagcaagactctgtctcaaaaaaagaaaaaaaaaagtatatccttcatttgagtaggtattgttagcatatttcctcttgacaaaacagaaaaacagagtatttgctgctgctgcttccccccgcccccccccgccaatagaggttgggtcttgctatgttgtccaggcttgtctcaaactcctgggctcaagcaatccacctaccttggcctcccaaagtgctaggatcacaggcatgagccactgtgtgcccagcctgccgctgcattcttaacatgctgaagatacctattcaagggctgcaattttaattatattcacaattttccatgcagttattaacaatgactcaagccagctgttgtctgtaaatgaagccatgtgtgaattggctttcaggtggtgggctcttcattgctgcacacaaagctagtgctctagctatgctgattccagcacaacttttcaattcaagtttcaaaaataattgttggttaaaagaaaatatcttcttctaaaacttttaaaaagttgcttgtatttcttgattaacatgttacattcgtatatactaagagttgattcgtactctgtacgctagtggcttcatgcagccattaaacaaaatacttaagagcctgcatctgtgataataattgttcttcctctctgtataacacacgtagcacgtaatgtccgatagtgtcatctgatgatagaattttgccagtagattgttttgtttctgtctgagcacatttgtcattaattttgcagctgacagtagttgaatctgttttgttaaaagaagtacctttgactattattttgatcttttaatgacagaattcatagtggaggctttggttggtttactggagttgttgaaaatgatatgaacacttcagtggcttcttgtccctatttaataatgtatcacaatacggtgggaacaaggatgtctcctagtacagtgttatcactcctagttcactggtcacagctcattctaagatcagtcttcactataaaatcatactattatcatttatggcattctgagttaaatgtatttttcacttttactcttttgaaccattgattcatttccctaaatttgggatttaacacaatatgatagtaacaataaaatacatatttaaccaatgtaaacaactcacatgatgtggaagtatgttagccctttccttttcattttccttattatgatagtgttttcttaacttaccctagtagagcttgggtgatccttagaatgtaacagcaataaagaacctaaaaggatttctgtgaaagtcataatctcctcaaatttgtgaaatatttgtgatcaaaacttttatcacttttttctcaaactgtctgtagaccaaatagattgccagggactgccattggtccccaaagacacttgataaacactgactagaagaaggaataaaagaagatacagagagggaaaggtgatgatggttaatattctatgggatgatctctatgcagcagattttgtgttttttttttaacttttcaaatgaatttagccccagtctggatgatgctagctggccaattctgcatcttttctggtacttagtcatggcaggaatgaagaggtaatataagtgtatgttcttcattgttaatagggagttacttattgtactcagttgtgaaaaacttaagaggattcgtcagagttttatccttctcactgtttgccacccatgttacagtttgcttttttctttttttctggtgagccaagccagttgtatgtatgtacctacttaaaaccttgctactcaaagtatgatctgaggaccagcaacattagcattgtctggcagttattaggaatgcagaacaccacccccttcctccaccccacttttactgaatagaagtctgctttttttaatttttattttttaaagacagtgttttgctttgttgcctacgctggagtacagcagcatgatcatagctcactgcagcctcagactcctgggctcaagcagtcttcttgcctcagccttccaagtagatggggttacaggcacgtgccaccacacccagctaattttttttttctttttagagagggggatcactatgttgcccagtctcaaacttcctggcctcaagggatccccctcccaaaccccgttggccttccaaagtactgagaatgtaggcaagaaccaccacacccagctgaaatgtgcattttaatgagataattgagtgatttctatgcacattaaatttaaaaaccattgctttaaaacatgaaaggaataccaactgaaaaaagtttgttttataaataaaacctgtccataaactttgagacctggtaataaccttgttcaggcagaagaattcagaggagagcatctcaaaggtagagagatcttgactcccaagggactgattcacactagatttattttcttttattattattattttttgagacggatctcgcactgtcatctaggctagagtgcagtggtgcgaagttggctcactgcaacctctgcctcctgggttcaagcagtttctcctgcctcggcctccctgggattacagacatgcgccagcacgcctgactaatttttgtattttttgtagagacagggtttcaccacgttgcccaggctggtctcaaattcctgacctcaggtgatccacccaccttggcctcccaaaatcctgggattgcaggtgtgagccaccacgcccaggcaagatttattttctttaacttctctcaacattgttttatagtttttagattttttttttagtttttaaatttgtttctaaatattttgttctttttgatacattgtgtaaatggaattgttttcttaactttgtttttagattgtttaagtatgtagaatacaatttttgttttctgtcttggaacacaatcagcaacaattgatttttgtaaattgaccttgtatcctgtgaccttgctgaacttgcttaataatttggatacttcttgatggattccttaggattttctaatataagatcatgtcattgttgaacagaaatagttttactttttgtttcccaatctgaatgcttttttttttttttttgaggcacagtctcgctctgttgcccaggctggagtacagcgccatgatctcagctcactgcaacctctgcctcctgggttctgtcagttctcctgtctcaccctctccagtagctgggattacaggcacacgccaccatgcccagctaagttttgtagttttagtagagacagtgtttcaccatgttggccaggctggtctagaactcctgacctcaggtgatccacccgcctaagcctcccaaagtgctgggattacaggtgtgagccaccatgcctggcccaatgtgaatcatttatttcattttcttggctaattgccctggttataacctttagtgcagtattaaatagaagtgatgaaagcagatatccttggctgggagccgtggctcatacctgtaatcccagcactttgggaggctgaggcaggcagattgcttgagtgcaggagtttgaaaccagcctcggcaacatagcaaaactccatctctactaaaaatacaaaaaattagccaggtctaagagcacacctatagtcccagctactcaggaggctgaggcgctagaatcacttgaacccgagaggcggaggtttcagtgtatcaagagaatgccactggactccagcctgggcaactggagtgagaccctgtctcaaaaaaaaaaaaaaaaatggctaggggcccacaactgtaatcccagcattttgggaggacaaggcaggcagattgcttgagcccaggagttcgagaccagcctggggaacatggcaaaacccagtctccacaaaaaaatacagaaaattagccaggtatggtggtgtgcacctggggtcgcagctacaaacaataaagggagagagaaagaacggaaaaaaaaaaaacagacatccttatcttgttcttgttcttagggggaaatcatccaatcttttcttttttttctaagatggaatctcactcttgtctcccaggctggagtgcagtggcacaatctcggctcactgcaacctctgcctactgcagaggttggtacacgtgattctcctgcctcggcctcccaagtagctggaattacaggcacccaccaccaagcctggctaatttttgtatttttagtagagttggggtttcaccatgttggccaggctggtctcaaactcctgacctcaggtgatccacccgcctcggcctcctaaagtgctgggattacaggcgtgagccgctgtgcctgacgacttttcaccgttaactatagccgtactacactgtacttaatgtttaggtcaataacaaccacagtggtggtcccctaagattataattgagtcgaaaaattcccatcaccttgtggcattgtagctgtggtaacatagtagtgcaatgcatcattcacctgattgtggtgatgaaggtataaacaaacctgtactagcagtcatataaaaatataacatgtaacagttttatacagtacataatgcttggtaataaatgactgtgttactggtttatgtatctactttactttttttttttttttgagacggagtttcgctcttgtcgcccaggctggagtgcagtggcgcgatctcgactcactgcaagctccgcctcccgggttcacgccattctcctgcctcagcctcccgtgtagctgggactacaggcgcacgccaccatgcccggctaatttttgtatttttagtagagacggggtttcaccgtgttagccaggatggtctcgatctcctgacctcgtgatctgcctgtctcggcctcccaaagtgctgggattacaggcgtgagccaccgcgcccggcctctactttactttttatcattacttttaaaaaattttgtgtgtttgttttttgtttttttgttttttgtttttttttctgagagggagtcttactctgttgcccaggttggagtgcagtggcgcaatctcggctcactgcaacctccgcctcccaggttgaagcaattctcctgcctcagcctcctgagtagctgggattacaggcacctgccaccgtgcccagctaatttttgtatttcagtatagacagggtttcaccatgttgatcaggctggtctcgagcttctgacctcatgatctgcccgtcttggcctcccaaagtgctgggattacaggcgtgagccactgcacctggccaaaaaaaaaaaaaaatttcttttcttttttttttttttgagacagagtctcactctgttgcccaggctggagtgcagtggtgcaatctcagcttactgcaaaaaaaatttttttaatatagagacagggtcttactgtgtcacccaggctggagtgcagtgtcatgatcatagctcattgtaatcttgaactcctgggctcaagggatcctcctgcttcagcctcccaaatagctgggactacaggtgcatgccaccaaacctggctaattttttttttattttttgtagagacaaggtcgtgctttgttgcccaggctgatttctctcttctgacttacaggggccttccttccttggcctcccaaagcactgtgattacaggcatgatccaccatacccaaccacttgttatcattattttagagtatacttcttttacttaaaaagtaactgtaaaacagcctcaggcatatccttcaggaggtgtttcagaagaaggcattattctcataggagatagtagcttcatgtttgtttttgcccctgaagaccttctagtgggacaagatgtagagatggaagacaatgatattaattgatgatcctgaccctgtgtaggcctaggctaatgtgtgtatttgtgtcttagtttttaacaaaaaagtttaaaaagtaagaataataaattttaaaaatagaaaaaagcttataaaataaggataaaaaatttttcgcacaactgtacaatatgtgttttaagctgttaatacaaaagagtcaaagttaaagttaaaagtgtatagagtttaaaagttacagtaagctaaggttaatttattattaaaaattataaattcagtgtaataagtgtacaatgtgtataaagtctataatagtgtatagtaatgtcttaggccttcacattcactcatcacccattcactgaatcacccagagcaacttccagacttccagccttggaagctccattcatgattaagtgttctatacaggtataccatcttttatcttttataccatatttttactgtacctttcctatgtttaggaacgcaaataccattgtatttgcctacagtattcaatacagtaacatgctgtgcaggtttgtaggctaagagcagtaggctataccatatagcctaggtgtgtaaataggctacaccataccgactctgtgatgtgcacaaaactacaaaatggcctaaggacacatttatccctgtgtgtggatacccatcattgagtaacacgtgagtgtatgttaactgggtttttcagagatggcctttatcaggttgaggatgtcccatctatttgtagtttgttgagggcttttgtcatgaaaaagtgttgggttttgtcaaatgctgtttctctgtctattgataatcatgtgagtattgttctgtattctaataatatggcatattggttgattttcatattagactcgcctggggttcctgggataagttctacttggtcatgtttgctagtactttgttgggaacttttgtgtctgtactcataatgggtattggtctgtagttcttttgtgacatctttggttttggtgctggaatcatactggctcataggataagttgggaagtgatccctcctttatgttttttaaaagagtttgtgaaggattggtgttttaaatgtttgggagcagtgaagccatttggtcctgggcttttcttcatggaaaatgttttaattactaattcaatctcattacttacaggtctattcagattttctatttcttcttgaattagttttgatagtttgtatcatacaaatttgtccatttcatgtatattatctaatttgttggcatatagttatttatagtattttttaataatccttttcatttctgtaagattggtagtaatgccccttccttaattcatgattttagtcatttgaatcttctctttttttctggtcagtctagctaaagatttgtcagggttggccaggcgtggtggctcatgcctgtaatcccagcactttgggaggccgaggcgggcggatcacctgaggtcgggagttcaagaccagcctgaccaacatggaaaaaccccgtctctactaaaaatataaaattagccgggcatggtggcgggcacctataatcccagctacttgggaggctgaagcagcagaatcacttgaacccaggaggcgaaggtttcagtgagccgagatcacaccactgcactccagcctgggcaacaagagcgaaactccgtctcaaaaaaaaaaaaaaaaaaaaaaaaaaaagatttgtcagagttttttctttctattcttgcattctctgtttcatttttatccaccctaatatttatgtcctttcttccttctgcttgatttgggtttagtttgcttttctccttttagtttcttaaggtagaagattagttgacttgggatctttctttttgtccttttttttttttttttttgagacagggcctcactctgtcaaacatgctgggatgcagtggcacaatctcagcttgctgtaaccttgacttcctgggctcaagtgatcctcccacctcagcctcccaagtagctgggactgcaggtgctcatcaccatacccagctagtttttgtatttttttttttttttatagtgacagggttttgccatgttgtccaggctggtctcatactcctgagctcaagtaatcagcccagctaggcctcccaaagtgcaccatcacatctagcccttttttttttctttctttgtttttgagatggagtgtcgccctgtcgccaggctggagtgcagtggcatgatctcagctcactgcaacctccgcctcctgggttcaagcaattctcctgcctcagcctcctgagtagctgggactataggcgtgcaccaccacgcccagctaatttttatatttttagtagagacggggtttcaccatgttggccaggatggtcttgatctcttgacctcgtgatccacccaccttggcctcccaaagtgctgggattacaggcgtgagccaccggtccccagccaccttctttattctttttcagtcttgccatgttgctcaggctggagtgcagtagctgttaacaggtgcagtcatagtacactgcagccttgaactcatgggctcaagtgatcttcctgcgtcagtatcctggttagctgggagtacaggtgtatgccactgcacccagcccctctttctgtttctgttatttttaaatagattttagagcctttttaggttcacagtaaaccatatgccagcctccacccctgaccacacacacacagagtgctgactactttccccactatcaacatcttgtaccagagtgttacattttttacagtcagcgaacttaagttgacacatcattaccacccagagtgtccatagtttacattagggttcactcttggttttgacaactgtataatttataatgtataaagggttgattcagggttttgacaactgtataataacatgtatccaccattatagtattatacagaatagtttcactgacctaaaaatcctctatgctccatctgttcatccctccccgagctcctggccaccatacatctttttttttctccatggttttcccttttccacaaggtcatatagttggactcgtacagtatgtagccttttcagattgtctttcatttagtaacatgcatttaatttcctctgtgtctttttgtagcttggtagatcatttcattttagtactgaatactcttacattgtctggatgtcccacagtttatccattcatgtactgaaagacatcttggttgctttcaagttttggctattatgaataaagctgtacacatccatgtacagaattttgtgtggacataaattttcaactcattggggtaaataccaaggagcatgattgctggattgtatgatacaagtatgtttagttttgtaagaagccttgaaactatcctccaaagtggctgtaccatgtaccattttgcattttcaccagcaatggatgggagttcctgttgctccacatccttgccagtgtttttgatttgggtcattctgatagatgtatagaggtatctcattttaatttgaaattttctaatgacatatgatgtgaaacatctttgcatttgtttatatgccatctgtatatcttctttgatgaggtgtacactttaaaatcagagtgatagttttctcattgttgacctttaagagttctttggatattttggataaaagttctttgtcagatgtcttgggcagatcttttctccttggttgtcttctcattctcttaatctttctccttttctttctttctttctttctatttatttatctatttatgagacggagtctcactctgttgcccaggctagagtgcagtggcacagtcttggctcactgcaagctctgcctcctgggttcatgccattctcctgcctcagccccccgaatagctgggactacaggcgcctgctaccacgcccggctaatttttttgtatttttagtagagacagggtttcactgtgttagctaggatggtcttgatctcctgacctcatgccgcacccggcctctcattttctaatgtcatttacaactagaagttttcctctaagcactgctttagctgtatatcataatttttgttgggttttcatttatctcaaaatattttctaatttttcttgtgatttcttctttgactcactgattatttaggaatgtagtgtttaattttcacatatttgtaaatttcccagatgtccttctgttactgattttttttttatttcattgtgatcagagagcatactctgtctgattttttaactatattaaaactttttttaatggcctaacgtaggtttatcctggagaatgttccatgtgcacttgagaaaaacatgtattctgctgctgttggagtagtctataaatgtctagttgattctggtattttcaagttttccatttccttgttatcttttacctgtttattatttaaaatagagtggtgagtggtggcttgtgcctataatcccagcactttggaaggtcgaggcggggggatcatttgcgcctagaagttaaagaccagcctgagcaacatagtgagaccctgtctctacaaaaaaaaagaaaaagaaaaactttagccaggcatggtggcacatgcctgtggtctctgctagctcaggaggctgaagcaggaggattgcctgagcccaagagttccagactgcaacgagctgttattgcactgctgcactccagcctgggcaacagagtaaaaccttatgtcttaaataaaaagagagagagtggggcatagaagtctccaattactgttaaattgcctgttcctctggttccatacgtctttgcttaatttattttggcgctctgttaagtgcacatatttataattgttaggtcaagtgcacatatttataattgttacgtcgtcctgatggattgtccctttaccattataaaatatccttttttgtttctaatagcaattttgtcataaaaatcccttgaccaatatttgtatagctatttcagctctcttatatctcattaagagtaaattcttagttttcaagttaaatttttgtcatctttattttattatttatgtattatttatttgagatggagtcttgctgtgtcgcacaggctggagtgcagctgcacgatcttggctctctgcaacctctgcctcccaggttcaagcaattctcctgcctcagcctcccgagtagctgggattacaggtgtgcaccaccacacctggctaattttttgtattttgaatagagatgaggtttcaccatgttggccaggctggtctcaaactcctgatctccagtgatccgcctgccttggcctcccaaagttctgggattacaggcatgagccaccgtgcccagctactcttattttattgttgctcttataactaaacattaattgaaacttcttatatagaattttaccagtaaccatcctcaaaaagtggttgtcaaatgttaagtggagtgtaaatgcttagaagggaaagattttcactagggatgaataggaccaattcctgggagaaaccttcctagagaatctaggatataaaattaatagttgtaactattttattttattttacaataaatatcaatagctatcatttgctaataggcccctattgcctattcttccattctctgtttcattctaggcactatgtcgatcactttgcctatattatttaaacctctcgaaagctctgcataatagatattgtcctcagtttgtagataagaagtagactcagcaaatttatgtaatggaagcccatgggcttccagcaaataaagcaaggagccagaattttacactggcaaatttcttgttactgtcactcagtgagtcagctaataggccacatatggataagtagtttctagtaccataagaactaatagagataatgtgaatttgaattaatttgagagactgttaataaattacacaaatgatgtgtaagtaacaaaaattttatgagttggtaccactagaattgaaagacaagtgtattgccaaaaaacaaaatgatagctaggtgcctgcactaacaaattgcctgttctcttttctttcttgatatttgctttgctagaaatggaaaggaatagcaaatacatcaaagagaagatggagcaactgcaatatctcataagcagttttttttttttttaactcatttgatgtttaagtttatatttttcccccaggtaatgcattgacacagtcaaaaattcaaagacacgaggtacagtaggatatttaatgaaaagtctttctactatgtctgccagccatggtgccaagtaagttttcttacttggttataaattataactatcgttataaatttctggtatttcattgcagtttgtttctctttttcttctctctccttcattcttctcctctccctctctccctacacttacacagaatctacaaacgtaagagttaaaggaacatcaagggagagggaagtacccagggtttagcaagctacttgcaagctacttgcaatgagggaaccagggaaaaaaactttaacacttttaccactctctgatgttctggtctctcctatcatttgaacacatcagaaactagagggcaaggttgcctaaactttttttttttcttagcagtatatcgtagataccattttgtattcatatatgaagagcttttttttttttctattaaaagtagcctggataaagagctttttaaaaaaaaaaactgtgttcatacatagatgtatgattacttatataatcagtcttcctccattgatggacatacaggcttgtttccaatcttttactgttatagacagtactttcataaacaactttgggaagtaattttatgcatgtgtgcaaatacatctgtaagataaatgactagaaatagaattactgggtcaaaggtatgtgcatttataacataatggatatcctataattggcttttgtagagattacacccatttaatctcccaacggtgtattggagtgcctgcttccccattgcctttgccaacatgctgctatcaatacacagaactagttatatctgctgccttagcattgaccaaagctcagcagaatgctcactcaggtattttttttctcttttattatgaaatatttcatttgtggaaaaggaatatatcgcagtttcatgtgagaagagataaacagggcgaagtcaacaacacccttgaaaaagctagcataaaagggaaaaaaaaagtaagtttacagtggagaaatgtggcaaacactacaacagccaaataatcaaggtcattatcaccagtaatgattcatgtaggtattatgtacatttgatctgatgcaatgagaattgcactttgcctctctggtcttcttccctgaaactcctaactccaagagataatgagaaaaacaccagacaaattccagttgagggatattatacaaaatacctggtcagtactcctcaagattgtcaaggtcatcaaaagcaaagaagtctgagaaactgtcatagccaagaggagtgtaaggagacatgactaaatgtaattcacatgtctttattctgttccagaatcttatccaagataccacattacatttagtcatgtctccttacactcctcttggctatgaccttgattatttggctgttgtagtgtttgccacatttctccactgtaaagttacttttttttttttttttgcccttttttgccagctttttcaatggtggtgttgattttgccctgtttatctcttctcatccttttatttttaattcttttgggttcttttttacatttattgtgatactgatatagctggatttttatcatcagattttgtgcattctatttgtcctactttttcctttaagttttatgctttatttctctacctaagtggttattcttgaaaagtcttggcttttatcacttcagatattgcttttcccccattctttccattctcattttgtagaactctgagtagagttatattagacatttttcctttttttgttatgatagaatttttcatttcctgggctttgttatgctgatacactacgaacacttggctgtttaatatgttgccctatcctctgcattttgtgtaaactggtgtttagatcttgtcagtgaggttattatatatatatatatatatattttttttttttttacaggaatatctgatagatagtttgtgtgcttcttattgcatcacatcacaaggcacataatgtgtagttgttctttttatgataagaccgatcagtgtgtataggtgttatcagcctgatccattcagtaaagttgcctattcatttccacctagttttagcagagattgataatttatttttcattgcctctaggtccattgtttcattaagtaatacaaaacattgtcactctaatgttttcattctttcttcatttattggcttagaaaatttatgttatcaatcaagaagagattgctgagtcagagggtaaattgaacatagaattttgctgggtattgccaaatttcctgccacaggtgctgaatcattttgtgtattcacctgcaatatgtgagtgtgcctatttcctcatgctttgccagtaggatgtgttagcaaactgagattttagccagtctgttaagaaaagataacttattgtagttttaatacacatttctttatcagtgaggaggctaaaccattttaaagtaagaatacttagattgtaaaagggtactatagagtaagaaatatattttccccaaacttaaaacttcatggcttcaattttatgggggttttatatttttgactgataaatcccaaggtatcagttactccataaaaatactccccattgtttttcctctagccacatggccttctgtcactcacatgaactcaacctatttcttttctgcctgctcataaaatatatcattggtttatttcactacctaaaaaacaaatatggacttaagaactcaagtactctcttcatattaataaaagtttctagtaatatttacacttagccttcagagaaatgttttctttttactttgctatatagaagttcctatgtatgatcaaaataaagaaaaatttaaaaacctaagtcctattccatagtgatttagtctttgaataatctttgttgtcaaagtttatagttagagaactcatttagtcttttttgagacagagatttgctcttgttgcccaggctggagtgcaatggcacaatcttggctcactgtaacctccgcctcccgggttcaagcagttctgcctcagcctcccgagtagctggaattacaggctcctaccaccacgcccaactaacttttgtatttttattagagacggggtttcaccaggttggccaggctggtcttaaactcctgacctcaggtgattcacccgccttggcctccaaaagtgctgggattacaggcatgagccaccatgcctggcccttcatttagtcttttgtagccctcattggttaccttcttgtgaggcaaatgactaggataccttcagaataagagttccttttgtttactgctggatcatgtttggtcttgctccctaagtcttaaaagtagattagttttaagaagtatctttcaacagtgtgagactttctgggtacacactgtatatgaataaaagtagctgaattacaggtccaaaacataactatacaatctttttttaaaaggaggggaggataactgctctttatcaagagaatctaaattctcttgatgtcttcattttccctttacattgccagatttcttggctcctttgactccttcctttgctccttgtcctggatctttaaggaaaagggcacctattctttatttctcacctgaggatttcctgaaattgtcttatttgtattccagagctatataccacaagttttttctcagacacctgctgtctttgattatgccttctactccactgtcctataatgtttaacatcgtttgcccttttggggtgaccatatagtttagaactggaagaaataatagctgacacaagatcgttactacgtaacattaagtactaagagcttcatatgaattattttaatttttacaaaaactctgatatacataacaccttcattgtacagatgcagaaattcaggcccagagatggcactttgtcccaattcacacagcagacccaacctaatccttacccaccttgttttgttacagcctaatgagcctaatacacaaccttctcatatacagggaagaagaaaattcagtggtaatgtcaggttaccttcctcagggtaatggttacctgaagtttataactcattgttcttttctaaaatacagtttttcttattaataagaacaattatattatcatcatggaaaatgtgaaaaatatacacatatgtttaaagaaaaaaagactgtgttatacagttaactggcatatatgtagtatgtgcataattagtgctgccagctgtttttatgtgttaataaaggatgattggtggtggtgacttttttcagcaaagtttttcacttccagttagaaggctcttcttagcatgccctgcttggttttaccttgattcagttgtgctttttcttcttcacttggaattggccttcttttcacatcagagacttcaagtttaggtcaagattcatttatttaaaaaaacaaacaaaacaaacagcaatttttaaaaactgtttgtatccttacctcctccccccccataatctttacctaaaattttcttaacatctgtatagtttgtaccatactatcatatctttattaattttgcattggaagttttcagttgttttatgtatattgtttgtccctaactagattgtagactcctagggggcagcagctagtgtgttaaatataatttacatttattttaatacgtagtaaaatgtgtttacaatagatgcttaataagtacttagtagttgaccttacagctcacaagtattctgtagcctattattttatgagtataaatttaaaatttcccttggcataaattatataatcataaggaactactgtggtgatcttcagtgattaatcatggaaatgcaatatatgaatttatagatatagcatatataactatgtaccatatatattttcatatataatcatatatatgtttttatatataatcatatatatgtatatataatcatatatatgtatatataatcatatatatgtatatataatcgtatatatatgtatatatataatcgtatatatatatgtatatatataatcactcatctgctttgacctgaagtcttttattcttcagggttgtttgggttagttggtttgtttgtgggtccttttttttttctttttttggtcagatactattttggaccaggcatagtgtctcatgtctataatcccagcactttgggatgccagtcacttgaagccaagaggttgagaccagctggggcaacatagcaagataccatttctacaataaaatatatataattaacttagttatctaaaaagttgtccaagaacatatcccttctttacaatctaatgattaaccttttgttattaagcaaagtaacttacagcgtaagtttgcaggatgtttgttcttacataaagatggtgaaatctcaaactaccagcagagcagtcaatcagagatgaaacttacataagcgacttttctggggctcttggacctagcctccaaagtgtagtgtttaaaacagtggggaatgctagagaaagaggtaaaactctttactatcgcattaggattccccatccttttttttttttttttttttttgagacggagtttggctcttgttgcccaggctagagtgcaatggcgcaatcttggctcactacaacctccacctcctgggttcaagtgattctcctacctcagcctcccaagtagctgggattacaggcgcacgccaccatgcccagctaatttttgtatttttagtagagacagggtttccccatgttggccaggatggtctcaatctcttgactttgagatccacctgcctcagcctcccaaagttctgggattacaggtgtgagccaccgcacccagcctcccacatacttttaatcaagtttgttgtattacttgatatcttcaataaaattcacatttgttggccgggtgcggtggctcacgcctgtaatcccagcactttgggagggcaaggcgggcggattacctgaggtcaggagttcgagatcagcctgggcatgtgaaaccacgtctctactaaaaatacaaaattagccaggcatggtgacacatgactgtaatcccagctactcgggaggctgaggcaggagaatcgcttgaacctgggaggcggaggatgcggtgagccaagatcgcaccattgcactccagcctgggcaacaagagtaaatctccgtcttgccaaaagaaaaaaaaaaaaagaaaaaaaaaattcacgtttgttggcttgggaccatataattaatacttttttttttttcccttaaaatgtccatttaacaacagattgagtcaagtactggccacagagtactgtggctaggtcctgtgccattatattccagtgccttgtagaaaaggccaaagtgccccatactgccaagtaccatgtgctgagatagctgtggcccagagggtccttgagagtgatgccaatcatcattaaaaagcattttttaagcaccgatctgtacatggttctgtcctaggcactgtacaaaacgagttaaacagacatggcccttgccccctgggagttttcagtctaagatgatgctgacatggacagacataaaggatattgagacaactgaacaaacattgaacaagaacataaagtactaacattatgcacaagcaaaggggtaagtgtattttgtggggtagtatgtaaaggaagcctcatgggacatggacagggtggggtagtcagcctctatcaagttaagttagtctttgctgagaagttggatttttatacagatttaatcaaagtaaggacaggacattccagacatgtagcaaaaagacttggagcaaggatgaaagtttatattgttaaactgtcagtggcctcaaaaatctgtacttctgggtggctctgaaaatggggttggtgtcttagctttagaaagttgccatttgagggccgggtgcagtgcctcacgcctgtaatcccatcactttgggaggccgaggcgggtggatcatttgagaccagaagttctagaccagcctgggtgacatggcaaaaccccatctccgctaaaaataaaaaaattagctaggtgtggtggcatgtacctgtaatcttagctacttgggaggctgaggtgggagaatcgcttgaacccgggaggcagaggttgctgtgagctgacattgcgccagtgcactccagcctgggctatagagcgagactctgtctcggaagaaagttggcatttgagtttggtctaggtcgaaatcagttcaatgcaaagcaaaaagcaaacagaaaaaacatgggaacttgagtggcttctgtgagcagtctgtcttgcttgttgaatctcttttataaattattggccacttaacagaaggaacttatcgtctcagaaacttataccaggttgtcttgtaaagtacctgtttatgctcattaaatcatgttctgtgttagaaactttcgcacaacaaagtatagaattatgtttctctgccagtccaagtgcattggtatttacaactaattgatcacaaccagttacatatttctttgtttcttctccactccaacagcttcacttgactagcctctaggagttctgggtgttattataagcaatgccagcaaatgctgaacattaagtattacctacctgcccttcagtcattgacttctgaacttccaaggtgtacctttagcagccaaaatataaattttaatttatattacagtggcagcaaaaatctacttttgtttgctatgtctgccagacaaaactgattacttcttttttagtagacattgacttacaagccccagtagttctcagctcacttttttatgtcattcatgtctgaaacgtgaaaacttgaatttacccagaatattagggtgtagttgttctctttacaaaagcttctttattatacaaaagaagtaatagtttccctgctaattccaagcttctctggtgccctttaaattaatagattttcaaaacttaatatttatacaaagcttcagttgccattcgttatgtaaatacagtgctattagaaacataagtgttgaggcccactaaggcattaaaaattcaataataccttttgaaaatattgaaactttctcaagcccctatatatttaacttgtaaggtacatttattatagttcttcctctccaccagaattaaggttttcaaaggctgctgtcttgcctttttctacttcccataactttttgtggtgtaatctgacagcaataagaatctaataaatgttgcttttttcctaagtttacaacccctggccccaaatcatgagatagtagcacataaacttcataggaagagtatgaattagagactgtcctccaaaagatttcagtgattgttcttactcaccaaatagcttgccagataatctttagctctcagaaatacctcccctgggtggcagtttattattctaatggtatgcttagcactaggcatttatcttttcttttaagtattaagctaatcttagactagtgtctggaaaagccttaagagatttagacaaagtaaacttaagagaaaagccaagacagaattttgtcagaaaaactagaattaggtgctataaaatgcaacctttgcctccattttatctggtacatcttttgcctataacacaagagatgagtagaaaatttccaaagaggaaatatgaagacttttttttcttattcaaaagaattcacacccaatgattcaggaagaaaattgagcttgttagaagcttctgagatcttccaaggaaaaacaagaaaaacaattcaaacatctgtaggctgtcactgttcatgatagataaaagtaatagtgatgggttatattttaggaattatgctttcattcaaatatttgaattttgttttaaggaattatattgctttactccatcagtaggtagttccaagtacaagacaattcagttcaacaaatgattgagagtagtaggaacttggggtaaatcaatgatgaaaacaaagatcattttccctttggaggtttgtttttgtttttttggttttttctgagacggagtttcgctcttgttgcccaggctggaatgcaatggtgccatctcagctcactgcaacctctgcctcccaggttcgagcgattcttctgcctcagcctcctgagtagctgggattacaagcacacaccaccacgcccggctaattgtttgtatttttagtagaaacggggtttcaccatgttagccatgctggtctcaaactcctgacctcaggtgatccgcccaccttggcctcccaaagtgctgggattacaggtgggagccaccatgcccggcctggagcttattttccgatgcaaaaatcagcaaacctttctgtaaagaaccagatagtaaatattttagactttgcatgtgcccatgttccaataaaacttaatttacaaaaacaggcagatgtctgaatttagcatacaggccctagtttcccaacctctgttacagtaagtggaaacataattaatatgtaaattagggtatgttatgtgataagtgctttaggaaaaagaaaaatagagcaaggtaatcaaatggggagtgtgatgaagtaggggttcgtagggtgggcttcattgaggtcaagaagaagaggaaggggcatggtggcacacacctgtagtctcagctactcaagaggcttagatgggaggatcacttcagccaggggttaagccagcctgggcaatataatagtgagactccatgtctaaaaagagaaagaaccagcaaaggagactgaaaattgagtagtgaaatagaaagaaaaacgagagatgttctgggattggcccagtggctcactgctgtaatcccagcactttggaaggccaaggtgggcagatcgcttgagcctaagaatttgagaccagcctaggcaacgtggcaaaacctcatctctgcaaaaaatacaaaggttagccaggcgtggtggtgcacacctgtagtcccagctacttgggaggctgaagcagaggactgcttgagcccaggaggcggaaattacagtgagccaagatgacgccattgcacttccgcctgggtgacagagtgagactctgtctcaaaaaaaaaaaaaagaggaaaactgagattagatttggctaaatggaggttgctagtgaccttgataagcagttttggtggagtgggttcaaaactaaggagagagatagagggccgggcgcagtggctcacacctgtaatcccaacacttcgggaggctgaggtgggcggatcacctgaagtcggagttcaagaccaatctgacaaacatggagaaaccctgtctctactaaaactacaaaattagccgggcgtggtggcacataactgtaatcccagccactcaggaggctgaggcaggagaatcgcttgaacccaggaggcaagaggttgcagcagtgagccgagatcgtgccattgcattccaccctgggcaacaagagcaaaactccgtctcaaaaaaaataaaaataaataaaacatatacagttcttctggggaattttgttgcaaagggagcaatgaaatgaagcagtggggcaaaaaggctcaagaaaataatttggttttaatttttttttttaacactgaagaaataatagcatgtttgtttgatgaggatccagtaaagagtagggagaaattatgtaggatagtgggagataattgctggagctgtggccttgagttggtgaggggataggatcatctagtgcataagtgaggggattgacttcagatgggtggaatattggttgatgagtacatgtgctggagagcgtcgataaatgttctcttatggcttcagttttctgattaaaaaattaccaggccaggcatggtggtacatgcctgtaatcctagcactttgggaaactgaagtgggaggattgcttgagcctaggagttccagaccagcctgggcaacacagggagaccccatctctacaaaaaaaaaaaaaaatttaaataaagaaaattagccaagcatggtggcgcacatctgtggtcccagctacttgggggctgaggtgggaggctcgcttgagctggggaggtcaaggctgcagtgagccataatcatgccactgtactctagtgtgggtgacagagcaagaccctgtctcaaaaaaaaaatcgaattatcaaccatacgaaggttgaagtgctgaggttttatatatacttacggtctttaacttctactactagcatttgagggatctttggtgactaagatgacttttattgtgctttctgaaggagttataaacttaacccagcaaatttgtatgtcttgagaattcagcactatattctgagattaaataatgatgcatgtaataatgcctttggcacagcacacagtctcttatagaccctcaagaaatgctaactatttattagaggatatagagttggtgtgcactaaattagacttatttcatctctctggtcccagaagataccttatcattgttttaaatgttatgtaagttagagcttgacagtaataagtaaatatgctatacatattataaatgacagtcctttgacatctcttctaatgttctctctactttacaatgtatagtctgtcttcatacagtgacatagcgatattattggctccagtgatcagcagggagtcttgatcagaggctccatagatggatgctttgttcttacatgtttcattattttatcatcagaatcctatgttaatttatttgtatagggaaaataaacagtttttgtgtatagcatctgcctttagattataagctcccagaaggtaggtaataattcttacacatttctaagaagttttcatatttttttggtagctcacacacacctgtaatctcagttactcgggaggctgaggcaggagaatcacttgaacccaggaggcggaggttgtagtgagccgagattgtgccactgcactccagcctgggcaacaaagcaaaactctgtctcaaaaaaaaaaaaattaaaaattaaattaaaaaaataaacttagggccagatgcagtggctcatgcctgtaatcccagcacttttggaggccgaggtgggtggatcacctgaggtcgggagctcaagaccaacctggccaacagggtgaaaccccatctctactaaaaatacaaaaattagttgggcgtggtggcacatgcctgtaatcccagctacctgggaggctgaagcaggaggatcacttgagcccaggaggcggagggtgcagtgaaccaagatcccaccattgcaccccagactgggtgacacagtgagactctgtctcaaaaataaataaatagctggctgggtgcggtggctcacacctgtaatcccagcactttgggaggctgaggcgggtggatcacctgaggtcaagagttcgagaccaacctgactaacatggtgaaaccccgtctctactaaaaatacaaaaattagctgggcatggtggcagacgcctgtaatcctagctactcaggacgctgaggcaggaaaattgcttgaacccaagaggcggaggttgcagtgagccatgatcgcaccattgcactccaacctgggcgacagagcgagactccatctcaaaaaaaaataaaaataataaataaataaacttagatattcagttatatttggcctttaaatcagggctgagacccttccattcttctggaaaattctggagctaaattatactgggcttagtggcagtcagaatacctccaaatgctgcttttccaaataactttcagaaggaagtagtagtcagatttcagagtaagcatataataatagaacataattggtacatagagctgttggaatgctataaaaactggcttcataatcataaaaagaaatttgttagagaataatattcaattaaatacagcatattgaaaatcaaagagagataaattgacattatgtaaatacaagaaaatggccctggttacctttatgtactgtatcaaggtatacagtgagtgaagtcagagaaatgatattcttactaaatacgagaatctaattgttgccaggaatttgatggaaaaagcaagctgaaatgaccatttcactctaccgtggccagtatgattaagagatgaaagtgagaggactatttcctttataagaagtaactatatttgagactctaattttaggttcaataataaagataatttgaggaggctgtttacgagaatttatgaagtaatatttagctattcgtgcaaatgactgagaaattctcaactattctagtctaggttcccatcaaatttataacagttatttctaaagcatcaaaacatccaacttcatgaaagtattttaggctgagtgtagtagctcatgcctgtaatcccaacattttgggagaccaaggcaagaggatcacttgaacccagaagtttgaggctgtagtgagctatgatcatgccactgcactataatctggatgacaaagtgagaccctgtgtcttgttggggggaaggtattttagatctatagaaaatatcaaacaagtcattttaaaagttcaccctgtgttgaacctttacttcttttctgtgtgttataggtccagtggtttacgtcttggatcttgcagatagactgatctcaaaagcctgtccatttgctgcagcaggaataatggtcggctctatctattggacagctgtgacttatggagcagtgacagtgatgcaggttcactattttacctatatagtgatattacttggtgtgaagatctattaaaacattttttgttagacatttaaaagtgtattattttgaataagaaataacattctcatgttctttctaaatgttatttcccctactttttctttacccaaaaaggagcatattatagctgtatctcccttttttcatagtgaatcttagagatcatttcatataagtatgcagaaatctgcataacgttctatctatagaattacagccatttactaaccaacttgtctcttgtggatagacgtttagttagtccaatgttttgctataaaaacagtgctgcatagcttgcaatcccagcacttcaggaggccgaggcaggtggatcacctgaggtcaggagttcgagaccagcctggcaaacatggtgaaaccccatctctactaaaaatacaaaaattagctgggagtggtggcaggttcctgtaatcccagctactcaggaggctgaggcaggagaattgcttgaacccaggagccggaggttgcagtgagccaagatcacaccactgcactccagcacaggcgacagagcgagactccatctcaaaaaaaacagtgctacatagaacttggataagtggtcaaaaataaaaattaaaaaaaaggaaagaaaaacagtgctacaatcagtaactgctgctgaatattagagagacataaatttcaaaatttagtcccaagccgttgactcttctttttataccttcttcttaaagatttccagctatcaacttagtttttttgtgtgttcaggtcttttgtcctgttcttttctcaaatccagtgctgcaatgatctcttgtgacttcatactcaaaattattgaaatcaaacttgtcacttcttccatttgaaacctaaatttattctccgtcatcgttcctttgtttctgtttctattttcccatctatagtttacatcctttttttttttttttttttttttttgagacaaggtcttgctctgcatagcccagattgggcatgtggtggcacagtcatggctcactgcagcctcaacttcctgggctcagtcatctgtccaccttagcctccatagtagctggaactatgggtgtgtgcctccatgcctagctacttttttctaaggatggtgggaggggtctcactatgttaccaaggctgatctcaaactcctgggctcaagtgatcctcccacttcagcctcccaaagtgtcccaaagtgctggaggtacgggtgtaagccactgcacccagcccatcctatatttttagaattacgtttgactcttcacccccctcaatactccccacaaaccgccccccgacaaaacaaagtcttactctgtcaccaaggctggagtacagtggcgcaatcaagggtcactgcagccttactcctgggctcaaacgatcctcctgcctcaacctcccaagtagctgggactacaggcacacaccactatgcccagctaattttttattttttgtagagatggggtcttgctgtgttgtacagactggtctcaacctcctggcctcaagtgatcctcccacctcagcttcccaaagtgctgggatcacaagcctagtgagcccatctggcctagtctttctattttatagccttctattcagtccactgaccaaatacaagcagtttttccactttgatgtgtcttgtgtctgtggcttcctttccacagtctttaccacctgacttcttgtcacttcatcatacctggatggctaaaggaccttcttggtttatctgacttcatgttcttctgtcaatccatccttccaaatgaatcctcttaaaatagtaccttcaaaatcttactccccagcttaacatctccattgccttaagtagtagtcttcaagagcagcatctagattggttaagtgtttcctaagtaactctgtagtagtgaacacacttaggtttgtagatgatataatttgcttttctttaatataaattagaatttacatgaacaaaaaaggaatgcttggaattttacctaatattccaggaactgcatatgtatctatgccagggtcaaacctttatggcttgctccattaatggtcatggtgagacagagtattatgagacttccttataaaatgatgatgacatcccaaaaatatggatacagttaaatgaatcacaaacagtgaaacatatctgacatgagtgtagtgaataaagtttgagaaccactgacttgaactttagcatgatttgatacacagggtcctctgtaatcgtacttcgttctgctttaaggctgttgggctgtctcctccaacccatccttatgttgtgtagtttttcacctctgtcctttggcttacgtcaccttcccaacctaatacctgcccttctagtcttctgtgtacttatccaaatctaaaccctccttccaggcttagctagctttcctccatagaacttacaggcaactcctgcctgctgtgattccttcttcccccacattcatgacatttttattcctcaaatggcagctagtcctgccctgatgaagtgacatttcttatatagattatctgtttaacttttcttgtttttaggccttatttttcctgttaggaggtaatttccttgaaagcagagtccattttatgcttctgtattccctgttacagcatctacatagaaactaacacattaaagggtttcataaatctttgtggttttgttttttgtttttttgtttgagacagagtttcgctcttgttgtccaggctggagtacggtggcgtgatctcagctcaccgcaacctccgctttccgggttcaagcgattctcctgcctcagcctcccgagtagctgggattacaggcatgtgccaccacgcccagctaattttgtctttttagtagagatggggtttcaccatgttggtcaggctggtctggaactcctgaccttagatgatctgcctgcctctgcttcccaaagtgctgggattacaggtgtgagccactgcacccggcagtctttatgttttttatgtgaccacttcaaataatgagtattagtacatcacctgaggagggaggatcaggatgatttactaagactgagaaagacatagaaacttagagcagattatacattatttaatgtacaaatacattatatagatatatatattttgcaaatgagattgagttattttcttaagactttattgaccataagaagtgagatggctcttttttaagaaagatttttaggctggcacaatgttaaaagaattttgataattaatggggcacttgttaaaacacaaataaattgaaaactctgatccccagcatcaagggatatagtccaagacaagacgttcataaatgaaaccactggagaacagttacaggttagatagataaatgtgataagagggcagaagactatataaacaatattttaattcagtaaaagtgaaagataatttgatttgaaattatgagaaaagtcttgagctaacccttaaaggaaataatttgaattggtagaatgaaataagcaaggaagcaaaaactatagtacacatatgtgttaccatttagaaataaccttcacatgtaatgtctcacttgaaaagattttttttttttagcccagaaatgagactagctatgacagtaggtggatagtgttgtgtgatttaagagtattgggaagatgacttttaccttcctgagcacatatgatagagaatgtgcccctctacaccatcagtagtatttagggtttgccttctaacacttgattgtttttctctgattccttaacaaccctgcagtacaagtaaaccaaatcaaggaatcagatcactgttattttcccatttattttctttccttctccatggacctgtcatagaatcaatactttttagttgtggggaacttgaataggaccttcctcttgcatttttattgaaaagacaacacaataatttttttttctcggcactgtattgaacacctagcactgatgcatttaacccttgcaacaattttatgacatagattattgttataaattattcctagtttactggtttagagagtttacaggtccagtgccacacagcagagaagcattaggactcctgtcccttggctccttaagtgaagcctggtcccagaggcagctggaacattttatcctggaacagtggaaccttaatatgtttagcctagttcccatttttgcctctagtgcaaagacagcccccattagcattgcccattcttaattacagtacttacttatccttgattctgagttaaaaaaaaaaaaaccctgttatttcatcactgtttcatcctcttgttaggattctggccaggtgctgtagctcatgcctgtaatcccagcacgttgggaagctgaggcaggcagaacccttgaggccaggagttggagaccagcctggtcaacatgatgaaaccccatctctaccaaaaatacaaagaaaaaattaggcatagtggctgtattcccagctactccggatgctgaggcgtgagaatcgcttgaacctgggaggcagaggttgtagtgagccaagattgcactccagcctgggcgacagagcaagactctgtctctaattaattaatgtagaattctaataataatttaaaagctcagaccttaattaaaactgttagcctttcagcagcaatgaactgcaggcctacctagatatgaaaatctagcttttagcccttctgcaggaaaaacaaaaaattatttttctctaaacctgcaattctataggtcttttgtttttctcttttttttttttcttttttttttttttgagacagagtctcattctgttacccaggctggaatgcagtggcgcagtcacggctcactgcatcctcgaactccctgggctcaggtgatcctcccacctcagcctcctgcacagctgggactacatacacatgccaccacgccctgctaatttttgtattttttgtagagacagggtttcaccatgttgcccagtctcaaactcctagactcaagttacccacctacctcagcctcccaaagtgcttggattacaggcgtgagccactgtgcccagccaggcctttattttatacatagataacaaattcttagacattctatataattcctggagcttaccccaaaatcgaagtcttaaaaataatgtttttaaatcttgggacaagaaagcagaatgtatgtgattacacacaggttcactgactttgtattggccaaaattaaatcaggcctattgcttaatcacctttcatttattgcccctgagtatgactgttttagcaagtggtgtactgcaggtgttatactaccttatttcttcacagtgtatatatttgcacacttgtttggtttgattttctctcactttcaaaagacatctgtttaacctgccattttagccccagcacaaaatcattattcagtgaatgaatgaatgcatgtgtgaatgatgagcctcatcccacttctaacttgcttgagcatggggcatctctcttcactttagttgtaacaagtgaaatactgggcctttgctcattctttgccctatttccttctttttttttttttttttttttttgagatggagtttcactcttgttgctcaggctggtgcaatctcggctcactgcaacctccacctcttgggttcaagcgattctcctgcttcagcctcccgagtagttgggattacagatgaccaccaccacgcctggcttgtatttttaatagaaacggggttccaccatgttggtcaggctggtctcaaactcctgacctcaggtgatccgcctgcctcagcctcccaaagtgctaggattacaattgtgagtcacagtgcccaacccctacttcctttttgtttccttattcttaaacaccttataaggtttttactgctacccatgagaaacaaacttcctcttgttcgctctagtctatacctgaatattcactcttctttatatttctaaacccaaaaaaaggacacataacccgacaaaggattttttcaaatattctgaatttatttgctaacactttgagaatatttaatcatatttagttataatgttagagtgatcattatattgaaatttttaatgatataaaaatagaatttcttagccagacgtggtggcactcatctgtagttccagctactcaggagggtgaggtgggaagattgcttgagcccaggagtacaaagccaacctgggaaacgtagcaagaccctgtctttttttttctttaaaggaatttcctggccgggcgtggtgggtcacgcctataatcccagcactttggggggccaaggcaggcggatcacctgaggtcaggaattcgagaccaacctggctaacgtggtgaaaccccatttctactaaaaatacaaaaaagtagccaggtgttgtgccatgtgcctgtaatcccatctactcaggaggttgaggcagaagaatagcttgaactcaggaggtggaggttgcagtgagccaagatcatgccaagactgaaactccgtctcagatagatagatagatagatagatagatagatagatagatagatagatagatagatagatgatagatatatagatagatagatagatagatagataaagaaatttcctgggaaatcattataggtaaaacagtcatggccagctaacttttgctaccattatggaattggggtttatgaaatatcataaaccagaccatttcactttagggcaactcaaaaggatcaccttccacatgcaagataggaagttgttaagttctacctggagacacagaagaatatcaaattcgatgacattattgaccattaggaagaggctagcctcctgccctttaatattacatcttaattagataaattaaccaagtggaaatctggactatatccatagctcaaatttggtcctctccacacactttcataaaacatttctggggccgggcgcagtggctcacgcctgtaatcccagcactgtcggaggccgaggcgggtggatcacctgaggtcaggagttcgagatcagcctgaccaatgtggagaaaccccgtctctactaaaaatacaaaaattagctgggcgtggaggtgcacacctgtaatcccagctactcgaaaggctgaggcaggagaattgcttgaacctgggaggcagaggttgcagtgagccaagatcgtgccattgcactccagcctgggcaacaagagcaaaaaattccgtctcaaaaaaaaaaaaaaaatttttggccaggcacggtggctcgcgcctgtaatcccagcactttgagaggccgaggcaggctgatcacctgaggtcaggagttcgagaccaacctggccaacatgatgaaacctcgtctctactaaaaatacacaaattagctgggcatggtggcatgcccctgtaatcccagctactcgggaggctaaggcagaagaatcgcttgaatccaggagccggaggttgcagtgagccaagatcacaccactgcactccagcctgggcaacacagcgagactccatctcaaaaacaacaacaaaaagaggtaaatttaaggccaagattgatgtggaagtgaaaaggattttggagagagggaaaaggtagaagttcacaaatgccaattttgtatttctcgccttctgggatctacaccaatttagaaatagccccaagactaggatagggtaaggaaaagattgtattagcttcattacccccatagatagggtaccctagagttcctgaattgggaaaaatgcctgggatctgtaaccaaaactggacctcctactacagtccctcaattctagaccttggaagtgcacttaaggagggttaggtctgtagggtagacacttagccagccagagacatcacaccctatcttacacaccactaagtaaggagaaagagccaaagagaaatgagctttcaggccatctcttgaaggccggtcctacctcttggctggctatgcttaatctcctagaaggaagatcaggaaaacagttgttttgctggaagacaaataggacttagaattatatcccagttccgtagcccagtctaaccaaatcaaataaaggaatagaagcaacaatcagaggtccccgcccctctattgtaatgtaatcagtctgggtcagccattttaatttttattcctgtgtggtatgaaatggcttgggaactttgtttttcccttgaatgagacatttcttataaataaatcaggactgatagctttccagcttattttttaaactttttatttctgtgtattcttttgaaattaagcattttctattaaaaaaatagagcttaacatgcaacacctcatttgaaaaagaagtaattctaatatatgctatctgtttcacaggttgtaggtcataaagaaggtctggatgttatggagagagctgatcctttattccttttaattggacttcctactattcctgtcatgctgatattaggcaagatgattcgctgggaggactatgtgcttagactgtggcgcaaatactcgaataaactacaaattttaaatagtatatttccaggtaaggcactgaactgtggttgtaaagtgcataccaaattgatcttgaagaacaataacatgcttttttagccatgtttgaaggtagtctaactcttctgatttattagcactaacgcactgcatttttttcctctagggataggttgtcctgttcctcgaattccagctgaggccaatcctttagcagatcatgtctctgctactcgaatcttgtgtggagcccttgtctttcctactattgctacaatagttggtaaattgatgttcagtagtgttaactctaatttacaaaggacaatcttggtaagacggctttaacattacttatattaccttgcaaaagagaatgaagtgtatttgtttttaaaaggtggggaactgtataaatattcggtctgtggctcctatgcattaagcctctatttgagcctcactatcattcaatagcttgagtggaaataaaaagaggagaaaccactgcagcagttctggccttttggaactatgttgtaggtgctttctctcctggcatatgcatgaatcatcacacctgtccctcttgccagtgggattacagtactttacgatcagaccacctggttcaaatcccatcacagaaattgtcttgctgtgaaatctaaatcaaatgtctggactttttgttcctgtagtatggtgatggtaataatcaggattattgtgaggattgtataagtactagcacatagtaagcactcatgttgtttgctattattgttactcccacttctcccctctggtggcatgtaacctgcacggaccttggaggactgaacaaagggggcaaacgtgggaataaaagacaaagacaagagagtatatttggaagaaggggtcagggggcaccttgcctctagtggacaagggccctgagctttacacagccctctgtatttattaggcaaaagagatagtgagaagcaggggtgattgtcgggtaattgtcagtccatttggcagtttggttcacagcaggcttgcgagactgcatcatttgaacagtaggcgctagatttcccagtagataagttcaaggagccctgcaccagggagtgatggcccccagcaaaccctttggtggcaggctcagtgtgagtttactcacatcctgcattcatgataaacagtttgctgtttggtcatatagcctccagtggaatgctgagttggtcacgatccctttggcctttcttgctcccaacagtggcagtctgcacatagtgccctagcattcttctttgtatatcagagtatatgtagaactacatggaagaaagactagtcagaaaggataatggagaaggcatctgtgtcccctgttacctgtagtaacagcgtatagtctgtctctctccctatctcatctcctagtagaaaaagaaaactgtttcatttgcagtcatctgaattagtttagcatcaaagcctacgtcttttgtgatctaaataaaattatttttattactctgtttctctaaatctgcattataaaaagctaattttcctttttattttagggtggaattgcgtttgttgccataaaaggagcatttaaagtttacttcaaacagcagcaatatttacgacaggcacaccgcaaaattctgaattatccagaacaagaagaagcataaaactgacttctggttgttctgcagttctctcatccttatgaatctgttgtgttgttttgattccatcattaatgcacttgtggagacttgtgataagctgctgctcctatattttttaagaaatataataaagcacttagggcaggggaaatcatctcggtaatcatggaacctaaggatgtgatttgttttcattgtttgtatgtactacttttatggcagtcatatgaaccattatcttagcatggtaaacctgggttttgttcatattttctccagacagaaatgcaaagatcaaactgtgcaaatattaaaaaaatgcacatgctgttttattcaaatgcctcttttgtacatgttcatgtttagtgttttctcagaatcagcaactcaaggtactatgaggatttttctcactgacataatttgattacatactaaataagaggatatgttaatatgaggaaatgtaaattaaattagttataaataaataaccaaaaatgtatgtaaacattcaaatgattatctgaacaaatgagattttgtggtgttttctttaacccatgtgatgtcctccaaaatgtgtagggtaaaaattcacagggcttccagatcactttttcaatattaaattttatttacataatgttgacatctcatacttcatgaagtaattttgactcatgcagtcgtgtgtgtgtgtgtgtgtgtgtgtgtgtgtgtgtgtgtatttgtgtgtttcagtgtttcatcaggtccttccatctctgggagttttttcaacccatatttctagaaattacagctgccagtttatagtagtttgagcagaggatgatttgcaaaaataaaaataaagttattttactctcctcttgcattgattcagttattgagatattcgttgatcacctcctatttcccaggcactgtgcagagtgctgtaggacatagtggtgaacaagacagacttggtccaagctcttacagagttgacagtctagtttcagcacatagaaaaccagcagtgaataaaccaaggtgaggccttgagctctttgtttttatattaatgaggagaaaagtatgaaaacaagaagtcttaagtaaatattgaggtcattgtttttggcttaagtttattatagaaaatcaacactaatgtttttagattttaattgtcctattgatgaggctagcaccttaatcactgtttagttttgtattcatttttaaaagcaattattgaagccattttcaatagattggccattttaatgttcagcaacctgaatggttatttttgttaattaaaattaaatttttaagagatattttcaaaaccctatttattttcttgttcacagtaatgcatgtcaataataaatgtttccccttactgataagcggccactttaggagtgtagcaaatatagattgagctatgttagtttgcaataatatatgttaactttagtaattaaagactggtttctatagtatgaatgtcttaattttgagttatatgatgtttatttgaatgactgttgaacattcaaatttgtattatttggagatgaagatttgactaacagtgagccttattaagaacactactacagttctgaaggggaaatataacatctatggttatatattttaaaaacttagattataggctgtaattataaaatatattggcttttgttttcaatgtgaaagatacattaaatggacacatatcttgcaaaattttgttgtatagaacagtttttaggcagcctttactaaagttatgcaaacacacagttccccatttactacattaatgcccttgacagggagtagctgcttggttttataggtattagggctcatgaaggccggggaacaactctaatccttttggggcaggagggagggtttttttagggttgcggggagggaactgcaagtgcctgaggaccagagtggcctctagccccgaattgaacacttttaaacctaaagagccttattattattagctcgagaaataccacatgccagtcttcccaggaaggtgacctgcctgaccatgaagcaacaaaagagcataggcagacttaaagttggatagacctgggttcaaatcatagttcagctttcaataactgtatgtatgattttggctaaaggatttgactttctctcaactgcagttttcttaatctttgaaatgcaaataatgtttatctcagaagactatttctaggattaactgagagattaaaggaacagcagcacttaggctcaaaatcgcccctacaaagcagtagttgtttcttaattgctaagtaatctgtttgcactctaggaaaagtaaatggagaggtaaaagaaaggcattggggacaaatgaaagagatgatgtagatttttcggatgggtgggtatattttattttccagtttattttcatatttctttactgtgttatttctggaaactttaatgttttaaacctcttttataaaattcaatgacgactactagaattcttttcaaaagttaacttatctccaaagtggctgaaaatattgtttaccattacatgattatgaaatgactgtgaagaatataaaattaaacttagtgacttaattagtcactgccttgctaactttgctgtaatttttttaaacgtcttgtttttaatatagcaaactatctcaatactggctggattaggttaaataaagaatttttatgttc

SEQ ID NO: 38406 - DNA, 34989 bp, Homo sapiens
gcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacggtgggtaccatgtgccagctcctggagtccacagtgatccaacctcaaggggacagccccggtgaggacgtaataatgatagctaactcttattgagcacttactgtgtgcagacactgctgagtgttccataaacgtccattctctaaacaataaccctgagaagtagctgttactatcactgtcaggtaaatgagaaaaccgggtctcagagtttaagtggaacggtatcaaacctttgaaaatacttgaagtggtcccagacaacagtgatgcaaagagcaataatgaattcttgcagcccaagacgaaattaagtcgagacaatggtggaaattagtgccttggctgcactgaactttcacttaaagagaggccaaaggtctatcttactaaatgtgactatgttaagacccttctctgttgacctgaattctaaaaacccaggattcctcctgtgttgaattggaggtggaaagctattgagggaggggttatgctcacttcttaggagtcatatgtagggataattaacatttttttcagaaaatgattaattctagaattacacatttagtggaaatattttataatctaatttgacgtttggctggcgccgtggctcacgcctgtaatcccagcactttgggaggtcaactcgggtggattgcttgaggtaggagttcaagatcagtctggtcaaaatggcgaaacccagtctctactaaaaatagaaaaaatagccgggcatggtgtaatcctagctactcgggaggctgaggcaggagactcgcttgaacccaggaggcagaggttgcagtaattaccactgcactccagactgggcgacagagcaagactgtctcaaaaaaaaaaattgacatggatgacttcactgaatgactgtgacccgctaagattgagtgcaaaactttgtgaatatgccttttcctgagatgagagttcatagcagccgattcttaaagtggttcatgatctcaaaaaaagtttttaaaattttccgattgtgtgaattgagagtaaccccaatagatatgcagtacttttaatctttttttattctttttttgtttttgagacaaggtctcgctctgttacccaggctggagtgcagtggcgtgattatatctcacttaagtctcaatctgctgggctcaagggatccttctgcctcagcctccagagtagctggaaccacaggcgtgctcccccagcttgctttttttatttttttatttttagtagagatgagatctcgctatgttgttcaggctgatctcaaactcctgggctcaagtgatcctcccaccttggccttccaaagtgctgggattacaggtgtaaacaactgtgcccagcctatcccttcttaagaagatcttttctcaaattgattaaggctcagtattagtaagtaaaaaagtcatcagctgagatcttgaactctaggacttaactgcggttactgaacctttatttctccaaaagctctcctttctgaattacgagtaatctgaaagaaaaagtacagagaaatatatttgctattttaatatataaacagagctctgttttatatttaaattgttgatttgatgaattagtagggaagttaaatcagtgataaactgggacagaagaaagccaagtattcaatgcctgaaactctaaagtttttggactggattgtcttttattcatgtaagtactccatctgttaatgcattttctctccaaaataaagctatgcttgaaacatcattattatagcatgtgttcaaggctgtttttccagtataggggatgaatttgtgcttgtcctcacactttattttttttttttttggtcacagggtctcactctgtcactcaggctggagtatagtggcatgatcacagctcactgcagcctcgacctcctaggctcaggtgatcttcccacctcagactcccgggtagctggaactacaggtgctgcatgccaccacgcccggctaattttttgtagggacggggtttcaccatgttgcccaggctggtcttgaactcctggcctcaagtgattgcccacctaggcctcccatagtgttaggattacaggcttgagccactgcactctgccagtcacctgtcttcacctttttaaaggacctctctttagacttgtgacagtaataactcatttgttaactgttcactgtgtggcaggcactgtgctaagcatttcacctatgatgtatctcatttaatccttacaacaaccccatgatgagggtactgttatccccatttttcaggtggataaattatttgcctaattttaggacacgcaacttgtagatatcggagcaggaggctgactgtgagtggagaactggatggaaaattgcaggtggcttcaggcagtgttggtggagaagagtgataacccttcatcttgaatctgggctctgttcattagtaccctgctctacaagccaggtgtgcagatgcgataggaggcaagggcagctgagtgctgcttagacctgacaggggctcaacagctacttggtggatgattaagtacactcgcatcctgggtagaaacctttttcctaagtggagttattaaacactattgcttcgtccttagtagtcttacagctgcctataagggctttaagttttgaaaacaaagcaagatagtaattttaaacatacagggaacctaaagcacttttaattttttacattagcgtgcataagttgtgtcattttactaggcacatagaagagttctcaactagagagaagcactgtaaactttagggggaaagcttttgtgtcttagactaagaaatcatggcatattaacaaaaccttccccttcacctcacacattttttttgcagagtgcattataccttttacggggtactatttttttttttttaattgcccaggctggaatgcagtggcgcagtctcagctcactgcaacctccacctcccaggttcaagcgattctcctgcctcagcctcccaagtagctgggattacagccgcgcgccaccatgcctggctaatttttttggtatttttagtagagatggggttttaccacgttggccaggctggtctcaaactcctaacctcaggggatccactcttctcagccttccagagtgctaggatacaggcgtgagctatgggatacatttttcttttctctttttctttctttttttttttttgagatggaatcttgccctgtcacccaggctggagtgcagtggcacgatatcggctcactgcaaactctgcctcctgggttcaggctattcttctgcctcagcctcctgagtagctgggactacgggtgtgtgccaccatgcccgactaatttttgtattttcagtagagacggggttttaccatgtcggccaggctggtctggacctcctgacctcgtgatccacctgcctcagcctcccaaagtgctgggattacaggcttgagccactgcatccggccgctgtggggtacatttttctaaagctcctttttatcgtgaaataattcatacgtacaaataagaatgttgggtggacactagcagcatttgcttcagattccttttttgttaattttgttttttggcttgagatctttttttttttttttttgagatggagtctcactctgtcatccaggctggagtgcagtggtgtgatctcagtttactgcaacctctgccttctgggttgaaacgattctcctgcctcagcctccctgagtagctgggattacaggcgcccaccaccatacctggctaatttttgaattttttttttgagatggagtctcgctctgtcgcccaggctggaatgcagtgacgcgatctcggctcactgcaaaccccgcctcctgggttcacgccattctcccgcctcagcctccccagtagctgggactacaggtgcccgccaccacacccagctagtttttatattgttagtagagacggggtttcaccgtgttagccaggatggtctcaatctcctgaccttgtgatccgcctgccttggcctcccaaagtgctgggattacaggcatgaaccaccgcgcccagcctaatttttgtatttttaatagagacagggtttaaccatgttggccagggcagtctcaaactcctgacctcaagtgatctgcccgcctcccaaagtgcaggaattacagatgtgagccaccgtgcctggtttgaaatcttcttttgaaaaagaaaacgttacagataagattgaaggttgatcttacttcttcccttccagcaataattgcaactataaattcattctctattttttaaaagggttttcttgtccttatttgacagaataagatagagaattaaaaatccagataatcatctttgttgcaaagcggcaaagaaaaatcatccttattaatgattaaaagttgaccaggagtggtggctcacacctgtaatcccagcactttgggtggctaaggctggcagatcacttgaggtcaggagtttgagaccagcctggccaacatggtgaaaccccgtccctaataaaaatacaaaaaaaaaaaaaaagttgggcgtggtagtgcatgcctttaatcccagctactcaggaggctgaggcaggagaatagcttgaacccaggaggtggaggttgcagtgagccaagattgcaccattgcactccagcctgggcaacaagagccgaaactcctttaaaaaataaataaataaataaaataattaaaagttgtgaggtgggggagattcctaccccgccctcataccttattgtctaaatcaccaaagacattctgagcacctgagccggtatgattcttggccaagggtctgtgaatatgagttcagctttaaagcagcaggttatacgtgaagagggggcaagattgaaaagtctctttcctgaaggtttaagtgggcccttcctctgaatcgtaatctctagaggaggggcttaaggactttggagttttaaactggtggttcttatggtcaggcaaatggtttaggggtgcttgttcttaaacttgtctaattataagcatcacctggaaagtttctgaaaactgcaaatgcctgggtttcatattcagcttacgaaatcagcatctctgtaggcaaagcactaacagaactttccaagcgagtcagatcattagccactttggggaaacctctgattgtgggatgctcaaactgactcatttccacttcacaaatttcccccaaagtgcaataggaaaaataaaatggatcttttttatgaaattgacttatggtacactgtggtggcagggggcagtcaccacctgctgatggtgatgttctggatcctacccctcttttttctgcagttgctgttctctgtgtctgtgacttatccccagcacagtgtgacatcaactgctgctgtgatcccgactgcagctccgtggatttcagtgtcttttctgcctgctcagttccagttgtcacgtaagtttacgtatgacacatgcaattttgaaaaaatttgaccaggataatacaatttggagaaagggaaaactttcccaggcttaaaaacccaaacctgatttccagtgttttacgtcgttctgaagccataccgtccaaacaaatatgtaaaaaagtagctatccctggcagggcgcagtggctcacgcctgtaatcccagcactttgggaggctgaggtgggtggatcacgaggtcaggagattgggaccattctggctaacacggtgaaaccccgtctctactaaaaatccaaaaaaattagccgggcatgttggcgggcacctgtggtcccagctactcgggaggctgaggcaggagaatggcgtgaacccgggaggcagagcttgcagtgagtggagattgcgctactgcactctagcctgggtgacagagcgagactcagtctcaaaaaaaaaaaaagtagctatcccttatttgcattcagccaggtgactgtgcaggcaaaagagaagagagaatatacattaaaataatgtaatgaaacctctgtgtttgaagattgaattacatttcaatttgagttgtagacagtggtcacattttttgtatcagtgaattagtatagcctagggtgaaaagtgcattttaatttcacagcttttgttgtggacatagtatttgtaacaaaaaattagataagaaatctgtacttttctgatatgtaaatctaccaggaattctcacagttcgcattgtatagaacaatgaaaaatgacatttccagctgattataaggtaaataaataatctgttctgaatgatctcttataattgaggtttcaaggcttcttttttttttttttttttatgagatggagtctcgctctgttgcccaggctggagtgcagtggtgtgatagtggctcactgcaaccaccgcctcctggcttcaagcaattctcctgtctcagcctcctgagtagctgggactacaggtgcacgccacgatgcctggcgtatttttagtagaggtggggtttcaccatattggtcaggctgctctcgaactcctgacctcaggtgatccgccctccttggcctcccaaagtgccgggatttcaggtgtaagccaacgcgcccagcttcaaggctttttgaaaaactaggagcacttagaagaggctcattaattcaggatgggaccaacttagtattcagagatagctaatttaaatttagccttatagcaagttttagcaattgatacttgataggtgaacccttttaagaagtacaatgggtttttcctgtgagaaactattttattgaccaatgggattttgagcctatttctagtattgtaaaaatgctcagagaacagggcaatgtagtcagattaattttctggctacctggcctgtagcatgtttcagtatttgttgaaagtcattctgttttcctccctttagtaaatacaggagcctgaaagtgacatttttgctccaacttggggctattttttttttttttgagacagagtcttgctctgttgcccaggctggagtgcagtgcctccatctcggctcactgcaacctctgcctgctggcttcaagcaattttcctgcctcagcctcccaacgagctgggactacaggcgtgtgccaccatgcccagctaattttttgtatttttagtagagacagggtttcaccgtgttagccaggctggtcttgaacttctgacctcgtgatccgcccacctcggcctcccaaagtgctgggattacaggcgtgagccactgcgcctaacctggaagatctcttttctccttaaccattagtacctagtagagctcctgccacatagtgggccctcgttaagaatgagttgaattggctgggcatggtgtctcacgcctgtaatcccagcactttgggaggctgaggcatgtagatcacttgaggtcaggagtttgagaccagcctggccaagatagtgaaaccccgtgtctactaaaaatacaaaaatcagctgggcgtggtggtgggtgcctgtaatcccagctactcagggggctgaggtgggagaatcgcttgaacctgggaggcagaggttgcaggagccaagatcgcaccattgcactctagcccgggcaacaagagcgaaactccataaaaaaaaataataataataataatgagttgaatggatgaatgaatttctcccttccacctctaactgatttcctagtgtcccttgttgacttcctctaccattagtcttttaggccgacaccaggccaaaaacctggaggctcccctgacccttgcctcttcctttccttttcctgtctcagcagtctttcctttctcccaacctttcttgagtacctcctgaatgccagcaccagggacataaagatgagttaggcactctcctgccttcaaagagcttaccgtcgagtaagggagacagaggagtggatggcagtttctacatcaagcacgatgagaaggcagaggaatggcatctaactcagccccactaaggaatgctccccagaaaacaggagctgagctgggtcctgaaggacacgtggaagatggtcagcatggactgaggggaagggcattccaggcagagggaactgcgtggacagagatggggggatgtgggatggcctgcttaactgcaggtaactcagtgtggccagaagaggggtggggtgagaggagtgtaggaaagagatcaggggtcaggtccccaggggccttgtgtatatgctaaggggtttggactctgtcctgaagtccacagggcctgggttgtaagaggatcagattcccatcttatgtaattctgcagcatcatatgcagtggatcacaaggccaagcctggtggcagagaaccaagtaaaaagctattgcagatgcggattaacggtttccctccccatcctccccaaaagctgtgacagtggggctagggagaagtatctagatctgatgatgatactgaaatactgcacaggattggggaggtggctgactggaggggagtaaggaatcccattctgtggagccttccatcactctagccctcgtggtcgtccatccctgctcctgctttatgagctcacacctcatcctgtcaagcactcactaaaagaccttcagaagttctcattatctataggcttcttagcctggattcagattcattcccaccttctttcagagcctatcacctgctaccagccatctcaaatccactccagcccaaccttggtactcagagtttcccaaagaccatgagtcgttacccagccttggccattgccgttcttgcacttggatttgcttcccattcctactgtctgtctgatttctacttatcctttaaggcccagtaaaaacggaatgataatatccagtcttggcaagggtacagggaaataggcactcttactacagtgttggtgagaatgtatattgtgcccttctagagggcaatctgggagtgtgtctcagaagctttaaataatgttacctgccttttggtttagcagttccagttcaggaaacatatcctaaggaaacaactggagacagtcataaagatgtatgtataaggttgtcattatagcattacatataattggggaaaattagaaacctaaacctaaaccaacgatcatagctcgctgtaaccttgctcctgggctcaagcagtcctcctacctcagcctcccaagtagttagaactataagcatctgccagcatgccgggctaattttttctttgttttctgtagagatcggggtctgtgttgcccaggctggtcttgaactcctggcctcaagtgatcctccccagcctcccaaaatgctgggattacaggcatgagccacggtgcttgggctgtaccatatccatatctatattggttaaacaaattggggtattaataggctggtatacgatgatgaagccacttataatattgtaagtgcatattaggcattatatattaagtgagaaaagccttaaaacagtatgtagaatatggtcccatttttattatgactatctctatactattatctgtctgtccagctatctgtctatttttttttttttttagagacaaaatctcactttgtggcccaggctggtcttgaaatcctggcttcaagtgatcctcctgccatggcctcccaaagtactggcattgtaggcgtgagccactgtgcccagcctctatgtttttttgagataggtcttgctctgtcacccaggctggagtgcagtgacacgatcatagctcactgtaaccttgctcctgggctcaagcagtcctcctacctcagcctcccaagtagttagtactacaggcatctgccagcatgccggactaattttttctttgttttttgtagagataggggtctgtgttgcccaggctggtcttgaactcctggcctcaagtgatcctcctcagcctcccaaaatgctgggattacaggcatgagccatggtgcttggcctgtatctgtatctatagcaaattgattgggatttgtcaaatctgggattggttgaagacttaactcataacttcttttttttttttttttgggagagagagtctcactctgtcgcccaggctggagtgcagtggcacgatcttggctcactgcaacctcccaggttcaagcaatactcctgcctcagtctccccagcagctggaactacaggcacatgccaccacgcctggctaatttatttttgtatttttagtagagacagggtttcgccatgttggccaggctggtcttgaatgcctgacctgaggtgatccgctcacctcggcctcccaaagtgctgggattacaggcatgatccactgtgcctggtcctgtaccataacttgtaagcactaaaccttccagacgactgatctcaggtgatccacccgcctcggcctcccaaagtgctgggattagaggcatgagccactgtgcctggccctgtaccataacttctaagcattaaaccttccagatgactccacattttcttactctcacagtcctttgaagacagctttattctaaagacaaggaatttggatctattctgggtacttttaaacaatctgaaggtctgcaaaattttatctaattgatgctatcagagtttgtaaagttcactgacataaaaattataccctgatctacgttcttgacaagatttccttaaaggttattctacttgtctcaattttgtttttttctgttagaggaaaaagttttaaatgccaagctttttcttttttaaaaagagatgaggatctcactatgttgccagactggcctcgaactcctaacctcaagtgagccttgcatcttaacctcctgagtagttggtaatacaggtgcatgctactgtgactggcccaaatgcaaaatatttcaacacagaataaactaaataaaaatggattcagccagctgtggtgactcatgcccagcactttgggaggctgaggcaggtggatcatctgaggtaaggagtttgagaccagcctggccaacatggtgaaaccctgtctctaataaaaatacaaaaattagccaggcatggcagtgcacacctgtagtcccagctactcgggaggctgaggcaggagaatcacctgaacccaagaggcagaggttgcagtgacccgagatcgtgccactgcactccagcctgggagagtgaggctacatctcaaaaaaaaggattcaattttttttttttttttgagatggagtctcactctgtcaccaggcttgagtgcagtggcgcgatctcgggtcactgcaacctctgcctcttgggttcaagcgatgttcgtgcctcagcctccctagtagctgggattacaggcacccaccaccacgcccagctaatttttgtatttttagtggagatggggttttaccatcttggccaggctggtccccatctcctgaccttgtgatccgcctacctcggcctcccaaagtgctgggattacaggtgtgagccaccgtgcccagccggattcaattctaatatgctttcttttttctttctttctttctttttttttttgtgagacagagtcttgctctgttgcccaggctagagtgcagtggcgcgatcttggctcactgccagctctgcctcctgggttcatgccattctcccgcctcagcctcccaagtagctgggacgtcatgctttcataaatatcctccacgtaactgttaacatagtacagtacaagcatctgacagttttaaaataattttgctaagattgtgtgcttatgtcttgtaactttgtattattatttttttaattttcaggggcgacagccagttttgtagtcaaaaagcagtcatctattcattgaattttacagcaaacccacctcaaagagtatttgaacttgttgaccagattaatccatctattttctgcattcatattacaaactgtaagtatttgacattgatatattttgtgaagctctggaaaatttttctcaaagttatggaaaaatgtgtcagatttattttataattatgattatggtttttttgagacagagtcttgctctgtcacccaggctggcgtgcagtggcgcaatctcggctcactgaaacctccacctcccagattcaagtgattctcctgcctcagcctactgagtagctgggattacaggtgcctgccaccatgcctggataatttttgtgtgtgcgtggttttttttttttttttttttttttgagacggagtttcgctcttgttgcccaggctggagtgcaacggctcaatctcggctcatcacaaatcctctgcctcttgggttcaagtgagtctcctgcctcagcctcccaagtagctgggattacaggcatgggccaccatgcctggccagttttgtatttttagtagagacggggtttctccatgttggtcaggctggtcttgaactcccgacctcaggtgatccacctgccttggcctcccaacgtgctgggattacaggtgtgagccactgtgcccagccctattattactattttttctttctttctttttttttttttttttgaggcagagtctcactctgttgcccaggttggaaagcagtggcacgttctcagctcactgcaacctctgcctcccgggttcaagtgattctcctgcctcagcctcccgagtagctgagattacaggtacctgccaccacacccagctaattttttatttttagtagagacagggtttcaccatgttggcgaggctggtctcaaactcctgaccttaaatgatcctcctgcctcggcctctcaaaatgccgagattacaggtgtgagctgccttgtccagccctcagttagatttaaagcaattattctgttttgctatatgtatagtgtatatctttagagaccatttcacaggtaataggaagtaactttatagacctgtgggcatgcacattttctttaaaagtaattatgattgtgtagttgtctttcgaaaccgtatacttatcttaaaagtgtttataatatgcagacatacataggaatctaggtttctatatatacatgtgtttttttaactttatttcctcctggtttaatggttgaaaatcaggctcagctttgaacattacctgtggtttctatttccttttttcttttatttttactaagaatatttgcatgaaaacaggatctttatttttatctgagcatttagctcaaatatatgtctagatccaaagtacatgtacatgtaaaatgttatcaggatatcaaagatcagagacacgtttatgcttttatttgtcaaattctgtcatattttcagaatatctttatagattttggttttgttctcttgtgattgaaaacaggcagatgctctgtgtgatttgtaatctgaagtgataactggccagtgactgtcaggttctctgtcgtaacaccagcccagtgaacatgccagcctgcttccttctctctcttctgtacacagcacattttactccaggactttcacggtggctgtgtgagagtagaagtcggattctttcattcccatagccatccggagagagcttctccttacaggttgatacagcaaactcatcagtccaggggctagagaaatagacggattattattggcttctgttgtgctgtttacttgtaagtgctacaaactattacttccccattattagaagaagcaggctgagtctggaggtcctgtttgtttaataagctttaaaaaatcctgggagaagtgaatatggaaaaatacactttttttttttttttttgagatgaagtctcactgtgtcacccaggctggagtgcagtggcgctatctcagctcactgcaacctctgcctgctgggtttcagcgattctcctgcctcagcctcccgagtagctgggattacaggtgcacaccaccatgactggctaatttttgtatttttagtagagacaggatttcaccgtgttggccaggctggtctcaaactcctgacctcaggcagtccgcccgccttggcctcccaaagtgttgagattacaggcgtgagcccatgcgcccagccaagacactatttgttttttacatcagccttgatgctattaaaaactttccaaaacctttatataggtcatacatattatacatatattttataccgatttaaaatactgttttttttaaaaaacagataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgaggtgagcctgaacttgattgattcttttcatcccatcacaaatatctttccttgtaagttaattttcaaggttaccaggaaaactgggttccttgagacagagttgatattatagactaaaaaacttaatgttcatgcctacaaatcaaagatcatgaaaattaaaactgaatatttgaagatggattaaagacttaaatgtaagacctaaaaccatacaaaccctagaagaaaacccaggcaataccattcaggacatagacatgggcaaagacatcatgagtaaaacaaccaaaagcaatggcaacaaaagccaaaattgacaaatgggatctaattaaactaaagagcttctgcacagcaaaagaaactatcatcagagtgaacgtgtgacctacagaatgggaaaaaatttttgcaatctatccatatgacaaagggctaatatccagaatctacaaggaacttaaataaatttacaagaaaaaaacaaccccatcaaaaagtgggtgaaggatatgaatagacacttttcaaaagaagacatttaagtggccaacgaacctatgaaaaaaggctcatcatcactggtcattagagaaatgcaaatcaaaactgcaatcagataccatctcacgccagttagaatgacgattattaagaagtcaggaaacaacaggtgctggagaggatatggagaaataggaacgcttttacactgttgggtgggagtgtaaattatttcaaccattgtggaagacagtgcggcgattcctcaaggatctagaacctaaaataccatttgacccagcaattccattactgagtatatacccaaaggattataaatcattctataaagacacacgcacacgtatgtttattgcagcactattcacaatagcaaagacttggaaccaacccaaatgtccatcagtgatagactgggtgaagaaaatgtggcacatacacaacatggaatgctaagcagccataaaaaaggatgagttcatgtcctttgtaggaaaccatcattctcagcaaactaacatggaacagaaaaccaaacatcgcatgttctcactcataagtgggagttgaacaatgagaacacatggacacagggaggggaacatcacacacaggggcctgtcagagggtggtgggctaggggaggggatagcattaggagaaacacctaatgtagatgatgggttgatgagtgcagtaaaccaccatggcacgtgtatacctacgtaacaaacctgcatgttctgcacccgttatcccagaacttaaaatataataataaaaataaaactgaatatttgaattctgaatagaggatttaaggttgtttattctgtgataaacttgtattttgtctcttcagagttctttgttctcctcaaccttaaaagatgcagcaaaatgcttgaggcatgttgctgagatcatggagtagattggttggttgtctggtcatcttctcaaaattgtatttagttttacagattttggaagatgtgtgctgttttatgtctattcagtagtacacctttaaatgggacacatattaactgaatgaaccttaactcttttggaagcatctttttaaaagcaaagtataaaagcaacatgtactagttctaaaagttcaacatatagaggcatataagttgaaagatccctgtatccattaatattcatactgcaaatcactttgaagagattggtgtgtattcttcctgatttttaaatatgtctattataatgtatatatggtgttgtatagaagtgggatttataggtatccacattgttctagaaaattcctttttcagtgataaatcatgtgcatcttcccatgtcaatataaaatttaccattgagcattttccatgtgccaggcactgtgaagagcttttcaggcattacttcatgcacccccctgggagggatgcaccattgtctccatttacctgatgagaaaaacttaggcacaggaaagcaacttgtcagaactagtgatagagctgcgttgttgttgttgttgttgttgtttttgagatggagtcttgctgtgtcgcccaggctggagtgcagtggtgtgatcttggctcactgcaacctccgcctctcaggttcaagcaattctcccacctcagcctcccaagtagctgggattgcaggcacctgccatcatgatcagctaatttttgtatttttgtagagatggggtttcaccatgttggccaggctggtcttcagctaatttttgtatttttgtagagacggggtttcaccatgttggccaggctggtcttgaactcctgacctcaggtaatccgctcgcctcggcctcccaaagtgctgggattacgatgtgagccactgcacccagccctagagctgtagtttacaaaatattcttggctgggcatggtggctcacgcctataatcccagcactttgggaggccgaggcgggcaaatcacttgaggtcaggagttccacaccagcctggacaatatagtgaaaccccatgtctactaaaaatacaaaaattagctgggcgtggtggtgcgtgcctgtagttccagctacttggaaggctgaggcatgaggatcgcttgaacccaggaagcggaggttgcagtgagctgagatcatgccactgcactccagcctgggcaatagagcaagactccatctcaaaaacaaacaaacaaacaaagccaaaatattattttctgtgtatgtatctgagctgttccactcttaacagacatgtttccagtttttgctgttatccacaatgaacattctcatatatacatacatttttgtacacttcactgattaaatccttaggatacattcctataaatgagttagtttggtaaaaatgaatggaaaatttaaatattgataccagattgccctccagaaaaattgcagtgctttacactcccagctccagtgagtggaaggagttgtttcccatactcctgctggcactaaagcatttggataaactttcaagttcgagaaaattggctataagcctaatagctattaatctgggttttgaagattggaaaataattttgtggggtttggttttgggaaagaaggcattctttcataaaactgatttataaaaaattgatttttatgattttaatgtatactgtatatgttatttaaataattaatgctagcgaaaaataattctctcaaccctgtgtccagccacctagttcctgtctgcagaggcagatcgttatgtcattgtctcatgtacccttccagaggaattccatgactaagaagcctgcaaatacagtaacatgcacatacagaaacacatccttttaaaaatggcgacacaactagatgtgagcttcttgagggcaaggaccacatctgttttttgctcatcagtgtgtctctgatgcctgcagtgctgcttggcacattgtgggtgcccagtaagtgttgaatgaatactttaattacaccataacgactgttggttgttgtgtttgcagtatggggttcctctgcagacttcagattcgtttctgagatttccttcgtccctgacatcatctctgtgcactgataataaccctgcaggtaagaaagtggtcattcttctttccttagacatttgctgttattattaggttggtggaaaagtagttgcggtttttgccattaaaagtaatgaccaaaatcgcaattatttttgcaccaacttaatactttacatttgtagtagtcatcattaaacaggcctcgtaactaaaaacagaatcttcgggttaaaagaggcctcaaaggtcacgtagttcaatttctcacccagggccagtcttttctaccacatgcagtcactgcttgagcacttgtagtgatggggaactgactacctgaaaacagctcactcaattgtttaacacttccagttgttggaaagttctaaagcatatcaacagctaaccattattaagcacatattgtgtgctgggtattgtgttaagtgcttgtatgtgttttcccttaaatactctctgtaatcccttgaggccaggttagtatctccattttttagagcaggaaacagagatgtacagtttcttgttcaggctcactcaggtggtggtggaacaggaatggaccccatgcagttggcctgcagcctgtgctcccctatgctcctctccattcaggagcctccaagagtttgcagaatggccccctaggcagtggaaggcagcaggcttggctctcccatccccaaggggcctcactatgaagaagctaagtaatggacgataggaatgtattctgtattctgctgaaaagacaaatgtattctgctgaaaagacaatcttgcacacacgaagaacagtgtaaattaaaaccaaaccaaaggctgggtgtggcggctatgcctgtaatcccagcactttgggaggctgaggtgggcagattgcttgagattaggagtttgagcctgggcaacatagtgaaaccctgtctttataaaaaatacaaaaattagccagacatagtggtgcacatctgtagttccagctactcaggaggctgaggtaggaggattgcttgagccagggaggtggaggttgcagtgagctgaaattgcaccactgcactccatcctgggtgacagaacaagaccctgtctcaaagaaaaaaaaaaaagaaaacaaaaccaaaaacaactccccctcccccacaacaaaacctaaaaaccaaactgagataccattttcccctgtcagattggcaaaactcaaaaaaactgaagctgtggggaaacaggcagtccacctacatagctggtgagactgtaaattggtacaaccttggtgaagggcaatttagcaatttgtatccagattagaaatgaatgtgctcttcaacccagctgttctacttccaggagttgatcctacagaaatgctggccaatatgcaaaataatagattgcagcattgttggtggtagcaaagatggagacaacttaagtgttcattaatagggaactggtataataattatgccacatctataatactaattatccccaagaaaggaggagctgcttcatgtaaagacaggccaatctccaagatatattgttcagtaaacaaaatgaggggcagaatagtgtatatattgtacatttgtttccaaaaggggaaagaaataataataaaaatatatgtatgttttttacacacatatttgtttttatttccatagaatatttctagaaagagacacaagaagcctcatgccagttgcctctggagaaggggactggtggtagctggggggcaggacaagaattggagggggatttactcattatctttttgtgctttttgaattttgaatctcatgaatgtattctttttgaaaaataatttaaaacattgtaggccaggcgtactggttcacacctgtaatcccagcactctgggaggccgaggcgagaggatcacttgaggtgaggagtttgagaccagtctgggcaacacggtgaaaccttgtctctactaaaaaaacaaaacaaacaacaacaaaattgtatatctgtgttgtaacttattttacagttttacctagattaaaactttttagttgccattggaaaattgaaaaatttcttctcttttgtatttttttttccttgggaatgttaatgatttctagcgtttctggtgaaccaggctgttaagtgcaccagaaaaataaatttagaacagtgtgaagaaattgaagccctcagcatggctttttacagcagcccggaaattctgagggtaagaattattttgaagtggaacttactcattaggtatgtttctgttctttctgcgcttttaaaatatgacaagtacagaataatttcagtacatgattgacactcgagtttaaatttctccagtacttttatatcagtgattattgaaataatcctttaaataatttttatttttttatagttagctcatattttgcttttgttgatttttttctttcattcattttgatggtaaccaatatctgtctcctgaataaaaacaaatctttacgaataactaaaaactttagaaatcataaaaacatcttcatgtctgtgacagaaataatcttattagccccaaaaagggctccctctcagaaacaggccagaaaagaagaggaaatccactttctggttggcagatgacacaggcagtcaggaaagaacaggaaatgggagaagtgggcacaatggtgaaggggccccttctctctggttacagtgactgaaccctaaactgaagaaatgatgaggccactggcccacatgacagatgagatggagggtggcaagggaagaagacctttttcaatgattaaaaaccatatgataggctgaggcaggaggatcacttgaggctaagagttcaagaaccagcctgggcaacataatgagaccctgtccctacaaaaaataataaaaaaaaaccttttgtgtcatggttgtgcacacctgtggtcccagctactcaggaggctaagacaggaggatcacttgatcctaagaggctgaggttgcagtgagctgaggttgcagtgagctaaggttgcagtgagctatgatcgcactccagcctgggtgacagagtgagacctggtctctaacaaaacaaaacaactgccccgccagaaacatacgattattgtcaaaggggtccccttcccaatttcctttttatgaggggtacaggggtagggtggttcatggcaccattatttatctggacctcagtttttaggatcaaatttaacctttccctctcccctcattttctctctccctctcttgtgtaagtcagccatctaggcttgtgaattcttctagttagcttgagctcacagttgtcttgaagcaattccttgggcatccaggtacagttctctttcagcacaggtctctccaaacaggtctatttgtctccctccccacgtttctcagtgggcccttcagaaagaaagctgcagctctactggggaggcaagagcttgtcattgaggaggcttgggccagaggcaggaagaccagttaggagtctgtggaaatcgcctgggcaagcaatggtggccttccagcaaggacaggtgcagtgagagtgaccaggagtgcaagaactgtgcttcccacagtgcttatggccgtgagaccatgtggaaatatacaataatgaccctggagcatggagccttcctgagactagcttggtgagcttctacctggaggaaatgaagatagaaggaaaacgcaatgtgacctctttgattaggacatagattcaaacacatgcagatggggagtcttgatcaaggaaattctgttttcttctttgtgaagcctttaataagatgaatatactcttcaactcgagatctgaaaaagcaatgaaaatacttctttttgttgtacttaacacaattttttgtggtttctttttatctaggtacctgattcaagaaaaaaggtaagagtatttatttatttttgtaatagaaagtaggatagtttataatactgtcttatttctgagcccttttaaatgaatacagttacaattagaaggggaccttgttgctaatagcaaatacatttgccaaaaagcaagcagaagtgcaatagggaaactccttagtgggagtcacacttctgggcttcccagctgcctctgttgttgtggttttgtactcttccatggttcagtgacaccactgtcgtgaccagcagtgggtatgattgacttctggacattcaggctatcccttgctcccttcttagtctcttgttaagaaagctgtccagctcccaggatgctgcccgtccagggcagaagccataagcactttggccagtgggtgtccataccgcgtgggaggcgtgccccgtggtataccttcagggctttatttgagggtgggttcttttcaaagccttatcgccccagcccagggttctacttgattgtggtcaggatgtcagggtctcttcgtggctatgtcagaaggaatgtggatccctcaccccttattctagggtttgcaccctaggtctgcctgtgaacacagtccccatggaggcctgagttggtggctttgtcatagtttcccaccctgtggaactggccagcctaggttcaaacctcagctttgccattattttcttgtcggactgacaccgtggtctccctttgttgagtggatggtaagcgtccgtgcagaggcatgacacaaggccaagtgggagaagcacatgaggtgctggtgcggcatctgcgcatgggatgcactcgggatggggatgcactggctgtgattgacttcactgatgctctgcacacaaacatgtttgagggagatgtttgaaaggaaatagccatgtgactttgggtctcacacaacggtgtgtgaggctggatcctgtcttctgtgaagggtgggaagacctattatgaggaatgatggatgttacttgtgttttcaaacttgttttagttatagagaccctttcttaaatgcagtctgaagtggaaccctctctagagtgtaacacacagactgaatgtggagctgtgctggttggagcagggatggggcctgaagccctccacctgcccagtctccttctctctcctctttggtcccagtgaagaaccctagggctcccaggaatgcagtgtgaaagtcatgcaatgggctagctctcacctccctccaacccctagagagtgcttggattttaccactcaaaactggaaccgtctgtgggggcagcagccctatcagccttgttcatgatatatccttatttctaacgcagcgtccagtaggtactgggcactcaatgagttacgcatttagtgatgaatgactaggaaggaggtgggtccattcagggtgggaagacctattatgaggaatgtgatggatgttactggaaggcttggagcaggtgccaggactgttctaagtgctgtatgtgtctgacgtctttgaatcctcttggctgtcctaggaggtaggttcagttactgtcactctctggcagatgagtcacaggagatgaatgagctgcccatggctgcacagctgggaagtggcagagctgggacagggatctaggtggtctggccccagggaccttatactttaccaccatactgggccagctctactctgtgagcccatgtgacaggcttcacacaccttccttctttgcatcctgtggccacacaggacgtggcagactgggacttccaacttaggtctgtgtgacaccaaaggttgtgctctaaaggacaagcatgtaaactaatagtaggaatttgtttaaaattttcttaaaaagcagattttaaggttagaggatcaggagtatagaaattgggtctaatctccccactaagtgaagactgttatgattgcctggaatcattgtcagtatctgtggagccatcagtgaaagattccagggtagccctgtagtttcattgagtatgctggagttctttaccagtgtgtgtgtggtttgggaatggtatgtggtagaagaggaatcaaggaaatcagcacagcgctactgtttccttctcgggacagttgagtgagctgtcgagacgagggcagctcctgccattgacaccaggactctccaaagctcattgacactgaatccttcggtttttgccaattccacgcacacaccatggaagtggctccagcagaggctggtatggcaggctatgctctttcttggaacccggtgtcattgctgaatcaggggccactatgctcagagtaaggaacccggggttgcccttgtgttaaacaagagctaattgaataacagcctaggaccccctccatgctgaaaccccttggtgcggcatgttatgcagagggcctcacagtgactagcattgcccttctgccattctcgtcacatgacagctcacgtctttgttactgagtcatgtcactttcttctatgagaggttttgactcgcaggtcttcttggtcatgggagcagacacataaggactgcttatttatctctaaaataactgcttaaatacttggtcattttgaattataaacagcatggtgcatgattgagtgcaagttcaaagtggtataaacaactgttaatagatacatgaggctccttcctcaacagtggtttctaagaattgaagtttagagcaaatgacagattcatcctatagtacgaggaggctcagctacctttagaggatggcttgatgccttgttactctgctggtggtggccatgaatgcaaaacgtcctttaatagcactgggataagcagggcttccctggtgctgctgaaaatgtttgtctgtgtctgttttttgttgctcataatcctaccacccagagaaaccactgtgtgtgtgtgtgtgtgtgtgtatgtgtgtgtgagcgtgcttgcgcttgtatagaagttgtgtataaattgggtcaaatgaatattcgggggtgtgtgggggcttaaggatatatatcctgggactgcatgtgaatgtgcatgtgtgggtatggagtgtgtaggagttgtgttttggaggtgaggatatatatgtgtgcttgacagtgtgatggagttttgtgtgtatttgagatataattcatataccataaaactcaccattttaaagtatacaattctgtggtttttagtatagtcacaggttgtgcaaccatcaccactaattccggaacatttccatcaccccaaaaaggagccttgtgttagcagtcactcctcattcttccccagctttgtcccccatcccctggcaaccaccgatctacttttcgtctctatgggtttgcctatttggacattccgtataaatggaattagaactgtggccttttgtgtctggcttccatgacttagcatgtttttaagattcatctgtactgtggcatgtattagtactatttttagggatgagtcatatgcctttgtaaggctagactttgtatttatccattcatcagttgatggacatttaggtggtttttggttttagctattttgatagtgcagctgtgaacatttgtgtacaagtttttgtgtaaactttatgttttcagaggtaactacttttaaagttttggttatatcctctcaagtattttctttgtgaatgtatatatgtttattacttttgcaaatgtggatcatagtatatacactgttgtgtagcatgcttccccctacttggccatatatcaggggaggtttctttccagttggttggttattttagcccatcctccctgggtagagcatcttcaacactccaggtcttcactctgcaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaggtgccgagtttggctttgagagcttgtctgtggcagacttaagcctcttgttgcgccggggtaactggacgccctccgaggacgctctgtcccagcccatggtgtggcttttcttggctcagctgcctgcttgtctttctgctgtctcatcaaaggacacctcttgtctccacaaacttagtgacttgccggaatacatcaaaatatttttgttgttgctgtttttgttttaacatgtttcctctgcagagataggcttattgcattctgcttggaccagcttatgtggaacttctgtaattgggcagagtggctcagatgaccctgtctgctaggggtggtgctgagggaacacctctcataatccaactggacagcagagcaaggcttcaacacatggagaaacagggaaagatttgctatctatgggtgttttcagttattcatacagcttctgaaatgtaatggaacaggtatatttggagtatcattttgtttttaggtaaagtacagcctcacatacacagatgcaggtgaagtcaccaaagctgatctctcattcgttctggggacagttagcagcgtagtggtcccactgcagcaaaagtttgaaattcattttcttcaggtaaggttgatcaatttggcataagtatttaattgccaagttaaaaagaaataatgacttctcagtggataaaactgaatttctaagtattacatccaagcctttgtagtgaacagagggctttgtgtagcctgtgcatttgtaatgaaaccaagcattctccttgtatcttttttccttttgggaaaagattcccttccacattagcttgttcttttacagtatgatgtactcctacacctggcagatgtatttatagttctgagtagggagggagaaattcttttattggttggtaattccatattttattatgaaagaagaatttttcttcctgccatttccttattaaaatgagaattatttgggggcatttctgcattgtctttcaggaaaatacccagccagtccctctcagtggaaaccctggttatgtcgtggggctcccattagctgctggattccagcctcataagggatatcctttttggttctgtagagggtggatttatttctctctccatgtgcgtgggctgcactgctctttatcgctgaggctcccctgggctgcttgtgggaaggagagagcagtccaggccgagcttcctgcaggcggctctggtgggcggccagtctggctacacagcaggtgggctggggggagactggcagttgggggtgagacagcacgtcctgggaaaatgtcagtgttttttttttttaatctccttttttttttcagcctgccattaagccacaaaatatgtcagtgttttacaacgaaaatcttaagagagaaaagttgacatttaaatgtttttaatttcacatttaaacagacactcctaaacagatgtagtgattttgaaaatttagaatttcaaagggccagtttctgagaatttttcttctgagaatccatttattaaggaaaatagaactgtttttttgcctgctcctgggaaatagctgtcaaaatcccagaggcccagaaaaagtgtatttgggtctccctcatgtcacacaagtgacactgtcttcttacctgagaaccaggctgctctagcactaggcagttgtcccttaactgtctgtgaatgtctgggattattcagaccacaaatagatatggacagcttactattcttcatagcacaactgagcaagactgcttagcactggagggggtccggaccccagtattatttggttacactatgcaatctggctgtaaactaaggtaaaagagtcacttgtttctgtttgaacttgtgctgatcagaaaacaaagcattctcacttttccccattttaatcaaatctctgcatcagctgatgagctcacatgaaagccacatatagtatatcatcatgcatgaatagtagcaaaactgttacaatcatttttgttattaaatacggcaaagcaaaaatttcaaggctttgtatgtttctttttctttttttaagagatggggtctcgctctgtctcctaggctggagtacagtggtgccattatagctcactgcagccctgacctcctgggctcaagggatcccgcctcagtctcccaagtagttgggactacaggcatgcaccaccacatccggctttttttttttttgagacaaagtctccctctgtcacccagtctggagtgcagtggtataatctcaactcactgcaacctctgcctctgggttcaagcaattctcctgcctcagcctcctgagtagctgggactacaggcatgtggcaacatgcccagctaaattttgtatttttagtagagacggggtttcaccatgttggccaggctggtctcaaactcctgacctcaggtgatctgcctgccttggcctcccaaggtgctgggattacaggtgtgagccaccatgcctggcctaatatttttgaatttttttttttttttgtagagacaggatctcactatgttgcccaggctgatgttgaactcctgggctcaagcagtcctcccatctcagcctcctaaagtgctgggattacaggtgtgagccactgtgcctggcctgtatgtttcatttttaaggttgtttagcatttgagttcacagcaaaaatatttcccctgacaatatttcctgtgtttctcaattttaatatacacagcacatcaaaaccagtgagaggaagcctgaatatgatctgtttttatcttatcaaatatgtacataatgtaaaatatcaaacagcgctgcgcagcttgttataaaaatagttcttaccctcatttgccccaccttggaggcaaccactttcaactcttgtagctgtttttttcaaattctacccccaaatcttgaaataacctgcatataatgctacttcttgatttttttggttttatgaattttttattgtttccattaaggaagacaaaggtttggctctttccccttcatcccctacctcatgacccacacacttcccacatcttcccagggtcattggatcattattttggttagaccaatatttaccatttacttatattattttttgagacagggtctccccctgttgcccaggctggagtgcagtggcgtgatcaggctcactgcagccttggcctacaggctcaagcaatcctcctgcttcagcctcctaatagctgggaccacatgcgggtaccatcacacctggctaatttttaaaattttggtagagacagggtctccctttgtttcccaggctggtctcgaactcctgggctcaagtgctcctcttgcttcagcctcccaacatgttgggattacaggtgtgagccagcacatccagccaccatttacattattagttctgatccatttagaccagcatttctcaaagggagagggttccatggaatacatttccacaagacatcagtaggggtaggtctgtggtccaatacgtttgggaaacaccaaattaaagttaaaacaatggttccttcctgtattactcatcagagcctttaataggcaaatgtgcctcaggagggacatggggatgtggaggttcaatgcttccccaactttggccatgaaacccttcttgtacagatcttcagtggaacacagtttgggaaacactgttttagactcatcatctcacaggtaaagattttgcaaagttagagactctttagcttctgtcagataatccctcatttggagaatgagaagataatgaaactgggaaggaatggaactgctcgtggggctgagagcagtggctcacgcctgtaatcccagcacttcgggaggctgatgtgggcagatcacctgaggttgggagttcgagaccagcctggccaacatggtgaaaccccgtctctactaaaaatacaaaaaaattagccaggcatggtggtgggcacctgtagtcccagctactcaggaggctgaggcaggagaatcacttgaacctgggaggcggtggttgcagtgagccaagattgcctcactgtactccagcctgggcaacagagcaaactccatctcaaaacaaaacaaaaaaaccaaaaatcaaaacttaaaaaacaaaaaactgctggtgggctgggtgtggtggctcactcctgtagtcccagcactctgggaggattgcatgagcccaggagtttgaggctgcagggagctatgatggtgccactgcactccagcttgggcatcagagtgagaccttatctcaaaaataaataaacaaagggaaggaaaggaagaagaaaatgaaaaactgctggtggatgaacaacagcctcattcagttgacttctttttccttcaccaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggtaaaggggagaaggtacaggttccatgctagtggtctctgtcttccaggtggtgtgatgaaggcagccggggaagccagctgttaaggaggcaggatggccctgagtgggagcgcgggctgaatcttggatactgatttttgccccttgttagcaatgttgcctctggccagcagttttatggctttgagcctctgttttcatctgtgaaatgggaacgctagtcaatagtgagtgaatggcctcatggggcattgagagggttaagtgaggtaacatttatgtggccctgggcatggtgcctagtggtccataaatgggaacctctgtgatcctcatcctgttgctaccatcattgtgattgctggtgtcccccgagccctctccaggcatctcatgacacgatagacgaatgttgagtcctgtatcaaagactgagactgacttccgtgcatgtggctctcccacccattgtcccctgttctacacaggcagcccacacctgagagttttcactgccacagttcctcacagagttgaatggaagttgacaatcctacagataggttcccggtcacacatgatgcttctgcccacctttttcttttgtcttagcagtcagcgtgtgggccggccctggcccaggggcgtgctctccatcttagcctgtaattgcccagcttgttcttgtcacgctttcttcagacctctcattatccgctccgaatatttctagcatgggcataacgggggtgaggactgctcacttctctgatccgccctcccaccgaggccagcagagacccgggattactcagtccctgccgttccactgcgaagtcttgactcaactctcccaccagaaccaggcacatcgcttctggcttcttggccatgggtgaagatgtgcagttattactcctcctcagaagggaagacatgggttgggaggagaggcagcagtgcgcacatggcaccgtcagggtctgtgctgatcctgggtgctcagagggcctgcagcagcaggttttgtaccaactctgccggcaacccaggtagaggcaggcacgagcacctgctaaactcagtttccaccagctgcatgctgcattgtctcctaagaacagggtattcgagaggattgttcagtctgcatggtttttaaaggcggttccaagctaaggaattccatcagtgcttttttcgcagccaccaaatttagcaggcctgtgaggttttcatatcctgaagagatgtattttaaagctttttttttttaatgaaaaaatgtcagacacacacaaaagtagaatagtaccatggagtccccacgtacccagcctgcagcttcaacagttaccacatttgccaaccggagagactgccaaggcaggaaaaagccctggaaagcccacggcccctttttcccttgggtcagaggccttagagctggctgccaaagcagccaaccaaaggggcagctcagctccttcgtggcaccagcagtgttcctgatgcagttgaagagttgatgtctttgacaacatacggacactgcctggattacctagatgtcacatcttaattgccaattgatgaaattaggtaaatgaaaagaaagcacttaaatttccccttagagcattttaacatgacatgcaatcaggttttgtctgctaataattatttctccccctccatccctcccaccagtttctttcctgaagtctgtgaggccgctataaacaggtagatgaagttagagcagttatggccctaaatggtccacagttgggtattggcactaccgcagtttcaggtgatgtcggcatttttagaaataggaggagatggaaaaattacgcttcagctgttaaaaatatttttggggcattgagttactttaaaacacgtatattctctaagctgtttttatctgaacttgtagagtctattcattttcttgttcagaacattttgtaatatgtgaaaccttttataattaaaactctgaactgcagattaagtctgacttgcagttttgtaagattctaatggattaacagcattttgttttgcaggattcctgccagctcccaggggctttggttatagaagtgaagtggactaaatacggatccctgctgaatccacaggccaaaatagtcaatgtaactgcaaatctaatttcatcctcctttcctgaggtaggcctaacctagtttaaaggcataggttaagacagaagtctagacacaactcaagtgtggtaggtgacaggtattactttgtgaaaaagattataatttaaaccatgggggttcataaaatatttcagcagtcattcttagaaacactgacgatggttctacttacattagcattctggttcagattggatctttaaaattctcatgaaaattatgatattcacgtgttaatcagacaccctggtaaaattgtttctctcatccaagttaatggccaattagtgctccaggacctatcagattcatgaactgacagtagttgggtgaggaagagaatgaaaagtgtctcattgttgtcattctgggagcacactggagggtgggccttgcatctctctgtttattacaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacgtaagtgaggaaactacgcccctcctctgaggtcatcccctttggaaagtgtgcacgtggggctagaagtccctaggggatactgcattttatactttttgagggtctcgctttgttgcccaggctggagtgcagtggtgtgatcatggctcactgcagccttgacctcctgggctcaagcaatccacccacctcagcctcctaatagctgggactacaggtgcacaccacaacacctggctaattttaatatagtttgtagagatggggtcttgctgtgttgaccaggctggtctcaaactcctgggctcaggtgctcctcctgcctcggcctctgaaagtgctgggattacaggtgtgagccaccatgcctagccttattatacttctaacctttgaggttgcctccaaaccagcacactgcccttctccactcccttcctgccttttttccttttggaaatgttattctatctgacttttgaatggggaatatgcttaacacataggtcatagatgatagaacccaaaaagtctttggggagatggtaaagaacatgaacaggacttgaagcagcagaggcaagggggatttggccagttcattcatcccctgctttgagttatttattttaaaaatactcagttcaggttttttcctttttgggtccggttgaaatgagtacaaaaaaatagcaaaatattagataaaatcatgcgagaagagcacacagcccttacaaggggatcttcccccaaataccttgttaattatagtggagtcttgggtctaattgccatttctgcaccaggcactgtagctagcttgctctccgactggcaggctggtatgggtgccacagaggaaagaatacagtaggagggtccagggaaaagagagagtttattttatacagtagttgttttattttatacagtagttgtacagtaattgaggaaaaatgttgtcaggtggcagaaaacaatggagccacctagaagctggctgatgcagctggggcacacagaggaggggcctgggtaccccttttggggaaactgagacgaagctatttagaacagcttgaaaataagagacttttctagaatggggtggcagctaaagtagcttctttttctttctttcagaatgctcagatgcatcagttccttaatatacacgtgaaatttgaaaactgtacattcggtgagattaaattttatatacaact

SEQ ID NO: 38407 - DNA, 4672 bp, Homo sapiens
tccctctgctatggctcttcctcagtagaaacaactggcaacaaaattcaagtttatgattcattcatcagcaaacatgtgagaatcatctacaaagaaccaagaattgtggtaagaattatacaaacatttactatgatactgataataatgaaaagcctaattcaacaaatagtgatctatccatttttaagccccagtaactcaaacattaaaaaactataaatgaacaggccgggcacggtggctcacacatggaatcccagcacttggggaggctgaagtgggtggatgacttgaggtcaggagttcaagaccagcctggccacatggtaaaaccctatctctactaaaaatacaaaaattagctgggtgtggtggcgggtgcccataatcccagctactcgggaggctgaggtgggaaaattgctggaacctgggaggcagaggttgcagtaagacaagatcgcaccactgcactccagcctgggcggcagagtgagaaaaaaaaaagaaagaaagaaaaagaaaaagaaaagaaaagaaaaaactatagatgaatgacttaagtgaataacaagtcaagtgagtaatgacaatatgtagaaaaatattccaagtagaattaataaattttaattatttgaatgagaaaatgccgccatattcaaaatgaaagtaaaagtaggatgagatcagcatatacaactgcatatatttcattaattaaagatgactaaagaggagactatcaatttgaaagaagattactaagattttgtttttttaaaacatactgaaccaaataaaaaaaaaataacagtaagacataactactaacagaaaattttttccaatgagaatacaagcttattaaccactccttttttcattaatgctcactcagcttctaccagccttctaataagaacacacacatacatcttttctataccaaatgtgatataaaagatattcaacccttcaaaattttaagtattggttataagtaatactcatctttttttgtcatttgataatagatgaattttctagtccagacagtagaaatagattatagttcatcaacaaatgacaaaaattgctgagtgtgaaagaatggtgcaaaacaacacaaaacattttactgtaataagttatttttaagctagctaagtaatttatgagaaaaaaataaattgttcttaaattacttaatacccaagaggaagagtttcagcttaaactagaccaaattaaaaaaataataacagtaaggcataactagatctagccttttctgaagaaaatgatatttaaaacaagaaaaacatgtgccatagaggttgtgatatcctcaatctttgaggaaataacacctacatttaagtaccctcaccttacacacactttcttcttctgattttggagtctttaaaatataagtatactttttttttttttttttgagatagtctcgctgtcgcccaggctggagtgcagtggcttgatcttggttcactgcaacatctgcctcccaggttcaagcgattctcctgcctcagtctcctgggtagctgggactacaggcacgcactattgccctaggctagttttgtatttttggtagagatggggtttcgccattttggccaggctgctctcaaactcctgatctcaggtgatccacctgcctcggccttccaaagtgctgggattataggcgtgagccactgcacctggcccaaaatatgagtatactttaaatataaacatataaaccattcatagaaacttttagatggagacaaaatctgaaatatatttcaatatatagttaatgtcatattaaggggttaagggaagagctgggaggaagaaggaagataagactatgaacctaaaattttgccaagtagtaggatttttattctctaaaccttatttcaatcaatttaaggttaaaaaaattttgcttaaaaagatgcaatttcattttgtgcttagaaagtaaaattaacaccacaccaaagataaacattcttgagtttgttcttttggagaaatgagtaatttaaaaatttaaacagctctaaaatattaatacaactgcataggaaagaggaaagaatgttagaaaattgcttatcaaaaactaatgagacccaggataagagctactcataatgataacaattaaatattgagtatttttcagaaaccaagagtcaaatgcttgttataccttaaaggttaaaggcccctgtttcatagtcattaaacagttctttgaaatgctatgttaagatatcactaacaatttcaatttataaatacacacccatacacattttcttttctaaattgtcatatcccaaacacgaaaacaatcgaataagagaacaggctgaatagtgatttttttctttcaattattactactgaaacaaatcaaaacaactctgagaggttgccagcaccgcagaaggcatttccacataaaaagagttaatgagcagaccacgcagttcaacagccagtgaccatttgcaagcctcctaggtatattcccagcagacacattatcagattaaaggaagtgcaaacaaactgggctgaaagtttctttgtccaaacccagcctcttcttcctgtgatgtcatattacaaatctaggaagcctttctttttcacttcagagaaagcgacctcaagatacaactggcaactgaggaaaaggcctcaattcaacaagagctaacaagcttgggagtttatttcggaatctttaaaagactcttctgcttacccacaatctgggatccactgcaggaaaacaaaaaaggaaaacttcatttaaaagaagcaagaagtaaaatgggacaaattgggaatgtttaagtctctgaaactctgcactgaaaagaaaataagattgataacttaagcttaacattctgaggcataaagaaacattaactttggagtattcatcttgactactgaaatacaagtttagaagacaagtggtttcattctggtcacagatcacagcttttctttaaatttataatcctatgggttggactcgttgactgtattttttaaaggttgctcgtcagttaactgagccttggaattcatggattttctaaagactaacaaatgaaaatattttcctgttgaagaacccagcggaaattttacagcaacaaatttcatgtttcttttgggtatttctgagaaaaaggaaatatttataaaaccatccaaagatccagataatttgcaaataaattggaggttatagaggttataatctgaatcccaaaggagactgcagctgatgaaagtgcttccaaactgaaaattggacgtgcctttacgatggtaagcgttaacagctcccactgcttctataatgactcctttaagtacactttgtatgggtgcatgttcagcatggtgtttgtgcttgggttaatatccaattgtgttgccatatacattttcatctgcgtcctcaaagtccgaaatgaaactacaacttacatgattaacttggcaatgtcagacttgctttttgtttttactttacccttcaggattttttacttcacaacacggaattggccatttggagatttactttgtaagatttctgtgatgctgttttataccaacatgtacggaagcattctgttcttaacctgtattagtgtagatcgatttctggcaattgtctacccatttaagtcaaagactctaagaaccaaaagaaatgcaaagattgtttgcactggcgtgtggttaactgtgatcggaggaagtgcacccgccgtttttgttcagtctacccactctcagggtaacaatgcctcagaagcctgctttgaaaattttccagaagccacatggaaaacatatctctcaaggattgtaattttcatcgaaatagtgggattttttattcctctaattttaaatgtaacttgttctagtatggtgctaaaaactttaaccaaacctgttacattaagtagaagcaaaataaacaaaactaaggttttaaaaatgatttttgtacatttgatcatattctgtttctgttttgttccttacaatatcaatcttattttatattctcttgtgagaacacaaacatttgttaattgctcagtagtggcagcagtaaggacaatgtacccaatcactctctgtattgctgtttccaactgttgttttgaccctatagtttactactttacatcggacacaattcagaattcaataaaaatgaaaaactggtctgtcaggagaagtgacttcagattctctgaagttcatggtgcagagaattttattcagcataacctacagaccttaaaaagtaagatatttgacaatgaatctgctgcctgaaataaaaccattaggactcactgggacagaactttcaagttccttcaactgtgaaaagtgtctttttggacaaactatttttccacctccaaaagaaattaacacatggacattttaaagtctttagtataaagaaaatttgtattcaatgtgttaagcattaacatgtattttatttgtgtatccactccatctgatttttctgagccattttgatttgttccttcattaaaaaaaatctcttaaagtt

SEQ ID NO: 38408 - DNA, 27777 bp, Homo sapiens
ctggtggaccagctggctcctaaagaggagaggggactaaatcatgtatgcttggttctttcttcccagcttctctcaggtaactcacgtttcctcttccccaggtagagagaggccaggagtattattaacagaagtcccattttcagggaaacatgactagtaggaaatatgtatcccttccctacagagaactccaccttctcagaattctccctcagcaagactgagtgtgtatgtgtgtgatgagagagatggagagagatagaaagagagagagacagtgagcagtaaaccctcctgcaagcccttcctgaccccagccagggggacctgcccatctctctgtggcctgttggccatcctccacccctgttcttccagccacagcttccctgccattcctgtactgggaaccaacttctcttttctttcgtctgcctcctactggtgtgaggtaggatatgccagtttccctccttttatcctttattccttctcatgtggaaaagcaaccatgacttttagccagtcataaggctatattttctagccttctttgctgctaggcatgaccatgtggttaagttttggccaatgaggtgtaagcagaagtggtataagagactccttggaagtgcacctgtagggaaatgggatacccctttttgtctctttcctggtggctggaatgtgaacataagggctggagcctgagcagctatcttagaccatgaagtggcagctgtgcagtgaaggccgtgagggagcaaaataggagcctgggtacctaacaagtttgtggaaccacaataccaaggctgtgttgttctctcccaactacttcgtttatgtgagagaaacacatttctttcttatctaagccactgctctttggaggtttctgtgtcttacagccaaacctaatcctaactaatagaaaatgtgtgtgggtgttagcaggtttacagacatctagatgcagacacatttgtgcaagtttgtggagaaagtaggagtatgaacagtcattcacctattgcttttttttttttttttttttttctgagatggagtctcactctgtcgcctaggctggagtgcagtggcacggtctcagctcactgcaacctccatctcccggattcaagcgattccccagcctcggactaccgagtagctgggattacagatgcgtgccaccatgcccagctaattttcggatttttagtagagacgtggtttcaccttgttggccaggctggtctcgaactcctgacctcaggtgatctgcccgcctccacctcccaaagtgctgggattacaggccaccgtgcctggcctcacctgcctattaatgtaaactgagcacccatcatgtgcaaggcatcctgcatgacaggactgtgagggagacaggtgaatcagagagacactgccctcaagcagcttagagtccagggcatcgagcttgtacacgtgtgaggccggaacttcccacagtgtatcttctgttctgctacctttcctgaaaagaactggctcacctcggattcctgccaggaatggctgctgttttatggggtttgggccacaactgaggatgaccgaaagcaaggcaggcctgggagaaaaatgtggctcacttgagatgagcagggcccacagatatcagtgctggggcaccagttgaacagaactgtggtcatataggtgtggctgggggctggggatagagaacagggagcagcatctgttctgggatgggaagtgtatggtctccagaacatactggtccagcgtctgctcagagacatgctaactcctaaaggagagcttcctaaagtgggtcagcagcatgagcatcctggggagctgatcagatatgcacatccaaactccaaagggagcgccatcaatctgggtttttaggagacctccaggtgattctgatggatgctcaagttagagaatcctggacctctgaagccaggtagcaaggtggggcaagtcagcgcatagaaggctacaaattccaaatatagtgtaatccaagcaccgaagccctctctgagacaaaagctgatttaacaaaccccacgagtaacatgtgattgaagactggcgaggcccttctaattaacatccacggtccatttgtacaacagacggtacaaaacataatctggataaactcagaagacgtgctcatataaagatttgggaagtctccaaattcaatcaagtgagcagagcaaatattctgaacctgaatacgaaagaacatcttaatgtgattgtgtcgtaacatgactgggaatcaaaataaagatgcgttaagcaacagcagggcaggggttctgcttacaatgtcagccacagagcctgagtttgttagtgtttattcagcactgcccaaaggatagagctaggggtggcagaatatgtgctccgtgcatccggcaggatgggaagacacctagaatagcacagggtagacgtgagtgcccttgttcctggaagtgcaaactctttaacatggcaagccttagctgtgagatttctccttagaggatggttcttaccttttactggcttatgaacccagagaatctaataaagacttatcacgtacacacacagtctttgattcaataatcatgttggaatctcccacagtgcaccttctgtcatctttccccgaaacaaacagacaaacaaaccaaaccaactaaaacaacagcaaaacccagcccatttctggttcctgctttggatgggctggaatggtcttatggcattcagtccacaatggaggaagaatgaaagcaaggcaggcccatgtggggaacactgctgacttaggctgaaactcctgaagattaataacactaagtatgacacagtcctgatcaccaagaatattagttatcttttgctgtataacgaattatcccaaagtgtaatgacttaaaacaacaaaccttcagtatctccctgtttctgagggttaggaattcaggagtgacttagctgggtggttttgcctcagggtggttcatgaggttttggtcaagggttccgccaggaatggaagctccacctccaagaagattctctctcctgactactggtaggatgcctcagatcctcaccatgtgggcctttctatagggctgcttgaatggcctcaccacatgacaactctactatgcgtctagctttcctagaatgagttatctaaatgagggcaaggtggaagtcacagtatcttttatgacctagccttggaaatcaactacactcacttctgtcccatgttatttattaaaaagtcagtgaagtccagcccacactcaatgggaggggaattagaattagactccaggttttttttttttctttttttttttttgagacagagtctcactctgttgctcaggctgtagtggcacaatcttggctcactgcaacctctgcctcctgagctcaagcgatcctcccaccttagcctcctagaatagctgggactacaggtgtgtgtcactatgcctggctaattttttttttatatatatattttgtggagacaaggttttgtcacgttgcccaggctggtctggcattcctggactcaagtgatccacctgcctcggcttcccaagtgttgggattacaggcatgaaccaccatacccacccaactccagctttttttttttttggagacatagttccgctctgtcgctcaggctggagtgcagtggctcaatctcagctcagctctctgcaacctctgcttcccaggttcaagtgattctcctgcctcagcctcccaagtagctgggattacaggcacacaccaccatgcctggctaatttttgtatttttagtagagacagagtttcaccatgttggccaggctggtcacgaactcctgacctcagatgatccacctacctcggcctcccaaagtgctgggattacaggcatgagccactgtgaccggcctttttttcttctttcttttttttttttttttgagatagagtctcactctgttgcccaggctcgagtacagtggcacgctctcagctcactgcaacctccacctcccaggttcaagcgattctcctgcctcagcttcccaagtagctgggattacaggtgcatgacgagctaatttttgtatttttagtagagacgggtttcgccatgttggccaggctggtcttgaactcctgatctcagatgatccgcctgacttggcctcccaaagtgctgggattacaggtgtgagccaccgcgcctggctatgcttttgaggagccgattgtcaaaaaaaactgtgggcatgtttaaaagccatcataccaagaaatttctaatgactaaatcagtttctaggtagtttaatagaaggaagggattaggaacattgcaatcctagagagctatgtcccctggcagggtttaagtgtcgggctattgtgagtttgactgacttgaattagtcttccaaattctgattagctgtagttgaactgaattaagatcttgcccttcaaagctgaggaccaaaggacaccgctaactacttcttcattttattattattattattatttttttttttttcaagacggagtctcactccgtcacccaggctggagtgcattggcgcaatctcggctcactgcaacttctgctgcctgggttcaagcgattctcctgcctcagcctcccgagtagctgggacttgaggcgcctgccaccgcgcctggctaatttttgcagttttcagcagagacggggtttcaccatcttggctaggtggtcttgaacccctgacctcctgatccactcgcctcagtctcccaaagtgctgggattacaggtgtgagccaccgcacccggccctattttattatttttaaaatagagaaggggtctccctatgttgcccaggctggtctggaactcctggactcaagttttcctcccaccttgaccttccaaagttctgggattacaggggtgagccaccgcaccctggcctgctaatgtgtgagctagtgcagtctctgtccatatcctcgactccctctctgctagtgctaagtacattgtagggtcccgcgtttttagcatagctatacctatgaatgggccaaagaatctgagggcatcctacacatttcaaacggtgggaatggagacctctttcctccagcagaatctcccctcatgaccgggggactaccagatccagctctgctaagggcctccacggacggagtcggctacctctccactttcagtgaccgaaatccattctttgttcattcacccttgtgtctactccgggaaacgcgcagcggacacagtcgtgttccctaagtgtttgctgacttagtcatctggccctctctggagtagtcattttgtaccttgtactacattcgtgcctctacctctccgcagtgcgcgcgggggcggactcacgtgcgcagtctccctatgcgctgggagggcgtcagcaggtttacagaaacaatgaaagacttaacaattggcgcgcgacgagcgtcccttgactggcaggggcccagaggacctgaacatcactaagggtctgccccagcggcccggccctgaagtcaaggttgagacccccggcccagacagtccgcgaagctgagggaggccggcctggggcctgccgcgcaatgttaccgggatccgcaggcacagggcgatagtacggacgccgccgcccaggccgtgcccattgtgcgccgcggccagctcaccgcgatctcggtctaggaggcggcgggaccccgcacttcttccttgcaacggagcccctttggcctgcgggtcgagttccataggcgcccgacgggctccgcgcgcttacaggactacaactcccgtgatgccgcgcgcgccgaccgctgattggctgtgcagcggacggactcgcggggggggggggccgcacgccgtgcacgtgcgcacggcgacggccggatggctgcgtggggctgtgtggctgcgctcggcgcggcgcgtgggctttgctggcgggcggcgcgcgcggctgcggggctccagggccgccccgcccgcaggtgctatgctgtgggccccgctcaggtgaggacgtccgggttctggccgagccactcgccactcagggccggaggcggggcggggagccgcggggaaggaggggcggccgggctggtatcccagcctcctgggaactgcctggaccgtcgtcgcgcccgagtgcatcgcgttcttgctggagggcggatgcgccctgccttcctctgactcgctggcggcctcggaaacgctactcccgcgggagagcgctcgtgggacggcctgggccaggctgcttgtcagcccctgcgcttcccggcagtttccgcgtccctgttttccctgcgcgtcttctgatttccaccatgaggacgtttgggtcgtgattttcatctgcatgtggaggaaactgggccgcgcgccgggagccgcgcctgcgggtgctccgcccccaagtgcctgtgggtttggtgcgggccttgggttcagttcagctcgctgtgacctcgactgagcgctggaggctccgcgggcgggagcaggagggctggagccggcgcctgctgtgtgcccggcgcggtagtgatgtgtgagcctccccgcaacttctgagaaggtgtgaccttgtgtggtcaggaagccgaagcttgacgagttttcaagtacgttttctcaggtcctgcagctgggagacggcacaggacactaaaccaggttggtcagatccacggctctcacgctcccttgggccgttttgccttttctggaaaaaggaatcactttgtcttctaaacgcacaagtaatattttacattaacatacggatttcacagtaatccttgcattttttttttttagacggcatctctgtcaccaggttggagtgcagtggcgcaatctctgctcactgcaacctccgcctcccgggttcaagcgattcttctgtctcagcctcccgagtagctgggattacaggcacccgccaccacatccggctaatttttgtatttttagtagagacagggtttcaccatgttggccaggctggtctcgaacttttgacctcagatgatcctcacatcttggcctcccagagtggtgagattacaggcatgagccagtgcacccggccaaattacttgcatgaaaaaaacacatagtgcttactttgtgccaggcactattctaagtacttcacagttattcgtataatctttataacaactccgaggaaagtactattattagtcttcccattttatagatggagcagaggcacagagaggttaagcagcttacccaagggcacacagctggtaagtggcagaatctggaactcaggtagtctggtgccagagtctaagctcttaacagctgtattatttttatgatttttaaatatggagcagctaaggttcaaagcagctgagtgacttggccagtgtcacatagctagacgtgaccaaggtggaagtttgaaattagaatatgttgataaaaggacttacaaactgtcaggatataaatataaggaaatatcgcccttatttataactgttgtattggctctagcatctctgcagagtcccgaaatgtctccaagtgactcttccggtagagcagaaaaagaagaatgcaggatgacagagtttgagcacgagctttagaattgaatcctgtgcagtctgttagcggcttcacttaaggcaatttacatagctttccaagctcagtttccccatctatgtaatggatctattacttgtaatcccagctactcgggaggctgaggcaggagaagcccttgaacctgggagggaggttgcggtgagcggagatcgggccattgcactccagcccgggcaacagatcctgactcttatcaaaaaaaaaaaaaaagaaaattaaccttagtttaactttcttgctttaccaagtttttaatttttaaaattttttactcttttgtaatagcacttagtttaaaacacaacacattgtacagctgtactaaatatatcttcatttatatcattgttccatagcttttttcttttgtgtgtgtgtgtgtgtgtgtgtgtgtgtatgtgtgtgagacggtgtctagctctgttgcccgggctggagtgcagtggcgccatctcggtccactgcaacctctgcctcccaggttcaagtgattcgcctgcctcagcctcccaagtacgtgggattacaggcgcctgccaccacgcccagctaatttttgtatttttagtagagacggggtttcactgtgttggccaggctggtctcgaactcctgacctcatgatccgcctgccttggtttcccaaagtattgggattagaagcatgagccaccgtgcccagccagctttttttttttttttgagacggagtctcgctcgctctgttgcccaggctggagtggagtggcgtggtctcggctcactgcaagctctgcctcctgggttcacatcattctcctgcctcagcctccggagtaactgggagtataggtgcctgccaccacgcctggctaattttttggatttttagtagagatggggtttcactgtgttagccaagatggtctcgatctcctaacctcgtgatctgccctccttggccttgcaacatgctgggattacaggcagcttttttctattaaaaaaaattacaggtgtgcaccaccacgcccggctaattttttgtatctttggtagagatggggtttcaccatgttggccagactggtctcgaactcctgacctcatgatacgcccgccttggcctcccagagtgctgggattacaggcgtgagccacagtgccctaccttaaaaaaaatttttttttttaacttttgttaaaaatgaagacacaaacacctactagcccaggcctacataaggtcgggtcaggtaattgatatcactgtcttctgccttcacaccatgtcccattagaaggtctttagggggcagtcatatgcatggaactgtcatctgcgataacagtgctttcttctggatatcttctgaaggacctctctgaggctcttgaggtgtcactcttatcagaaatatgtccattgtggtttgcttggtttctttttttttgtcataggtttgcttgtaaacagataatgtaccataaacattcttctctagtaatgaaaaccttttggcgttggagttcatgtttcagactttttaaggaacttgaggtctgtaaaagctgctgaacccttcactgtgaattttcttggatgttcttttctttctgtggctaccttttctcttgcctcttcttcagctatgagttcctgttccattataatcttaagggaccattgtatatgcagtgtgtcattgactgaaacatcgttatggtgcgtgactgtattaccatcttgcattagtgtggtacatttgttataattgatgtacaccttcactttttatggtactgggtgcctggttctctgtgtacatcctgaaggttggggaggggttggagtgatgggtgagggagccttatggatattgctcaattttcctgaaaactttgctgttctaagtagcaggggctatggattcttatttttaagaaagcagatcttgggccgggcgcggtgggtcatgcctgtaatcccagcactttgggaggccgcgacgggcggatcacgaggtcaggagtttgagaccagcctggccaatatggtgaaaccccgtctctactaaaaatataaaaaataagccaggtgtgttggcgcgcgtctgtagtcccagctacttgggaggctgaggcaggagaatcacttgaacccaggaggcagaggttgtagtgagtcgagattgcaccactgcactccagcctgggtgacagtgagactccgtctcaaaaaaaaccaaccaaacaaaaaaaaaaaaaaaaggaaagcaaatcttgtgactgtttaggcaatgaccgttaaaactatgtatggtaaattttgcaaccattgtacaaatgagctgttttttaactatgtaagttttcaaaaattcaaaaatggggaataatatgaacccctgtgcccatctcccagattgagcaatgattaacatttttcaacacctgctttgcttatctccctcctcctttttttgtggctctaagattttaaagtaaatctctgatttcttgtcatttcaaacctaaattcttctgtgtgtacctctaagaaaaataaggacattctggctgggtgccatggctcacacctgtaatctgagcactttgggagttggaaggattacttgagcccaggagttccagaccagcctgggcaacatagggagaccctgtctctacaaaagaaaaaaaaaaaaaaattagccaggcatgtggtggcacatacttgtagtcccagctacttgggaagctgaagcaggaggatcctttgagctcaggaggttgaggttgcagtgagctgagatgacactagtgcacccagccttggtgacagagtgcgaccctgtcttgtctcaaccaaaaaaaaaaaaaaaagaaaataaggacattctgaacataaccacgatgccagtatcatacctaacaacattagtaattccttaatatcacttaaaatctaggccttttaaaaatttatttatttattttttgtttttatttatttattttttgagatggagtttccctcttgttgcccaggctggagtgcaacgatgtgatcttggcttactgcaaacaccatctcccgagttcaagcaattctgcctcagccttccgagtagctgggattacaggcatgtgccaccacgcccagctaattttgtatttttaatagagacagggtttctccgtgttggtcaggctggtctcgaactcccaacctcaggcgatctgcccacctcggcctgccaaagtgctgggattacaggcgtgagctactgtgcccagccaagtttcttaaagaaacactgtttcttaaaaaaattgttggctgggcgcggtggctcacgcctgtaatcccagcactttgggaggccgaggtgggcagattgcctgaggttgggagttggagaccagctttgagacaagactaacctggggaaaccgcatctctgccaaatacaaaaattaggtgggtttggtggtgcgcacctatagtcccagctacttgggaggctgaggtgggaggatcgcttgagcccaggtgatggaggttgcggtgagccaagatcacgccacaaaaaagtgttggaatcacccagtccttaagggacttactttctaagagccactcttttccttcagaaagggatagggtggtcgggaagtatctatttctccctaaccatttatcctttgggtcattcagcatccagtcagcctttgtcaatcacctgtgagtctaagcactgtgtcaggtatgggggtaaagggcaaatcacatcccctcctccctttaagcccaggtagtgattctccttgagaagaataagaaaatgaaatccgaaaagtgctatggttacttttcccaggaaaaatgcttgtagtgtttaaaggggatttatggccatcctgaaatctatctgtgggcctaggttaggacccccattctagtgagatttcttggggaatagggaggggctccagggatccttgagggtacatgagtgtattgaggagagagaagaaatggaactcacagctgggagctggcaggaggtgggggaagcagtcctggggtcccctgttttctctgaggtgctgccgagttgccagctgaatttgagactgaatcctgaatccagcacttgtgaactgggtgacccttgctgagttctttttgaggttgatgccttatttgtccagtcaggtaatttagtgcctgtatattgaacaccttgtataaaccggcacattttgccaggcaaggccatttggagatgctgacacttcctcaaagggctgccaaaaagaatacataaaaatgcctttgttacatgtctggctgagtgcttgggacagtgacaggtctgggtgcaacagcataagcctgtgaagccaagggttagaggcaccatttgtccaggcatttcctgtgtggcgtgtggggcttggtcagttttctcttggcagctgttttttggtgttcaggtgtgatatcttgttggctcgagttgcttcctcctgtttttccagggtccctgccctcctcctgcttggctctgtagctgtcattgtccaagcttggagggctcatgtacaagctaacatggaggaggagctggaagattgcctctcccgggggtcttgcctgttcagtggaaagaagatgggatcattacagccactccagtccctgttttactggacccgagacatacctcagcttcctggaccccacacgctcttggttttcctccttgcactgtcttttgctggcaggtcttgtgtggtccattattaagtagtattgttcttcctggttctctgagaggcgagaccttccaaaattttcatctccaggacctgtccagtgctgatgtctccacttgcctgtctcccaggtccaaagtgggacttaaccttgtatcctccaatgacctctcgctgcccgctcctactgtgccctttggttcagtgactcatacccgcatccaccctcccgggttcccagaccaaaataaaaaagcatgggagtccgtgtggctccctcttccctccacccctgtatctggatggttaccaagtcatgactgttctgtctctgataatgccccctgatctccattcttaccaccactctcccaggtaaatgctccatcttctctgtcttgggttgcatttggtcccacctggtctttcagttaactcccttcagtccacccaatgcagtcttttctctgcagccaaatttttttctatagttcaggtctgatgataccactttccattttcaaactccttaaattggcctcggagacctgtgatggccaatcttccccacccctgtgggtcaggttcctctggtgtgggcctatctcttagtgcaaggctccctgtagactgtcctggggctgcctgtctaattgtcttctcattgaaccaggtaggcaggcaggaaccactcatctagtctgggggtgactggggggtgcaaagagttttgttacaggatgtatttaacactttcattgtctggctcaaaattctctttgaagaaactgcctttgtttaattctgtttatttatttagaacttacctagaattgatttgcacttgcaaaaatgctgctgttttagagtttgctttctaggctggttgcttgctctgtcaccttagctaaaaagtaggtactggagcgccttttctcttctcttctcttctttctttcttcttctttttttttttttttttttttttttagtagagtctagctttgtcgcccaggcttaagtgcagtggcacgatcccggctcactgcatcctctgcctcccaggttcaagtgattctcctgcctcagcctcccgagtagctgggatgacaggcgcccaccaccacacccagctaatttttgtatttttagtagaggcgaggtttcaccatgttggccaggctggtcttgaactcctgacctcaagtgatccaccctcttgagcctcccaaagtgctgggattacaggcgtgagccaccacacctggcctgtagcgccatttctgtttctggttgctctataaagggagctctgtgcgtagagtaggtgtgtcagtaagaatgacttgacctagttggcaccaacaaagaaaaatagcaaacaagttaggttaggtttttttgatgattgaagaacatcttgtatgttaacaggcagtttataaaatgagaaatggaatgatttttaaaaacagcattcagctttataaatccaggaaatgcagatagaaaagagataatttttttacctttaaattataaaaaagtttgataattaacagttgtgaaaatcaatattgtaagggtaaagtacgttgccagtggacatgtttttgaacagcagtttgtcagttggtgtttatgtaattacatttgctctctctgatttattactcctatttttaagaatctagctcaaggaaatacccataatatgggaaaaaaatcagtattcctgaagaggttccttgtagcattatttttcatagcaaaattgtggaaaaacctaactgtccaaaatatagagaacaatattagtgaattattcactcagaatagtatgtagccagaaatgatgtttaggaaatagagctatgcataattaatatggaatgatagggcagggtgcagtggctcaagcctgtaatcctagcactttgagaggccaaggtgggtgaatcacctaaggtcaggagttcaagaccagcctggtcaacatggcataacctcgtctccactaaaaatacaaatattaggtgggcatggtggggtgcacctgtaatcccagctattcgggagagtgaggcagaagaatcacttgaacgtgggaggcagaggttgcggtgagctgagataacgctgctgcactccagtctcggcgacagagcaagactctgtctcaaaaaaaaaaaaaagacagccaagagataccaactaaaaaagtaagatggaaaacaaagtcaacatgattctatgtgtgtgttaacattagaaaggtgtgtatactatagatttataaaagccttctggaaattatgcaggacaggaataggactaagtaagttggagacaagaaacttttgaaacatttttatattgtctgtagtgattgaggttattttgtttttaactttttgctataataaaatcttaaaagatggttataaagactattgtaatccataaaaatatttatgatatgtcaagcaaaaaagaacgagatgatgtaaaatggcatatagttcatttgtagctacaagacaaatatgagaatagagaaaaaaggggaactattaattggttgttttaaagtgttgggattaggctggactcggtggctcacgcctaataatcctagcattaaatttaggaagctgaggcgagaggatcccttgagcccagtgggtcaaggctgcagtgagccgtgatcatgccactgtactccagtctgggcaacgggaagactctgtaaaagcgaatgattaaaaataagtgttgggattatattttctttggatttctctattttctatttaaagattgccctatcagaatcccatcttcatttttttgttctttctgacataggttttcaagggacatgagtgacccgaggatggtgttgagcctctctttgtaagggttgtttctttgttactcacgtactggtaattatcttaccatctctgcagagcccacccacctttgggttcctgttggacatcgatggagtgcttgtgcggggccacagagtgatccctgctgctctgaaagccttccgaaggctggtgaactcccaggggcagctgcgggtgcccgtggtttttgttacaaatgctgggaacatcttacaacacagcaaagcccaggagctgtcagccctgctggggtgcgaggtgagaaggcagccagaggcatggaagcccaaggacctggttcctaatggagccgctgccccagctccaagtccctttcccctgggttgggatatggaatcacctagtcctaggtcatggccacagctgaacacagaaatcctgcctgtgtatttggcagttgtagattatgtccttgtatctgtttcttttcttctgggcattgggggtgtgagtccctggaaagcaaaggtcacacacatgtctagaacttgcatagcaggaatagcaggtgtggctctggcgtcacaccttggctttcctgggtatgatgtgtgcacctgaaggagtgctgtcctcctcagccacctgcagccctgcaccatatcccaactttgatgcattcttgtttgttgagggtgaattcagcttttggaaagagtcctttggaaccaggagagtaaataaaatagctgattgattagatgatgctgctcaaagttgcatgtaaaatgtgacggaatcaaattggttccttgctgtgatttccagagagaattccaaaaaccttccaagtaaaggctgcattgttagggttagtataaatgttaagcagctaactcttagcaggaatgaaaatagaaagtaaaagaccagtttctgcgacagtgacagggagcacacatgaaccctatggcttccaagtgggggcttgggaaatccaaactgaacctgacggggtagcggtggcaagtggtcagaacccacatctgtggcatttctggtctcttgtgtggcaagaactaaatgagacaggttcttctcagatctgtttgggtgcctttcagaagtgctgctgggtgctagaaagggctttcctccccgttctttttctgagcgggttttttccttccctaggctaaaggacctgccacctgtctcattatttccctcaacagttctgtcttcctctgccctcccctgtcttggctgtccctacaggtggatgcagaccaagttatcctctctcacagccccatgaagctcttctccgagtaccatgagaagcggatgctggtgtctggacaggggcccgtgatggaaaatgcccaggggtatccttttggtcttaactctggctgaagggaaggggcagggctgaggtgtttcctcccttagctgagtggggactgtagtgaggagtgctgggtgctggggtacacaggcgatgttgtgggctcaggggagggaggacagctcccgactgtggtcagtcctcatgtctggtggtttccaaaagccagttctcatacccctgcatcagaatcctctggggagcttaaaatacagatcccagggtatctgcgctggagccttaattcactaggtctcgggtaaaactcaggaatctgtattttttaaaaaacaaaacacctctcttagtggttctgtaactgggtttgggaacccctgctctagcctcttccttggggtgcccagtcagtttattagccagtggtagtgaagcagctaccgggagcctgtctctgggagcctgcggaataatacctggcccgttttaagcaactgttgtgctgagcacgtcctgtgtaccagcggtctgccgcacactctgaatgggacgaggaccaggatgagggcgtaggacttatgaatcaatcaagggcttgtgctggaggcaagaataacaccatgagcagtaaaggagcgtgtgcgatggcgtgtgatcgaaggccggtaagctcacaggagggcgtcacaggtgtggggcgtgtgtgatggcgtgtgatcgaaggccggtaagctcacaggagggcgccacaggtgtggagcgtgtgcgatggcatgtgatcgaaggcctgtgagctcacaggagtgtgccacaggtgtggggcgtgtgcgatggcgtgtgattgaaggccggtaagctcacaggagggcgccacaggtgtggggcgtgtgcgatggcgtgtgatcgaaggccggtaagctcacaggagtgtgccacaggtgtggggcgtgtgcgatggcgtgtgatcgaaggccggtaagctcacaggagtgtgccacaggtgtggagcgtgtgcgatggcatgtgaaggccggtaagctcacaggagggcgtcgcaggtgtggggcgtgtgcgatggcatgtgatcgaaggccggtaagctcacaggagtgcgccacaggtgtggggcgtgtgcgatggcgtgtgatcgaaggcctgtaagctcacaggagtgcgtcacaggtgtggggcgtgtgcgatggcgtgtgatcgaaggccggtaagctcacaggagggcgtcacaggtgtggggcgtgtgcgatggcgtgtgatcgaaggccggtaagctcacaggagggcgtcacaggtgtggggcgtgtgcgatggcgtgtgatcgaaggccggtaagctcacaggagggcgtcacaggtgtggggcgtgtgcgatgacgtgtgatcgaaggccggtaagctcacaggagggcgtcacaggtgtggggcgtgtgcgatggcgtgtgatcgaatgccggtaagctcacaggagggcgtcacaggtgtggggcgtgtgcgatggcgtgtgatcgaaggccggtaagctcacaggagggcgtcacaggtgtggggcgtgtgcgatggcgtgtgatcgaaggccggtaagctcacaggagggcgtcacaggtgtggggcgtgtgcgatggcgtgtgatcgaaggccggtaagctcacaggagggcgtcacaggtgtggggcgtgtgcgatgacgtgtgattgaaggccggtaagctcacaggagggcgtcacaggtgtggggcgtgtgcgatgatgtgtgattgaaggccggtaagctcacaggagggcgtcacaggtgtggggcgtgtgcgatgacgtgtgatcgaaggcctgtaagctcacaggagtgtgccacaggtgtggagcgtgtgcgatggcgtgtgatcgaaggccggtaagctcacaggagggcgtcacaggtgtggggcgtgtgcgatgacgtgtgattgaaggccggtaagctcacaggagggcgccacaggtgtggagcgtgtgcgatggcgtgtgatcgaaggcctgtaagctcacaggagtgtgccacaggtgtggagcgtgtgcgatggcgtgtgatcgaaggccggtaagctcacaggagggcgtcacaggtgtggagcgtgtgcgatggcatgtgattgaaggccggtaagctcacaggagggcgccacaggtgtggaggggagggcttggagtatccctggggcaggagttgcctgtggcttcttggaggggtacagcggagccccaggagatggctaagctcctaagcaggggaagtaggaggttgggaatgggatagggagaggaaggaaagaacaggaagggtggtgccaggttgtcgggaaccttggaagtaaacttgaggagtctgaccgacttctcagggcagtggaaagcagggcacgctttattgctgatggggcaatctgatagaatcaggattttggggaaattcattttgagagtaatcaaaccatgtccagttaagattgcaagttggaattgaggataggaaaatggaggcagatcttagaggagataggctgaagctggcttgcccctccccaaggccgcctcttccttgatgatttgggttcatcctttaagattttagctccagccctacttctccatgactcctctggactccccagcccactgaggagtctcttctgaactcagcactgactagcagcactgttctcagagaacactggttttgatgggctctgaatgtgctagctccttggggacagagttttttgtttttttttgagacagggtcacactctgttgcccaagttggagtgcagtggtgcaatcatagctcactgtagccttgacctcctgggctcaaatgatcctcctgccccagcctcctgagtagacgacaggtgtgcaccaccatgcctagctgactttatttgtagagacaaggtctcactatgttgcccatgctggctggaactcctgggctcaagccatcctcctgcctcagcctcccaaagtgctgggatttcaggcatgagccactgcacccagctggggacagagattcttatgtgcctttgccccctaggctgtgcccagcataggacctggtagctggcatgtgcctggtgactgctggtgggttacccaggagctgccctctctactctacctgtgcagttacagcctgcctgccagcacctgcaggatttgtgccatccttgctgggctctgcttggtgccctcctgcctggcttgatcaggagtgggttgtgttcccttcacttgtgatttgatgcattcagaaaggcatcttccccaagaactgtccagcattacttcctgagcttgctccagactgggcttccgaaatgtcgtcaccgtggatgagctgcggatggcctttcctctgcttgacatggtggacctggagcggcggctaaagaccacggtaataaggagcatgggttgggctgtgtcttcatccttcactcctccagtgccctgcattggctgtgtcgctgaccttgcaagccctcctgcagagctgtgatttgtccatgcttctttggaggcacatctggctaagggttttgttccctgaatttatgagaatggcccagaggctggctgcggtggcttacacctgtaatcccaacgctttgggaggctgaaacaggaggactgtttgagcccaggagttcaagaccagcctgggcaacatagtgagaccccgtctctacaaaaaaatttaaaaaattgtccaggcatggtgggtcacacctgtaattccagcactttgggaggccaaggcgggtggatcacctgaggtcaggagttccagaccagcctggccaacatggtgaaaccccgtctctactaaaaatacaaaaattagctgggcacagtgatggatgcctataatcccagctactcgggaggcagaggcaggagaataacttgaacctgggaggcagaggttgcagtgagctgacatcacaccattgcactccagcctgggcaacagagcgagactccgtctcaaaaaaaaaaaaaaaaaagccacatatggtggcgcatgcctatagtcccagctactcaggaggctgaggcaggagggttgcttgagcccaggcgttggaggctgcagtgagctgtgatcactgcactccagtcttggcggctgagtgagaccctgtctcaaaaaaaaaaaaggaaaaagcccagagaagcgaacggctttatgccctgtcctctctgtattgcttataattagctgggaacccgtttcagagccacagcatcccgtccaacaaggagttccagacttactggctggccttcccagtgctgcccaggagagctggccattgtgaagttagcaatcctgaggcccggcactgagctgccctcgggagaggtagcttgcttgcagaggaagcactggtcagtctgcacatctgcccaggtgccctgtgcgctgggctcatttttgagcactgactttgtcccctaactcatctgatcccttggtgatcctctgcagcatgactgccatctcttgaggtgcccgttggctcactttctcctcatcgcaccgtctgtgtatcacatagcccaggtcttgagtcagaccattctcacagtttgacgacatgcagttataaacagataacttactttttatttgctgatatagcttaagtccttcctcctccagcgctttctgatggaacagagcacttcctcccctgtgagggctttctccctgacctgtgcaagttctgtggagaaccagaatgtcagagttggaacagatctcggaatagctcagagacagccccacacaggggagtgacctgtcccgggtcacatagttgtttagtggcagagccaagactaccatggcctggggatggagtggaccctcgaggctggtcgagtgaagctgcctgctcaagaaccgacatgaggagaaatggcccatcaggcgtgatgccgccttcgtctccacggcctcaccttagctgcctgattttagactcttgcttggctatatcttgtgtcctctcccaccagagaaagacagctgaccacccttcctcctggtgacttcacccatggtgtcctgcctgttctgtggccccacctggccattgtcttttcgcctttcttgcatctttctcagtcctctccagctttcccttggcttgggcttgaccacgggtgtggggtctgtggagtgtgtctcccctcccctcccagcaccctggaggtggggttgtggttctcctggagtggaaggcgacttgtgttgatagcctctcctttgtctctctgcagcccctcccgaggaatgacttcccccgcattgaaggtaagagaggtcctctttgatgagttgtgaggtcttttctccgtctcctctctggccctcaggctgtctcagtgtgactgcctgcagcctggttcagcagcaaggggccttggagtcaggacacctgggctctggtctggatctgccacttaccacctctgagactgttgttagtctttccttccccatgccactcactattccaggaaaaccgtaagcttagagaattttagtggtggaaagacacctagaggtgatctagtctagtgtttctcaacttttaaacccagttctcccctttttataccaagaacattggaatatcccctttattatcctgaagtgaaattcttaggtaatataacttctgtacacacatattaaaaattagttcagtataaagccctaactgtaatagggggatataaaaggaaacatttttagtaagaagataatgtatttcagtatgtagtagttatccaagaagtaaaatggttgcactaaacagaatcaccatgaatgttaacagctacaaatgcaggctgatgtgtgtttataggtgtgacaggcgtgttttaccggtgactcagaaattaggggcagcattgccgttggtcaagtgattttccaaaataggtaacagttcttggtagagttttgaaaaggcaaagtacagtcttctcttgacttacacgatagttgtatttttggaaaaattgatgtttattgaagctgtacaaaaatgctttgtgattgtatgtaaaatagaatcgttcaagtaattctgaaaaggttgttcacctgtgtggataccaggatatcaggtgggacattcaaatgttatgaggacatgggaaagttttttctttttcttcttgttgttttgtagagacgggctctcactatgttgcccaggctggtctcaaactcctgagctcaagcaatcctaccaccttggcctcccaaagtgctggaattacagacacaagccaccgcacgcagccatgggatggtttttttaaaaattaattttagtgtgggatagtttttgattgcacaggattgtcctgagtatgtagcgtccctggccccctcccacaaccttcacttgctaggttctagtcattgtgacaactaaaattgcctctgatttgtaaagcacctcagcaggggcggtgctgccccatggagaatcactggtctggtgcagttcaccggccctgtaccttagtgtcagcagtgttctttgcctagtgcttactgtgtgtctagtcctgggctgtttaccgatgatgtagctcatttttatcctcacaatagctaagtgctgttgctgttatgtagttgcagttgaggaaactgaggcttagagaagagaagttacttggccacagtcatacaggagaatcggtggagtccaggttgggtttcaagtctctatcactccacaccccctgtcctggctgttaggttctgccagtccctggggctcagagagaagcgactgagggaacaggagcccttgctaagtcatgtgagggagaatgtggtggcagagtcccagccagcaaggagaagtagccctgagacatgctgcttttgttttgtaacctcttctgtgaagcactggtggactgaagtcagaatgggagccctcaggaatctccttcctgggccctgggccttgtgcacccagggtggatgggtaaggggctctactgggcttgttggggagctgtgcccctgcccagctgggtgcaccatgggtggagggcttgtggatgggtagccctagctggcatcctgagggcctgccgcctgccatctgccctgcagccctcacctgcgcctctgttctttaaaggggtgctcctcctaggggagccggtccgctgggagaccagcctgcagctgatcatggatgtcctcctcagcaatgggagccctggggctggcctggcaacacccccctacccccacctccccgtcctagccagcaacatggatctcctgtggatggctgaagccaagatgcccaggtgaggacacaaagctcccagccttggcctggtggtctattcctggctgctgcctgggcagtcctgcaggcagttcccatccgtcctgacaccccaggtgccgggacctcacttaggtaggccctgttgttgctgcagtaacctggcctttggaagggctttcaaggaccactccacatattagttactaaacctaaactacagattatggagtctgaggatgtattgagaggatgtttcacacgtgacccctgccccctgtaatctttacagaacatgctcttggtgtctggtggatcccaaaccgtgggcactttttgtaccgtatctgtgcacattattcagttgctcttccttccttggctccatcctgtagcattggttctttgactttctggtttccttttacccttcagacataaggcaggaggaagcaaggatttgtcgttttttgtttgttttgttttttttgcggggacagtgtctcactctctcatccaggctggagtgcagtggtgcagtcatagctcactgcagccttgaactcctggcctcaagtgacccccgtgcctcagcctccaaaagtgccgggattacaggcgtgctccatcatgccggccaaggattgttctgatagtcgtatagaccagagaactgagacccagcagataagtggctttctcaggggcatgcaggtgcctatactccctgctcagctgtgttggtgtcatgtgtcctgtcttattctggggctagcacagatagaggcagcccttttttggcctcagggtgcttacttgaaggccagctgacagctgctgtgtactgttcggttgctgttatctgcatggccagtctcttgagtctcagcctgctgttgacccccagtcgacagtgctcgtcagcagagggtgggcacggcccagtactgcctcagggcccgtctcagtagtcccagagagacggggtatggtatgctcttgtcacttttaaagtgtatgtctgtggctcgaggcttggcattgtctctgaagtattattcctagaggcgggtatgctgacactagatcagtgggcttggttggttatgtctctgtgaactgaaaagcaaggggcagatttcaatttacaaaccagattttagatgaacttttctaattaaaagtagaattatttacataaatgacactgaaagatgtggtggctcatgcttgtaatcccaacacttcgggaggccgaggtgggtggatcacctgaggtcagttcaagatcagcctggccaacatggcaaaaccccgtctctactaaaaatataaaaattagccgggcatggtggcaggtgcctgtaatcccagctactcggaggctgaggcaggagaatcacttgaacccagggggtggaggttgcagtgagctgagattgtacccaagcgccagccatcatatcagcattccaggtgtcaagaaggagttggggagggcagagagggcagagaagaataccgtccccagtttgtttgttttttttttttagatggagtcttgctcttttgcccaggctggaatgcagtggtgcaatcttggcccgctgcaacctccgcctcccgggttcaagtgattctcctgcctcagccccccaagtagctgggactacaggcatgtgccaccacacccagctaatttttgcatttttggtagagacaggctttcaccatgttggccagactggtcttgaactcctgacctcaggtgatccacctgccttggcctcccaaagtgctaagattacaggcatgagccactgcgcctggccgcctgtccccaattttaaggatgcttattgaaaatttagcccagcatttctgctttccttgactgtagcttagtcacatggccacgcctcgctggcagggaggcaagcgaaggtctttttcacacctagtggcaatatggtcagctgaaaatggacaccagcaaagaaggggagaagcgcaaccgtagtctgcctcagctctacagcaggatttaagctctggagtcagactgagttgtaatcctagctctgccctcttgaacaagttacttaatcttgctgtgccttggtttcctcgttttacaaatagcgtcatctcatagagtttttctgagagggaaatgtgaaatgctgcctccagtgcctgcacagtgtctgctacatgtcagctcttaccctggggaaaaggctggtctgtgtgtttgctgcttagacagtggcagtcgtgttctctagaagagcctggagatcaggaagactgaactgctgcgtgctcgtttctggcaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtggggtaggctctgctctccctcctttgtcccttttatgacatccccttctctccctcctcctctactctcacccccatttccctatatctaattcactcttctgccccgaaactcttctctgctccctttgctttgcaacattgatttagggttttttctcctttttccttttccggtgtggctgcccctgccagtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggaggggagcctccattccacgggcaccgagacttatgcttcagtccagggctcatggaggcctcccacgtggtgaatgacgtgaatgaggctgtgcagctggtcttccgcaaggagggctgggctttggagtgagggcagtgcggtggaggtgagggggtgagcctggacctgtgggcgagtcccattggctgggctctggcctgatcactgggctcaggtcagggcttggttcccttgccacccttcttgctgccccatgagtgtggcattactggtcacttggaagaagacagtgactctttttccctgctgggtagcattttgtatggaacggttggaattttctgggcccagttcccacgtgcctttcgtggcagtctaacctcaggccattctcttcccctgtgtgcctcagtgtccttctcatttcagtagggacttctgaaatgggggaggcagtgtggaatactgtggatgtctgtgcagagcctttgccggcactgaaggcatgcagcctgtcggcagagtgtcttaacaccagatgctactttttactgtattgtagtttattgcccggagatgtggggctttttttttaaataaaataatcataataaatgttcatgatgctgactcttgtga

SEQ ID NO: 38409 - DNA, 8229 bp, Homo sapiens
atctaatgaggagcgaggtgcggtgccccgaagcgctcgcttcccgcggtgcgatctagtcctgcagtaggcggcccggggccacaccgcggccgcccaagccagtgcaaggcccaggggcctgacatcgctcccagcgctcgaggaccgaggcctgctgtggaggacaccgtgctccctcgggacctgctctggattccggcccggacgtccccttggagctctgcatctccaacctggaacccaacccagaagtctcaagtttgacgcatcacgtggcgtgcggatccactgagggtccacagagaggggcgcccatctcctgcgtctcagttatcctggtaattgtgtatctgcccattgttcgttgcctcattaacttggctttctaggtgcacccaccttgccaccagagaagtccaaatcctgacttctctccaaggtgttgggaattctgtgccctaaagaattccgactcagatccgaacggggatctggtggaatcgagggtgaaagaccagagggacaatgttctactatcccaacgtgcttcagcgccacaccggctgctttgccaccatctggtaagggcggggcccgttggcgcgcgatggcggacgctgcccgggatcccagcctgacagctccccctccatccccattctcccaccttccccacccacttcaggctggcggcgactcgcggcagccggttggtgaagcgcgaatacctgagggtgaatgtggtgaaaacctggtaaggcccagaaaagggaaggagggcctggtgcggggggtgagttaggggatggggtggccaagactgtgggcccactcctggacgcagcggtaatcagggcgcattgttccccagcgaggaaatcctcaattacgtgctggtacgagtgcaacccccgcagcccggcctgccgcggccccgcttctccctctatctctcagcccaacttcagatcggtgtgatccgcgtctattctcaacaatgccagtacctcgtgggtaaggctgggaaccctcaaaggtggggcgggctgagcagctgtctgctaagctggctgtctacctcgtcctccctgcccacagaggacatccagcacatcttggagcgcctccaccgtgcccagctgcagatccgaatagatatggagactgagctgtgagtgtgccctgggcctttgatggaacacctgctagcttggcctcagcctggctcagcctcagtccttcacggcctacattctctcccagacccagcctgctgcttcctaaccacctggccatgatggagaccctagaagatgctccagatcccttttttgggatgatgtctgtggatcccagacttcctagtcctttcgatatccctcaggtagggctcattccccaagactcgtgaattggcaatgcagaaggggagtgctgtccctgtgtcactctgacattggggttggggaaggaagcttaccacagctctctcccacaggagatggtgcagggggactgccaaggtggacccatccaggcgaagccccctgtacttacctactcagggccaatctgatcagacggtttccccactggaggcagctcttgtccccacttgtctccacactgttttcactgccaaggccctaatccaggctctcatctctctgcactgggctttcttacccctgtcctcctccatctattcccaatactcctacagcttaatgtcacccccttccttggttccccatttgaacagtggctcctgctgcaaacagattactagcatttggggctctccatgccccatttatttctttttttattttattactattattattattatttttgagacaggatcttgctctgtggcccaggctggagtgcagtggcacgatctcagcttactgcaacctctgcctccccggttcaagcaattctcctgcctcagcctcccgagtagctgggactacaggcatttgccaccatgcccaactgattttgtatttttagttgagacagggtttcaccatgctggccaggctggtttcgaacccctgacctcatgatctgcctgtctcctcctcctgaagtgctgggattacagacatgagccacagagcccggcccaatttttttagggtttcgccttatcggccaggctggtctcgaactccagacctcaggtgatccacccaccctggctttccaaagtgctaggattacagacgtgagccatcgcgctggcctattattattattttttgaaatggagtctctgtcacccaggctggagtgcagtggcatgatcttggctcacttcaacctccgcttcctctggtcaagcgattctcctgcctcggcctcccgaatagctgggattacagatgcctgccaccatgcccggctaatttttgtatctttagtagagatggagtttcatcatgttggtcagactggtcttgaactcctgatctcaggcactccacccgcctcggcctcccaaagtgctgggattacaggtgtgaaccaccgtgcctggcacataccccagtttagaactagtcatccccagacttctctctcagtcctctgggcatctgtggctcctaaacactagtttggcccttatgcctcaatgatgccacattcacatctttgcttgtactgtttccctagcccataatggtcacccctcatcctctacaagtcgggttctacatattcttacagacctggctcaaatgctgcccttctctatgaaatatttatcccagtcttagccggaaccaaatgcagtttgggaactcagtactttgctagggccttgttttaccctttgccttgactcttgtggggttacatacaaccttgtctccccactagacttccttaagatcaagaatcttttctgttcacctctgtcaaccacaacacttgccaaggataacgatgcactgctgcttgcacaaattttttttttttttttttgagacagagtcttgctctgtcacccaggctggagtgcagtggctcaatctcagctcactgcaatctctgcttcccaggttcaagcaattctcctgtctccgcctctcaagtagctggaattacaggcactgctaccaagcccggctaatttttgtatttttagtagaaatcaggtttcacgatgttggccaggctggtctggaactcctgacatcaagtgatccacccacctcagcctcccaaagtgctgggattacagacatgagccaccgagcccggccttcttgcacaaattgatgagggctagataactggggtgcgggttggggagggaggtgagaacaggaactgaggaaagaagaccagagggcgggtgagtttactgcaagctgatgtcaatgcaacaagaattaggcataaaaggagattaccgtgcattgttgaagaaggctgtgaaaagtgggaaagcagggggctgaagctgaaccctatcttttgtttccaatccctctccaaagattcgacacctcttagaggctgcaatcccagagagagttgaagagatccctcctgaagttcctacagagcccagggagccaggtcagcagagagaaccttctttctggtgagaggcataggcaggcccaagagctgtagaaatgaccatttttgagcttaagagccaggccttgtgaggggcgctttttttttttttcgaggcagagtctcactctgttgcccaggctacagtgcagtggcacgatctcggctcactgcaagcaattgtcccgcctcagcctccctagtagctgggattacagatgtgcactaccatgcccggcgaatttttgtatttttagtagagatggggtttcaccatgttggccaggctggtctcaaactcctgacctcaggtgatccacccgcctcggcctcccaaagtgctaggattacaggtgtgagccaccgtgcctggtgaggggcattttatgtgtataacctcatcagtacctcacaagagtcctctgaggtcagatttcttatccttttttttttttgagagatggggtatcactctctagcccaggctggagtacagtggtgcactttaggctcactgcaacctccgcctcccggattcaagcaattctccttcctagtagctgggattacaggcatgcaccaccacgcccagctaattttcgtatttttagtagagatgggtttttgccatgttggccaggctggtctcaaacttctgacctcagttgatccacccacctcagcctcccaaagtgctgggattacaggcgtgagccaccatactcggctttttttttttttttttctttttttcccaggctggagtgcagtggtatgatgatcataggtcactgcagccttgacctccagggctcaagcaatcctcccacctcagcctccagagtagctgggaccacaaggataagccaccacacctggctagtttttaaattttttgtagagacagggtctcgctatgttgcccaggctggcctcaaactcctgggctcaagcgatccaaagtgttgggattacaggtgtgagccacttcgcccagcctccccactttaccgatgaggaaagtgaggctcacagtggttaagcagtgtacccagggtcaggatgccagagattagcctgggtctgattagaatccaggttaccttgacttcagagtccatgcttttccttaactgcatggctgtgggaatttggaaagaagcagagaggctagtgactctcttgtccctccagagaggattccggtcactgtgctgccacctgaggccatcacgatcctggaggcagagcccatacggatgctggagattgaggtgagttcccctgcacacagggcctgaggtccagcccccttgcatgtacttctctctgtccccagagtcctgccttttctgtctccatttccctattctctgtccctggcacttgagcacccagtggcttccttgaacctggccctgtggcatgcctctgggatccactctcctggatccacttgcctttttcagaaatattattgaatcccctccccttgctcttcctctctggacagggtgaacgggagctcccagaggtcagccgccgagaactggacctgctgatcgcagaggaagaagctatcttgttagaaagtaggtgtctccggcagcgtagggcccgcctggagctggatagtcagacccctggcgtgggcattctgggactgggcaatgctcccatttctctttttctgtcctctgaactctgattctctctccacagtcccgcggctcccacctccagctcctgcagagtaagggcaagaactcctagaccaggtagggtgtcagtgctgggaagggtctcctcatttctcttgcccatttcccctcagggtggaaggaataggagaggcactgggtcctgaggagctgaggctgacaggctgggaacctggggccctactcatgggtgagtgcccaccatgccccaggggcttttctgggagtacctggatactgctgcagacaagggctttatatcccaacttgctaaagggaggaccctgcagtttcttgccctggcatctgcaaggggtaaggggcttatgggacagagccccttgggtgttgttgcagaggtgacccccccggaggagctgcgtctgccagccccacccagcccagaggtgagtagcctcccttctaatcctcctcctcctcctctttgccctcccccacaaggactgcctccccaagcccagggccactgctagcttacaggggtccttaatgcagatgataaaagatgcccctttctacgccccatcgtatctggcctacgcttcccagatgggtacccttatgcaaggtatgagctgctcaagtgcatggagaccccgcacaagccctctccaggttcctctaggggcgggtgtggggtcctgttagcagtccaccagaatgacaggaaaaggagtaatgggcagccttgcccctacctgccctccccactcaacagaggaggcccccagtccccccacctcctcgccgccgccgtcgtcgccggttactgttctgggacaaggagactcagatctccccggagaaattccaggaacaactgcaaaccagagcccactgctgggaatgtgtgagtgcagcccaggctttgccggggaagggagggaggcagggatgaccaggggcacatgcaggctgagccttccaaactcctcaggtgggtggggggaggattgggaacttgatgaaaaatctcctccattctccagaaaatgcaggcgatgtgggtttgcacatatacaactcttcatgctcctttagtgacccacctgtcatacccatgggcaccaggttaaaaagtccttcttttagcaatgagcagggcaggcagggtcatgagcgcaaaagctggggaagtccagaagccccagaacagtgcattgcaaagaggcaaaggggccctgaggagtggctgctttataatggggcttctgaccttcccccactacacagcctatggtgcagccgcccgagaggaccatcagaggccctgcggagttgttcagaaccccaactctctgtaagaatggtgggggttgggcacgaagtatcctcaaaaccaattcctcattcctggtgctcctcacgcctcaaaccccgtgcctactaccctcttgtccacagctggctggctaccccctgaactactgggtctctggacccattgtgcccagccacccccaaaagccctcaggcgagagctgcctgaggaggcagccgctgaggaggaaaggagaaagattgaagttccaagtgagattgaggtaactgcaccacctgtttactgcatcgccccagtgccagggtctgcctgaccagctggctgccctctcctgctatgagagccaacagcacaggctcactggccttgtgccttctgaggcccaagtcccagatgcttggggtcttagttctacttctcccatccccaggtcccgagggaggccctggagcccagtgttccccttatggtgtctttaggtaagcacctagagaagaggcgcagtgggaccacaccctaaccactgtcccaggaaactagtatcccaactgctgaagctgttttatgagtgaaggcgtgtgtgtgtgacataaggaagcacggactggtcctcctcagctctcccacctatgtgcttttaacaagtcaccgcacggctctgccatctacttacaccaggtggccacaaggccctaactgccacccaagcagacacccactagcgcctttcctcccccaacagagatctccctagaggcagctgaagaggagaagtcccgcatcagcctcatcccaccagaagaacggtggtaagcggccaggctccgtgggagccagggcccacagcccttggccaggtggtggaaacagctgctgggatgggtatgccccttgtcactgtcacagctgccaccttccctactctctcatgtcctcctagggcctggcctgaggtggaggcgccagaagctcctgcattgcccgtggtgcctgaactccctgaggtgcccatggagatgcctttggtgctgcccccagagctcgagctgctctcactggaagcagtgcacaggtaccagggaggtggcaccttgatggggtggacccgggctgaagcctctgctaatggttcttgatccctatagggcagtggcactggagctgcaggctaacagggagcccgacttcagcagcctggtgtcacctctcagcccccgcaggatggctgcccgggtcttctacctgctcctgggtgagtgtatgcatgtgtgtgtgtgtatgtggggcagggacacagagaccagaggcccgtacagggactcccccgacctgccctctcctcgcctcttgaccagtgctctcagcgcaacagattcttcacgtgaaacaagaaaagccatatggtcgcctcctgatccagccggggcccagattccactgaggttagagtccatttacaaagctgccaggaaaccggccacttctagtaaaccacgtcgtgcctcactgggtcctgcttacctcatttctgaatgtgcatttccagccttcttgctctcagagctattgttcaagcagaaaacaagctgcttttattacagt

SEQ ID NO: 38410 - DNA, 25696 bp, Homo sapiens
agtgtttacttccgcttgacctggcccggacgccagaaaatgttccacgtgggataccctgcgtggggttcactgtagtagctgcactaggtgattcttggagcgggcctgagagacaaggacatgtggatcccagtggtcgggcttcctcggcggctgaggctctccgccttggcgggcgctggtcgcttttgcattttagggtctgaagcggcgacgcgaaagcatttgccggcgaggaaccactgtgggctctctgactcctctccgcagctgtggcccgaaccggatttcaggaatccgccaaggaaggcgtctaaggccagcttagactttaagcgttacgtaaccgatcggagattggctgagaccctggcgcaaatctatttgggaaaaccaagtagacctccacacctactgctggagtgcaatccaggtgagtccagctgaattgcattttcttggatgttcatcatttattcaaacgtattgaccctcctcggggtgctattttagatactggggggtcttttttgttgttcttttgctttgagacggagtctcgctgtgttgccaggctggagtgcagtggggcgatctcggctccctgcaacctccgcgtaccgggttcaggcgattctcctgcctcagcctcccgagtagcaagaactacaggcgcgcgccaccacgcccagctaattttcttatttttactagagacgggatttcgccgtgttggccaggatggtctcgatctcttgacctcgtgatcctcccccctaggtctcccaaaatgctgggattagaggcgtgagccactgcgcccgtccagatacgggtctttgtttgaagctccttagttggagagattgcccactacataagcgtagagtctgtatcgttaatgacaccacaaagtatttctgtagcagcttgcactttacacaatattttgataaaacatgctcttagatcttatctccccaaaagagttgcaagcctctgccagctgaaaaaatgatgttatcttattcttccgtgcattccctatagaccatagcaggatgctaagaacacaagatttataggctttttgaatgatagttttttaaagcaccatttcatatcacagggagtcagttctgtttaggcttgacaatctctttgatggttaaagcatccgtgtagtccgtgaggaagtgataggctagaggcaatctattttgctgtgacttttttcttctaagaggtagtgaatcatggtgatgaagagtgcaagttttgacctggtgcggtggctcacgcctgtaatccagcactttcagaggccgaggcgagtggttcccttgaggtcaggagttccagaccagcctggccaacatggtgaaactccgtctctgcttaaaatacaaaaattagccgggcgtggtggcgggcgcctgtaatcccagctactcgggaggctgaggcaggagaatcgcttgaacccaagaggcagaggttgcagtgagccgagattgccccactgcactccagcctgggtgacagagtgagacttcgtctcaaaaaaaaaaaaaaaagagtgcaggttttgcagtcgctgacaatgatttcaaagccaagctgcatcacttttgacgctggagtcaaataagtatatataatctcctgtttccttatatgtaaaaaggagagtgacatctactttgcggatgctgtcagatttaaaaaccaggtaataacgtgtgaaacatctaatgaaagtttggtattgaaagagattatgtttcttgtacaaataaacttttcgttctgttaatgtgccaggtcctggaatcctgactcaggcattacttgaagctggtgccaaagtggttgcgctcgaaagtgacaaaacttttattccacatttggaggtatatttttagtttctcaacgtatgttattgtttgttcaactatctgtgagtggtttaaggaaatggaattaagcacacagtgttttacatagaatatcttttagggagccatctctgaaatatcttgtttattcccaaagactagaacacagttaatattcagtgctgttgaatggctgaaacatgaggagttctaagacttgtttgctagttctaggtcggctacagcctagttgggtgactttgaacaaagcgtataactggcatccctaggcttgtttccccatttctactaagctgcgctgtgctcctttcttctgtgagcttggaatctaattggaataagtgctaatattaggttaatggatctgtgtaacctctatatttagggtttgaaaggcaagaaaggttggcatacaaattaagtattttatctgaaatgcttgggaacacaactgttttggatttcaaattttttcatattttgcaatatttgcatatacataatgagatatcttggggatgggacccgagtctaaaaattccttttttgttccatatacatcttattcataaggcctaaaggcaattctgtataatattttaaataattttgtgcattaaacaaaatttgtgtacattggaccatcagaaagcaaaggtgtcactatgtcacccacccatgtgaacaatctccttgtttgacatcgtcatcatccctgactttttttttttttttaagatggagtttctctcttgtcacccaggctggagtgcaatggtgcgatctcggctcactgtaaccactgcctcccaagtttaagcgattctcctgcctcagcctcccaagtagctgggattacaggcgcccgccactatgcccagctgacttttgtatttttagtagtgacggggtttcaccatgttggccaggctggtcttgaactgctgacctcaggtgatccacccaccttggcctcccaaagtgctgggattacaggcgtgagccaccatgcctagctcctgactccgaatttatatgcttctgataagccatcattttcttacacttattcacacatgagtgcttaacagtagaaaaaatgacataccattagtacagtaaaaaaaaaaaaaaaaagtgtgttcagagaaactaagcagcacagcagcatcagaatccctgtgtcagctgttgaacagtggaaacacacagcggcaggctttcagtctcctgggatgctgtgttttcattgaaaggttactgtacaccacattttattttttcttaagaagaaacatcagaagcagctgagggaccaggaagcgggtccgtcaaggctaaggagacattctgccggccggcttttaaaaatgtttcctgtgggccgggcgcggtggctcacacctgtcatcccagcacttcgggaggcagaggcgggcggatcactaggttaagagattgagaccatcctgaccaacatggtgaaaccccgtctctactaaaaatacaaaacttagctgggcgtggtggcgcatgcctgtagtcccagctactcgggaggctgaggcaggagaatcgcttgaacccgggactcagagattgcagtgagctgagatcacaccactgcactgcagcctgggcgactgagctacactctttgtctcaaaaaaaaaaaaaagttccctatggagtcatctgccttattaacagtggtttttgtcttagatgactcccttcgatttttatagactgacctcatcttcgtgttgtatacctgcattttcactgcaagcctgtcacagaaggtcgggtgtcaaattttccacttttggcttcatgttgacactcaaaaagtttcacattttggagcatttcagaatttttggattaaggatgctcagcctgtagtcagatacagttgcatagagtgaaggcatcatccaaatagatttttcagtgattgtgcttcttaaaaagcagacacatttacgtaacaatgaagaagtggaaatcctttgggtctttaaccagtctcttactctcattctccttccctcttttataatcttccgtttcaacttaggaaacttatatttctctatgccaactttgtgaaaccatgcagaatggctgtatccaaaattgcatgacaacaaaaaattgtgaaaatgtctgtcaaatccagttgtttaattcttttaaaactatgagtatgaaattattgttattctaccacttactgttttgaaaagagttcaaggttttagctaggttatttaattgatgttaaatctgagggagttccaaaaatgtgaagaaaaaacacataattgtccgaagatttaagatcctgaaatgtgattcagtaaacatagtcatctgtagtttcaacttggaaattaaaaatgagaagataacttttatcctgatttgaggaaaaaaaaaagcctatatttaaaggttaatctacatattcacaaagtaattaagattgtattaaaatgtctttgtttctatttaaagtttgttattctgtaacacagtagttgcttttttctataagatcttcaaggctgaggaccgaggcccatgcctgtaatcccagcactttgggaggccaaggcgggcaggtcacttgaggtcaggagttcaagaccagcctggccaacatagtgaaaccccatctctactaaaaatacaaaaaattagctgggcatggtggttcatgcctgtaatcccagttacttgggaggctgaggcaggagaatcacttgaacccggtaggtggaggttgcagtgagccgagatcgtgccattacactccagcctgggctacaggagcaaaactcagtctcaaaagaaaaaaaaaaccttcaagataacagtttaattttaaaacaattgtttaatgaaaaaaggaaggttagggactagagaatttttgaaacaataattatgataggaatatcaataacaaaatgtttctgaagctataaatgtcagctaaaaatataaacatcattgactaaatccagtctttgattagaactagttttttctctattaaggctcttattttctactagcactgacttgtactcaacccttagtacatattctctcactttttagtaaccattgttatgataaattgaaaagccattcaaataaaattttgtgtgaattaatctgtttgccagagtgaaaagagaagtaacaataggtaagcagaactcttgtggctctaagtcagggacttaaagtgctgcgcttagcggataatgcttctggccacctaaagtttgttcctgaaaactgaaaggagtttcagtggtgagagctgggattacaggtgaccgccaccacgaccgacgaattttttgtatttttagtagagacgtggttttaccatgttggccagactggtctggaactcctgacctcgtgatccgcccgcctcagcctccaaagtgctaggattacaggcttgacccactgcacccagtaaatgagacaaacttaatgactaacttaagtacctaacttaatgactagtaaaaactcaagggttacttgccttttctctgttttttcccattctgtttttgaatcctaatgcaatccagttgaatttttaaatgtgatctgttgtatgaattgaattatttatcctgaagctttgattattatcatgtttgaattgttgagtgttaactgacaagtgctaaagcaagaatgtatggtgccctctcagaacatacaagtgtattgaggccataaagtgttcattgtttatacattttctttttcttttttgagacagggtctcactcccattgcccaggctggagtgcagtgctgcagtcacagctcactacagtctcaacttcccaggctcaggtgattctcccacctcagcctcccaagcaactgggattacaggcacacgcccccacacctggctgattttttgtattattagtagagacagggttttgtcatgttgtccaggctggtctcaaactcctgggactacaagcatgagccaccacacctgtgctgtttagctttccttaattacaaagattaaactgcctttttgataacttgaaagattatgttaatgctatatcaggggtgtccaatcttttggtttgcctaggccaccctgaaacatcaactgtctgggccatacataaaatacagtaataagaacagtggctgatgagcttaaaaaaaaaaaaagtccatgcatacatctcataatgttttaagaaagatgacaaatgtgtgttgggccacattcaaagccgtcctgggctgtatgcggccctcaggccacaggttagacagccttgccatgcgtgttgactgacaatcgtatgcattaggtaggtactctttcttttagcttccatgacaccacactcttctggttttcctccttagttgtattctcagtttcttgtcattagactttggacatactctaccttcagggctagtcctctgtttctccctagtgtagacccctgacttaaattaccttcaacaagccaaattcccacacatttatatcgtcagactggaccactccactgagcaccttattcaggtctgcaacttcctacctggcacctctacctagatcacatagtaggcatctcgaaattaatgtgaccaaatgtgtatgatttccacccccagtctttcccttcctctagtctttttaaaacttccccttgaaagtgattgttaaaatgtactagatttgtttgtttatttactttggagatggagtctcactctgtcaccctgactagagtgcagtggtgcaatctcagctctctgcaacccctgcctcctgggttcaagcgatttctcccacttcacctccccaatagctggagttacaggggtgtgccaccacccctggcttacttttgtatttttagtagagacagggtttcaccatgttggccgtgctcatctcaaactcctgaccttgtgtgatccgccctctttggcctcccaaagtgctggtattacacgtgtgagccactgcacccggccaaaatttactacattttgagctggacacggtatcacacacctgtaatcccagacacttaggaggctgagacaggagcatcacttaaggccaggagttggagaccagcctggggacatagtgagactcatctcaataaaaaataagaagaaaaagtattttactagatttagaaataggataatataggttgaatacaaatgcttaagaaaaaataggtgtttgcattaataactttaagttacatcatttccaaccttaataaatattaatagaattttctgtgcacagaaacatcagtgtacacattaaaaacataatgccttcttactgatttttttttttgtaacttcgaattaagtttatggagtctataactgattcttgccctaactatgaaggtctctagtactactgcaagatgagcaaatcagagcagtgagaagactgagatatattagacctcttccagcaaacaaggtgtatagttgcttctgtctttagaaaaagtaaatgaaaattatggagatgagctaagttcatttatttggtggatagctgactagattcccctagaagaaagatattctcttgaatccatctgcctttcacttttatattttaattgtttttctttactgtgaaacatctttcattttttcttcccatgaccaaagcagatggctcacagttctctgtaagaggccaaccatggtgtcagaatctttgcccagtgcttcaggtaaccactactaagcaggcagggagtggtgtgaaaagcttttgaatagctgaagccattatgataaagaaagtaagtggggccgggtgcagtggctcacacctgtaatcccagcactttgggaggtcaaggtgggcagatctcttgagctcaggagtttgagaccaacctgggcaacatggcaaaaccctgttgctacaaaaaatccaaaaattggtggggcgtgatggtatgcacctgtagtcctagctgcttgtgggactgaggtggaaggatcacttaagcccaggaggtcaaggctgcagtcagctgggattgcgccactgcactcctgcctggttgacagcttgtctcaaaaaaaaaaaaaaagtaaacagataaagaaaaatttatgatagtttatttctgtttggggggctttttcttggtaatattgtacttttgccacttttcaggtattaattgatttttacttcctctgttaaattttgggtatgttagtaatattttctttacatagttatggaggtagaaatattttttgtaaaaaggtaattcagccgggcgtggtggctcacgcctgtaatcccagcactttgggaggccaaggtggacgtatcatgaggtcaagagattgaggctctcctggccaacatggtgaaaccccatctctactaaaaatacaaaaaactggctgggtgtggtggcacgcacctgtagtcccagctacttgggaggctggcacaggatcacttgaacccaggaggcagaggttgcagtgagccgagatggcgccactgcactccagcctggcaacagagcgagactctgtctctcaaaaacaaaacaaaacaaaacaaaaaaaccccaggtaattgaattatttttatttttacattttattatggttttttgaagtagagttttttgaattgctgcaaagtatacttaatgctgaaaatttttaacgtgttatctttgtctctctttagtccttaggaaaaaatctggatggaaaactacgagtgatccactgtgacttctttaaactagatcctagaagtggtggagtaataaaaccacctgctatgtcttctcgagggctctttaagaatttgggaatagaagcagttccttggacagcaggtcatttttggaatttactaaagcaaatacctagaatttgccaggtgtctctagcagtataactgatttgttgatgaaatttgtgttttatttatttgtttgttttctgagatggagtctcactctgtcacccaggctggagtgcagtggcgcgatcctggttcactgaccctctgcctccaggttcatgtgattctcctgcttcagcctccctagtagctgggattacaagtgtgtgtcaccacacctggttatttttttgtatttttggtagagacggggtttcaccatgttggccaggctggtctcaaactccagccctcaagtgatctgcccgcttcgacctcccaaagtgctgggattacagatgtgagccaccgtaccccgccgaatttgtgtataatttatattatattaatacagtttatgagcagatgctctgactctgaatatggcatttacctcacctggacacaggtacccagtttatttccccaaaagccaagtttcatgccaaggaaagatattgaggcttagttttaattgaaataaacttgaaattaatatagtttgttaacttagtttgtctcaaaaaaatatggacataggacaaaatgctaagaactttattcaaatctttttgcttatattcctaacagacatccctttaaaagtagttggaatgttcccaagtagaggtgagaaaagggcactttggaaactcgcatatgacttgtattcctgtacttctatatataaatttggacgaatagaagtaaatatgtttattggtgaaaaagaattccaggtatgttattaacaaatacctattttttgttctgagtctgtaatttttctctgagtactcttaatctgtgcgattttaatttagggctcgtgacatttgagggtctaagattgtttttaaattctgcagagcagtcttatgctcaggttgctttttcagtgtacagttgagtggttttaactgcattcccattgtacagccattaccatcatctgtctccaaaacttttcatcatcccataccaaaactctgtactcattaaacacaaactctcgtttccctcttcctgcgtcccctagtaatcattattctactttctgtctctatgaattagactattctctttacctcatgtaagtttactctacaatatttctttgtgtctggcgtatttcacttagcataatgttttcaaggttcatcaatgttatagcatgtgtcagaatttcattcctctttaaggctgaataatattccattctggccgggcacggtggctcactcctgtaatcccagcactctgggaggccaaggcatgctgatcgcttgaggtcaggagttcgagaccagtttggctaacatggcaaaaccctgtctctactaaaaatacaaaaattagccaggcgtggtggtgcatgcctgtaatcccagctacttgggaggctaaaacaggagaatcacttgaacctgggaggaggaggttgctataagcccagatcatgcccctgcactccagcctgggcaacagagcaagactttgtctcaaaaaaaaaatctattgtatatatatactacagtttgtgtgttgatgtatcaatgacatttggttgcttttaccttttggctgttgggaataatgctgcaatgaacatgagtttaccaatatctcttcaagtcctttgagtgtacagctagaagtagaattgcaggatcatatagtaattctatttttagttttttgtgggttttttgttttttgtttgattgtttgtttgttttttgagacagggtcttgccctgttgcccaggctggagtgcagtgacatgatcacagctctctgcaacctggacctcctgggctcaagcgatcttcccgcctcagcccccaagctgggactgcagccacacaccaccaggcccagctttttgtagcgatagggtcttgccatgttgctcaggctggcctccaactctgggactcaagcagtcctcctgcctcagcctcctaaagtgttgggactacaggcatgagccactgtacccagtctatttttagttttttgaggaactgccatactgtttgttatccgtcgtggatgcaccatttgatattcctaccagcagtgcacaagggttccgatttctccacagcattactgagagtcgttttctgggtttttggtaatacctctcctaatggtatgaagtggtatttcattgtgcttttgatttgcattttcctaataattagtcatgttgaatatatttttatgtacgtactgactgtatatcttttaagaaatgtctgttcaagacatttgcccatttttaatgggttattttgtttgttgctgagttttaagagttctttatatattctggatattaatctcttatcatacatgatttacaaatattttctcccattctatgggttgccttttaaccctgttaattgtgtcctttgatgcccaaagtttttcattttgatgaagtcaactttgtctttttttctcttttgttgcctgtgcctttggtatcatacgtagctgggcggtccccaacatctttggcaccagggaccagttttgtggaagacagtttttacgtggatggcggcggggatggtttcaggatgattcaagtgcatcacatttattgtgcactttatttctattattattacattgtaatatataatgaaataattatacaactcaccataatgtagaatcagtgggaacactgagctagttttcctgaaactagatggtcctacttgcgggtgacaggagatagtgacagatcatcgggattagattctcataaggcccttgcaaaacccagatccttcgcatgcgcaatagggattgtgttcctatgagaatctaaggcggctgctgatctgagaggaggtggagctcaggcggtgatgtgaacggtggggagcggctataaatacggatgacgcctcgcctgttcacctgccgctcacttcctgctgtgtggcccagtttctaacaggacacggactggtatcagttcgtggcccggggattggggacctgtgtcgtagctaatagatcattgccaaatccagtgttgtgaaggtttccttgtgttttcttctaagagttttatagttttggctcttgtttaggtctttgatccattttcagtaaattttgcttatggtttcagtgtccagcttcattctttgatctagttttcccagcaccgtttgtggaaagactgttctttactgccattaaatggctttggcgttggtgtcagaaatgatttgaccatatgtgtacgcgtttatttctgggctctattgtattctattgatctaaatatttgtccttaggccaagacaacactgtgttgctactgttaccttggtaagttttgaaatcaggggctgattcatccaaatttattctttttaatgattgtttaggctatttgagtttcctcgagattctatatggattttaggctggatttttctgtttctccaaaatgcgttaggattttcctagggattgcgttgaatctggagattgctttgggtggtagtggcatcttaacagtattcaatattaaatcttccaatccacgaacatgaaatgtctttccatttatttgtgggttttgttgttgttgttgttttcatttttgtttgacacagggtctcactgtcgcccaggctggagtgcagtggcaggatcacagctcactgaagccttgacctcccaggctcaggtgatgcttccacctcaacctccccagtaggtgggactacaggcgtgcacccccgtgcctggctgattattgtcttttttgtagagatggttttaccacgttgctcaggctggtcttgaacttctgggttcaagtgatccttctacctcagtctcctgaggtgctgggattgcaggtgtgagccactgtgcctggcctccatttatttgtgtttttaattactagcttttaagttacttttggtgctattgtaaatggaattgtttttcgaattgtccgttggtagtgcataaaaatgcaactgatttttgtatcctgcagctttgctgaatttattaggttttttgttttgttttgttttttttagacggagtcttgctctgtcgcccaggctggagtgcagtggcgcaatcccggctcactgcaacctccgcctcccagtttaagtgattctcctgcctcagcctcctgaatagctgggattacaggcacgcgccaccatgcccagctactttttttgtatttttagtacagatggggtttcaccatgttggtcaggctagtctcaaactggtgacctcatgatccgcctgcctcagcctcccaaagtgctgggattacaggtatgagccacagcgcccagccaggttttttttccctccctttgtttttaaatagagacagtgtctcactttgttgcccaggctggtctcaaacacctgggcttaagtgatcctcctccctcggcctcccaaaatgctgggattacaagtgtgagctaccatactcagctgaatttattagttttaacaggatttttttttaatatttaaggggtattataattattttttttaactttaaaacattaaaagaaatttttttagagacagggtcttgctctgttgcccaggcttgaatgtcgtggtatgttcatagctcactgcagcctcaaactcctgggctcaagtgacactcctgcctcagcctccctgtagctgggaccacctgtgcacaccaccacacccaggtagtttatttttgtagtgacagggtcatgctgtgttgttcagggtggtcttgaactcctgtcttcaagtgattctcctgcctcggcctcccaaagtgctaggattacagttgtgagccattacaccgagcctaagatttgagactctagttcaattctctgtaatggaaggtcttcctgacaaccttgatctcgctatgagtgtcatctttcttttctgcccagaatgtttcatgttattgatctgttaatccagtttgacgggaaatgcttgtttgtcttgctgtgttgcccatgctggagtgctatggcttttcacaggcacggtcatctcacactgaacccccaaactcctagactcaagcagtccccttgcctcagcctttcgagtagctgggactacatgtgcacaccactgcacccagctttttgtatctaattctagttttctctgcttaaatttctagatgctattaagatagtactattaagactcaaagaagattaagatttttataatgcttatttgtattgctatggattaggatagtggggcaaaaaatgaagggatgatttgctcccccagacccatttagtaaatacatatttgctagccatggaaagacagcgagggcctcaggaccttggggctgtgcatacgctattcaacaaaggaaagacaaggagaagaataggaagtgctgtgttagattcctgctgctagggttatattccactggcccatgcctcttttgccgtggaccttttcacatgtggtttcttgtctgcggagtgccttcccattcgttgaggtaacctcgtcctttcaagtcagccttaacacttgtgtgttgttgttttttaagagatgcggtctcactatgttgcccaggctggtcttgaacttctaggctcaagcatcctcccaccttggcctcccaaagtgctggaattacaagcgtgaccccgcgtgccctgccgttgcccctgccggagtgctgtggctattcacaggcacgatcatctcacacggaacgcccaaatgcctgggctcaagcagtccccttgcctcagcctttcgagtagctgggactacaggcgtgcaccgctgcacccggctttttgcatctaattctagttttcttttcttaaatgtctagatgccattaagatagtcctattaagagtcagcatttgtttttaattgattatagatgtgtataacatgtaatttttattttccttttactagaaactaatggcagatcccggaaatccagacttgtatcatgtattaagtgttatctggcaattagcttgtgagattaaggttctgcacatggtgagtaaaatccttctgtttaaaaacgtttttctttagcgacagggtctcattatgttgcccaggctggagtgcagtggcacaatcatagcttgctgcagccttgaactactggactcaagtgatcctctcaccttagcctctggagtagctgggactacagccaggcgccaccatgcctggctaagttttaaaatgtttaagaatattgcccagcctggtcttgaactcctggcctcaagtgatccttctgccttagcctcccagatcactgggattacaggcatgacccactgcacctggctctattttttatttttttattttttgagatggagtctcactcaagtcacccaggctggggagcagtggttcgatctcggctcactgcaacctctacatcctgtattcaagcaattcccctgcctcggcctcccgagtagctgggactacaggcgtgcaccgccacaccttgctaatttttgtattttcggtagagacaggtttcaccacattggccaggctggccttgagctcctgacctcaggtgatctacccgcctcagcctcttaaagtgctgggattacaggcgtgagccactgcgcctggccctggctctaatttttaaatatttacaatgtggatcttcacgtgttctcgtcactgcttccgcctgagaatatgctgaggtcttcagtctgcaccttgctgtattttttttttaagctcaggaatgttatctcatttgattttagcttttgttccaattctttttttttcccctcaaaaacatttgaggttcttaggttggatctctgatccttgtctttcgtgtctgtcatgctctcatcatttttctccattcccagaatctcttcacacttagtcttcacatcactgattctgctttctgcctgcactgtatattgtactctcagtactatagttcttggtttctctaaaattcttccttacccactgatcttgtctcattctgttgactttcatctcaagtcttctgtcctggtagctttcagctagtttcttcagagaggccctctgaggactttagcttgcagaatgttttcgtcttcttgttcccttagtatttgctttcaaaggtcccgtgttaggttttgccatttactaaactccagaaaggaaaggtctttctggacctaacgtttctcagcacttgctccactgtgtgtctacatctgtagagtaagttgttgaagtcaattcccagtgtcttgcaggttttcctccactgtgcttgatgaggggaaagctgttgaggctcgaccaggcgtgtgggaagtggcagtactcattgtgcacggctgatggtgcttttcttcccccacttaaagtgacattcctggaactgctaggaatttcacaatttggccacaattatatgttttagccactctcattgcccctgcagttaataataaattgttacttgacagtagcctttcagaccttgtgttcaatattgtttagtcttttaagcctatgtcagatctattttaacccactcttattttggaatttaatatggttatgggtatgtatagtttttttaatagagaatactttttcaggtgggtcggttttttattttgagacacgatctcactctgtcagcccaggttggagtgcaccagcacaatcccggctcactgcaacctccgcctcccaggcttaagcaatcctcccgcctcagcctcccaaagagctgggactgcaggcatacaccaccacacccagctaatttttgtatttgttgaagagacagggtttcaccatgttgcccaggctggccttgaacccctgagctcaagcggtcctcctccctcagcctcccaaagtgctgggattacaggcatgagccactgtgcctgaccggatcatctcttaaaattgccttatgcacaaaattctcttacaaaagatagataccgaaaaatagtgatccattttaaaattgacactaggtttttgttattgttgtttttggatagggtctcactctgtttcccaggctggagtacagtggcttactgcaaactccagctcccaggctcaagcaaccctcccactttggcctcccaaagtgctgggattataggcatgaaccacagcacctggtcgacactagtatctttatttgtttatttccatatatgttctaacatattcaaatagtttgattagtaggcttttccactgaagtagggcaaaaagaaatcctcagcattaatctaatatcccttaaactgctgattctgactgtgatatggaaatattgagtggtaaaaattataacaaatacttatttgcgtaattgcataacaggcgaagtcatgtttaataaggaaaagaggtactagtatttgggtagacttttgatcctcctcctctttaaaaaaattaaggagagagatgtgtattatttagctataacatgtttcttttaaatccaattagactgaccattctcttatttaggcaaggtgttttttaaggaagtaataactggggcactttgaccaaagagaaataaaagatgttgttttgctttgtttttcttccccaggagccttggtcatcatttgatatatacacccggaaagggccgctggaaaacccaaagcgtagggtaagaataaaataataccttttcctttttctccctacgtgacgtattttttattttatttttttaggactatttggtagtctgtatttaactttttaattttaaaatatctagaaacattctttaaacatatcttactacttttaatgaatcaaaagtattttggaagagttatcagctgttatacaatggatgctagcatagtaataggcttaaaaacagaatctgagttctcttcttatatcttttgaaatgaaggtacatttcaaatttggaaaataaaatcattttaatatttatctaattcgattaattagaaacaaaattttatgacgtattaatcgattagaaatttgtgatattcaaggtcaagagatcgggaccaccctggccaacatggtgaaaccccgcctctattaaaaatacaaaacttagctgggtgtggtggcgcatgcctgtaattccagctattcaggacgctgaagcagaagaatcacttgaacctggcagacagaggttgcagtgagccaagatcgtgccactgcactctagcctgacaacagagcgagactctgtctcaaaaaaaaaaaaaaaaaaattgtgatattactactcttattacatggttgaattcactgataggtacttcttgatttttacccaggagttaggcctttatttttgttcattttttaatctttgtacgtaagaaccaaagtgacaatgttatagtcctccatttagtttatctcagggctagttgtgaaattctaataaagtagctaaagtttcacaaaacaattttttgactcaattcagaagtttcactttagaattagatgcctgtctttaaggtttggggcttaaaaaaaaaaaaaacgaattaaatgctaacaatggcctaatctcagcataacagcttagtctgaagatcttgtttgtttgcttacttatgtttttttctcacacttgccactaaaggaaaaagaaaattatcagttttctttcaatgttgtgattttagagtgatcagtcatcattgtgcttttagttctgtttgactatttatacagcatatttatgtagtcccaaaaaacagaataggaataatgcattttgtctaatacagtacatttggatactattggggacttatccaaatattccacaaatgaacaatcctgtatataatatactttctcagtttttcagcaagaagctgaaaagcttaagtttttttggccaacttaaaaatataaacttggccggacgtggtggctcacacctgtaatcccagcactttgggaggccgaggtgggtggatcacgaggtcaagagtctgagaccagcctggccaacgtgctgaaaccccatctctgctaaaaatacaagaattagctgggtgtggtggcgtgcgcctgtagtcccagctactcaggaggctgaggtgggagaatcagttgaacctgggaggcagagtttgcagtgagctgagactatgccattgcactccagcctggataacagagtgagactttgtctcaaaaaaaaaaaaaaaaaatgtgtgtgtgtgtgtgtatatatacatatataaacttttagggatgaagatgaaataagcaaatgtcatattttatgacagaatttattttagatatttcacatgtgtctttgatatcaaggtgctcatattgctatggaagcagtttgagacatttaacaggtttttagggcctgtcatttctatccaagttttgtttgagacctactttttaaatatccgattaaaaattttagtcaataactttttttgtcctttggatccgatggtgatgttttatcttgaatatagcaaggactcaatatatgttaatgccatgtttgggtttttttttttttcctttttttattttttatttatttatttttttgaggcaaagtctcattctgtcacccaggctggagtgcgatggcatgatcttggctcattgcaacccctacctcccgagttcaagtgtttctcctgcctcaccctcccgaatgctgggattacaggcatgctccaccacgcagggctaatttttgtatttttagtaaagatggggtttcaaccacgttggccaggctggtctcaaactcctgacctcaggtgatccgcctaccttggcttcccaaagtgctgggattacaggcgtgagccgccacgcccagcctatttttttttctttttttaaaagacagtgtctcactcttctcccaggctggagtgcagtggcataatcacggcttactgcagcctcaaactcccgggactcaagtgatcctcccacctcaacctcccaaatagctgggaccacagatgtgcatcccacgcccagctagtttgtttgtttgtaaagaaggagtctccctgtgttgcccaggctggtcgctaactcttgggctccagcgatcctcctgcctcggcctcccaaagtgttggattgtaggtgtgagcaacccggcctcatgtctgggatttgattttaccctacttacatgttaataaatgttactgtttctcggatgttggcctaagactcctggatcagacagaggatgttctgtgcctctcttcccatggagtgatgtgaggtggctcagttgggtgccttgcatttagtggacttgctttgcagctgagaagtacagagctgggggaatctaggtcttttttttttttttttttttttcgaatcagggtcttgctctgtcacccgggctggagtgcaatggcgtaatctcggctcactgcaaactccacgcagcagtctcaagcatcctcccatctgagcctcctaagtagctggggctacaggcatgcaccaccataccctgccaatttttgtactgtttgtagagacagggtttcgccatgttgtccaggctagtcttgaactcctgggctcaagcgatctgcccacctcagcctcccaatgaatcctcctccttcatagcaaacattaagcaagcctgcccttttgtttttttaagagaaggcctggctctgtcaaccagccttgagtgcagtggcatgctctcagcctccacctcctgggctcaagccatcctcccacctcagcctcccgagtagctgggactacaggcacacaccaccacacccagctaatttattttttatagagatggggttttgccacgttgtccaggctggtcttgaactcctgacctcgagtgatccacgccttggcctcccaaagtgctgggatcatgggcatgagccactgcacccagccacaggcctgctctttgtcctggagagagacgttatctcctccctcaaggttactcatcacaaacaactctgagaaatggcccaattcattggtaaagaccaattagggctttgtgttcttggtgtacacaataagaaaatgtgggccgggcacggtggctcacgcctgtaatcccagcactttggggaggccgaggcgggcggatcacgaggtcaggagatcgagaccatcctggctaacacggtgaaaccccatctctactaaaaatacaaaaaattagccaggcgtggtggtgggcgcctgtagtcccagctactcgggaggctgaggcaggagaatggcatgaacccgggagatggagctttcagtgagtggagatcacgccgttgtactccagcctgggcgacagagtgagactctatctccaagaaagaaaaagagaatgtgaagacactcagggcctgtggtgattgtgtctttcagcagatagcttgaaggaagaagtgagcaatgtcttactctggcaatattttgtgactaatgcaattcattttttcttctctccaggaattattagaccaattacaacaaaagctgtatcttattcaaatgattcctcgtcaaaatttatttaccaagaacttaacacctatgaactataatatattttttcacttgttaaagcactgttttgggaggcgcagcgccactgtaatagaccacttacggtgagtaaaaagaataaaagcaagtataaagtagcaacgatgcacaaattattctttcatgctagagatctatttttatatcttgattgacagagtgaggtaccatgttttccctcatatttcttcaaaataatttgttctccctggtgtacattttgaggaaaatatatttttcccataatctctcattgagtttcatttatttttccttctttaaaaaaatgcccagattgtttaatctttttgagagtatgggcttagctttatcttacaggaagcactagctgcctaccactagtggggtggagagaaatcagcattactggaggcgtgcccacacttacctctcattgcttgtcttcagtggttctgttccttaaccagagtagggatagataattataccaccctggttcccttgctctggatcaaattttgtttttacccaaagctttgtaaaaataatagcttgtaagtaacactacttgctttatgtctatataagtgaaaaacatttttttgttgttgttagagacagggtctcgctgtgttgtccaggctgaagtgtagtggcacagtctcagctcactgcagccttgtcctcccaggctcaagtgatcctcccacctcagcctcctgagtagctgggactacaagcatgcaccaccacgcccggctaatttttatatttgtaaaaatataaaatttttatatttatattttgtgtttataaattgtatgccaatttttgtagagatggggttttgccaccttgcccaggctggtctcaaattcctggcctcaagcaatccaccttgcttggcctcccaaagtgctggggttacaggcatgagccactgcacctggccatccatgtaatttgtatgtagggctgatgcacacacctctgtaagtagtgctggggttacaggcgggagccaccatgcctggccatccatgtaatttgtgtgtaggcctgatgcccacacttctgtaagtacagctcaggttaccagcatgagccactgcgcctggccatctatgtaatttgtatgtagggatgatgcatacatctctgtaagtagtgttggggttacaggcatgagctcccgcgcccagccatctgtgtaatttgtacataaatccatgtaatttgtatgtagggctgatgcatacgtccctgtaagttgtgcattatgccttgtaatcagcagcccatagtcattcaaagtctcgccagaggatgggtaaaatgttaaaataattattttaacaaatttgatcatttaatatttaactctgaatgagctgttgactagacaatatttatctaaaaataaatgttaaaagtggcaatagcctgggtgcagtggttcatgcctgtaatccgagcatttttgtgaggccaaggtgggaggatcacttgaggaggccggggattggaggctgtagtgagccataaactcaccactgcattgcagtgtgggacacagagcaagctgaccttgtctctaaaaaaaaaaaaaaaaaaaaaattgggaggcagagagcgccaacaagactttgagatgagcctgggtgacagagcaagactctatctctaaaaaaaaaaaaaaaaaaaagtggtaatagactagtaaaaggcaatagactaataaaaggcaatctattatttttcatcttgccaccttgtggctattttgaatgaaaatatcaagaaaatagggaaataaggaataaatgttgtaaatcatagtgcaaaatattaaaaatgctcctggtaatctcagtggactagaaacatgttaccaagattctattcaatatcaaaaagtattggaattgaacagacagagagtctcactctgttgcccagtctggagtacagtggcacaatcatagctcactgcaaccacaaaccccttgctcaagtgatcctgcctcagcctcttccctgagtagctgggactactatgcccaccactatgcccagctaactttttacgatttttgtagagatggggtctcactatgttgctcaggatagtcttgaactcttgggctcaaatgatcctcccacctagccccccaaagtgctgggataacaggtaggagccaccgcacccagcccaaaatatttttttacaattgttgttgttggaggcttattgatggtttgttgctaagctgatacacagttatgtacctcatattatggtatataatatacctcattgattatatattgtatatatattatataatataccttatatatataatacctcataatgaggcgtgttcgttatacctcgtttcagtcagtagtggaccaaatgtacaatagtggtcccataagattataaagatgctgtatcttttactgtatcttttctattacttaccattgtgttacagttgcctacagtattcagtacagtaacatgctgtgcaggtttgtatccttggagcaataggctatgccatatatcctaagtctgtaataggctatatcacataggtttgggttaagtactctgtaagatgttcaagcaacaatgaaatcacctaacagtgcatttctcaggacatacctccatcattaagcaatgcatgactgtataaggaagtttgcggctttataatgtatttaccaatgatggttacatcaaaatgtgaaaaatgattccctctttgtaaactgccaaacagcaacttctgctgtttatagttactgaactttgacatgaaccaaaagaagttaagaatattttttgcagaaaggaaaaggatgaaagaggtaggcataataattttttcaaacggcagtgattaaactagaattcggtgtaaaaattgattagagtatgtgaaagcctaaacctgctattaatattttcattataggttagctatgaaactttagaaataagcataaagttactggaagctcttaaactaaataagattgcttatatataataagttaggcttttttttttcttcttatttcaatagccttaggaatacaagtgatttttttggtttcatggatggattgttgaagtctgggcttttagtgtacccatgcccaaatagtgtacattgtacccagtaggtagctttttatccttcaccctcctcccatccttcaccctcctcccatcctcttccctgctgattctcccgtgtccattatagcactctgtatgcctaagttagacattttgaattcaacttagaagccatttctgtcaccgtgaactgatagatgcatgagaaagaattaagtacatttactttgtatttcttttgcagttcattgactccacttgatgcgagagatatattgatgcaaataggaaaacaggaggatgagaaagtagttaacatgcaccctcaagacttcaaaacactttttgaaactatagagcgttccaaagattgtgcttataaatggctgtatgatgaaaccctggaagataggtagcaactagactgtcgtttttggtggagcggttcatttatttggaaactatgacatgaaaaccaaatttgaaaactcacatcctttcagcagaaggtaactgttcttgtcttgcacaagccaggcagatcatttctcctaagctgatatcattggcttattggatgaaacagtgtctgctattttattcacaattgaataaaatgaaaacttcaattaattgtggatttgatcagattgaattcgttttgtttcagattcctatttaaatatttcacttgtactgttgctgatttttgcatcttcttgaagagcaagagtctgtacattattaagcttagaaagtaagcaaaactgatttactggtttgcctttcagtttgttgaaatgtattgtcaagtactgtacaatgaaattgtttaaattttaatatgatttaagctttttagaaattaaaatattttaaat

SEQ ID NO: 38411 - DNA, 42449 bp, Homo sapiens
cagactgccataagatggcgtccgtggcggctgcacgagcagttcccgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtatggcagtgcggctggcccgggcgcctggggaccccggaggccgcgtggacaccctgtggcaaaggtcttaaagggtgaaccccgaggcttgtaggggcggagggggtaggtaaagggagcccatacttactaagcacccgccgcatgccagacacagtgccagatgtttcccttatcatcgtctcatcaacttctcacgacgttactatttggtagatactattatctccttttatggagaaaggaattggggcttagggaggtgaaacgattttttccatgtcacatagcgaataagtggaagacatggtatttgaacctacaaggtcgacagataggtatccagtaaatatcttttgaataaaaattattccagagcttttgttgtaactctaaccctaacccagcgagatcaggataaattggataccacctatggtgtctgctgggggagtggaatagggttgacagtcaggagacctggattctagtcctgaatctgccattggccatgtgacttcggatcaacaatgtcgtttatttggacgttattttatatatctgtgaagtgaggaaaatgtcacctaccgcacaaggttatagtgcttaataaatgggatcatgagcgttagaacgaagaacagagtgccctgtccggaataaggccagacttgtggtaaatgcttttttaagtagaggttttaaatcataatggctgatttaaagttgaaggggctttgtcctcttcttcgaactgggaggcccagaaggggtgtacatcacatctgggagcattttgctccattaagagtgggtagtgggtgacattttgggtaaatctctgatggaggaactacagcagctatttgttgaggagaatttacagttatgagtcttcacagagtaaatgagatgttgaacatgaaatgcctggcactgaacatagcacctgatgagtactcagcaaagaagggcagttcctttccccaactcacccagaagccagtgggcatagtttctgctttcattagtttatgtggcatgacaagaccatcagcacacatgaaacgatcggataattcaaaaaataatttgtttgcagtctactttgtgccagcttcagaagacaatttacctcaaatcccagctgtcttttccaagatatgcagctatagcctaacctcttcatgcctttgtttcttcttctgtaaagtaggaagaataatatcaataacacaacattattgtgatgattaaatgagataaagtatgtgcagtacttaatacaatatatggcacataataagagctaaaaatacagcagctgctatcttctgcgaggccctactggagagacaaaatcataatttctgcccttgagttttagtccagctgaacataaaacaaggcagagctaataaatgtttggacagagatattaatggatttgcaagatgatgggaggagagagactacagatgctagattttatgacaagtattatagaatttctgagacaggagaaattatcgaaggctggcttagtatggaaagctctctgaaaaagggcttgaaaaataggtcaagtttggataggtaagaaagaagaaaaagcttattaaaggaaagaacatgaagctggtccaaaggtattgagttgtctcagttgattgttcacagtcagttacagatggaactcccttttctactctttggccctttctcactactgtacatgactagtcttaaaaaaaaaaaaggaacatgaatgaagatgaagatttagaaggtgaaatggccatagtgtgtaggtaggatagtaaaaggagactgttcaattgcagatatggaatgtgagatgagcaacatgatgaaggcagtgtgtaaggaacattcatttgtgagcagtacgtatggtacttggataaaaaatatccaagaatggtataatagtagatctgtggtctgatacctcagagacttaagtaataagagtttcagtaagatggagttacactgatgacacctaaggtccatgccaatatttatgttctatcatttctttcttcttttttttttttttttttggagacagagtttcgctcttgttgcccaggctggagtgcagtggcgcgatcttggctcactgcaacctctgcctcctgggttcaaggattctcctgcctcagcctcccaagtagctgggattagggtgagggacaggcacctgtcccacacccagctaagttttgtatttttagtagagacggagtttcgccatgttggccagactggtctcgaactcctgacctcaggtgatccacccgctccagcctcccaaagtgctaggattacaggtgtgaggcactgcacccagccttacatctgtttttaagtaggttactgggttctggcagtgagggttggatatagctctatagtagctattatgtctcgttactcatagctgtgtaccaaagaaatgtttctatcttttttcttttctttttttttttgaaacggagtcttgctctgtcgcccaggctggagtgcagtggcgcaatctctgctcactgccccctctgcctcccaggttcaagcaattctcctgcctcagcctcccgagtagctggaattacagacgcccgccaccatgctcggctaatttttgtattcttagtagagatagggtttcatcatgttggccaggctagtctcaaactcttgacctcatgatccgcccgccttggcctcccaaagtgctgggattccaggcatgagccactgcgcctggcccaacttgtgttttcaaccagtgaaaggagatgctgcttttcagtgacttgaggttgactcactagtatttggtaaacatgtaaacaaaatgatattgttgatgttgaatcaccagctacttgaaataacattttcaatttcaagtaactccacaggcaaagcaataataaatatcaacaactcaaattttcaaagcattgtttaccaaatgtttacagtttcttctttttttttttttttttttttttttatttgaggtcttgctctgttgccccggctggaatgcagtggtgtgatcatagctcactgctataactttgtttttgttgttgttgttgttgttttgagacggagtattgctctgtcactaggctggagtacagtggcactgtctcagctcactgcaacctccgcctccaggattccagtgattgtcctgcctcagcctcccgagcagctaggactacaggcacatgccaccaggcccagctaatttttgtatttttagtagagacagggtttcaccatgttggccacgatggtcttgatctcttgacctcgtgatccgcccacctcaacctcccaaaatgctgggattacaggtgtgagccaccatgcctgaccttttttttttttttttttttttgagatggagtttcgctattgtggcccaggctggagtgcaatgacaccatcttggctcactgcaacctccacttcccaggttaagtgattctcctgcctcagcctccctagtagctgggactacaggcatgtaccactgcacctggctaattttgtattattagtagagtcggggtttcaccatgttggccaggctggtctggaattcctgacctcaggtgatccgcctgccttggcctcccaaaatgctggaattacaggtgtgagacactgcgcctggcactgctgtaactttgaactcctgagttcaagcagtcctcctgtctcaagtagctgggactataggcatggaacactgtgctggtgataaatatatatatatatatatttaaaatcctcacaatagtctcataaaatggatattatcacttcacagttaagaaaataggcctaaggtcttagaataagtagcagacctggagtctgaacatgaaagtgtctgctttccatccccagtggcatatctgctacacaaagccatttcctttaagatgaccaggggctgtggggttcaatcagtagggagttttttgtttgtttgtttgtttgtttgttttaagatggagtctcgctctgtcacccaggctcatgatcttggctcactgcaacctctgcctcccatgttcaagcgattctcctgcctcagcctcccgagtagctgggactataagcgtgtgccaccacgcctggctaattttttgtatttttaatagagacggggtttcactgtgttagctaggatggtctcgatctcttgacctcgggatccgccagcctcggcctcccaaaatgctgagattacaggcatgagccactgcgccaggccaggagtttttaacttgtatgccagttatccttcttaggagtgtgcaacattttgatcaggaaaaagatgtattttaggattcatattgtaaatcacagtgttaattcatagtgatatctgtcaagtggagtgttgagctgactggaagccacctgatgtactttggggataaaatttgctgcagctaagagatattaatagaatctaatgtcaagttcgtatcaaagacagatagtgtttattggaacaaagggtaaacttggacttgtggagagcctagacagaacagtaaacttctttgttgtaacacaccaaagggtgaccaaatagaaagtgtgatcatagaaagttttttcaagtttctaaattgggttttttaaaaccaatatttgcattttaataattccttttggtgtgctgctgaaaattttctattcagaagtgtaccagtaactcagaaactattgtacaacactatcttaaatgttaaattgtctcgtacttcatactgcttttgtcatccctttgtcctgctttaaaatgtagggtcatccaaggcaacacctacccaaggtcaaccctacagcacctacagggcagttcctatccagagaaagtatttgtttttgtaaacattgaataagtactttaagctttgaggtaaaactacaatggggttgttaaaggtattgtgtctatggtgatcatttcttcatgtagcctgatatgcagtgacttgcttctgtagccatctagcatctgaaggtactgcctgtcctctttcttcccagtgttcttttttctttttctttttttttctatgacacagccccaggaggtcctgaaaacacatgcccttccatgattcttatgcaaggtagttgtggattgggaagtcagaactactttctgaggggattaccttctttgggatttctcttgggttttgctgaggatttctacatggccattctgacagaagtgagaaacaacatttgtgctttattttctgagtcttctgaatgctggttgtttcacaaattatagaaataaaaatattctcattcagtagtaagagtctgaattcaaggagggacaggtaatacaatccctgttttccaggatggaaaaactggagctacagaagattaaagagctgtctagagatcacactgcaagacactgggaattggatctgggtcttctaactcatttgtagagtctgatgtatttcaggaagatgataccgaaggtcttcttttcagtctgagtctttttcttggcttgtaaattcaaggtacagtgccgggccttcagtgactggatgaaacattgtactgagaaaattgaaggcccttgccaaacatgtacaatgatggcctggaaatacaaactaccaactatatgctaagagaaaagaaacaaagtgttctgttcgggtttatagagaggaagtgtctctaatgcctcagtttttcaagtcctgtggagaagcagtagccgtacataggagcacagttccttttgtgtttgtttaaacctacaagaggagaaacaaatgatttttggcagtctgactagtaagcaagcagaatatgtgtcatctcgtcatccaatagatgtggagctctttgttcttttttttttttttttttttttaatagaagcaccatgttgcccaggctgatcttgaacactcttggccccaagtgatcctcctgcattggcctcccaaagtgctaggattacaggcatgagctaccccacctggcctctgtattctttttgtttgctttgggacatactgtaggagcagtgtttgtaccaaaagactgtctgatcaagggagatatgggatgcttgggggagggatatgaaaggagagatgggatggtggatcacagtggcttaataaaatgtgaaataaaaggcttgaagacctgtttttttttttttttttttttttttgaagacccattaaccaggagaaaaggggtctatctggaaggtatttgccacaactgacaaaggcagtccttttttttttgttttttttttttgagatggagtcttgctgtgtcacccaggctggagtgcagtgactccatctcggcccactgcaacctaagcctcccaagttctagccattctcctgcctcagcctcctgagtagctgggactacaggcgcccgccaccacgcctggctaattttttgtatttttagtagagacagggtttcaccgtgttagccaggatggtctcaatctcctgacctcaggtgatccgccagcctcggcctctcaaagtgctgtgattacaagcgtgagccactgcacccagccaaaggcagtcttttagaaggactgagacttacaagaggctaaaaaggaaatctcaaaattttcgactcatcattcatatatatatatagatagatagatagatagatagatagatacacatataaataatgagtttctaggtcccttggttcacctccattgtaagtgaatttagttttcttttggctgcagtattaagctgtgtatgttgtacatatgtggtcatgtttttgcacctacagggagaactttggagtcaaatctgtgttatataaggaaggagaagtgactactggccaaacaggaaaccataggagagcacagatgaggcttgcagattcagattcatgaggatgagtgctaccctgatgtttcagtgcctgaggcagggtgttgaagcagctccacttcaaaaagatatatttgaggagtaaaagttacttggggtatataggaattcacatatgtgctccattatgatttaatggaattggttttgtttttctgtgtagttttggattcctcagaaacttgaatcagaccaggaccctgttggcctcttgatccctttggggctctgcttgtgagtagcagcctccctgtacctccctcattgtggcagtcagagttcaagccctcattacaggaatgatcataataattatactactgaagataatagcaagaataatatatatgtcaggcagttctaaaagtttgacaaatattatctaatatccttaccgtagccttttgccgtgggtgctgttattgtctcctccctaccaaaaattactttattaaatcctcatctccatgctgttttatactttttcctctaactcttatttatttattcattcatcctccatcccattcttttcctctgtaccactgtgtacattttatcaagcagaaaagtgggaagaataatattactgacaaaagaacagtatgggcaaagttaagaaaatgcatggtatgttttcaaggaatgaccagcaactatctggcatagagggtacttgagggacagtggtaggaggtaaaactaaaaatatagaccctgggaacaaatttttgaggccctcaaaagtcatgccatgaggtttgaggttttaaagagggaagtggtagtaagtctatttttttttttcaagacagagtctcgctctgtcacccaggctggagtgcagtggcgcaatctcagctcactgcaacctccacctcccgggttcaagcaagtctcctgccttagcctcctgagtagctgggattacagacgcatgccaccacgcctggctaatttttgtatttttggtagagacagggtttcaccatgttggtcaggctggtctcgaactcctgacctcgtgatctgcccacctcgggctcccaaagggttggaattacaggcgtgagccactgcacctggcctgtaaatctattttatgaagtaactgggtggagagtgggttagagaaggaaaaacagtttaggattctgttacattagtctgggtgagagaggctggagttgggctttggctggagagaataggtaaccattttgatattttgtaaacagaaccaacaggattttggttattgaattggaagcactatgaaaaaaatgagaacaaagcatttttgtgttcagaaaaatgagacatgcgggggccgggcacagtggctcacgcctataattccagcactttgggaggctgaggcgggcagatcacctgaggtcaggagctcgagaccagcctgaccaacatggagaaaccctatctccactaaaaatacaaaaaaattagtcaagcatggtggtgcatgcctgtaatctcagctactcaggagactaaggcaggagaatcacttgaacccaggaggcggaggttgcagtgagccgagatcacgccattgcactccagcctgggcaacaagagcgaaactccatctcaaaaaaaaaaagaaaagaaaaatgagacatgcttattaaaaaaatccaataatactgaaaagtacagagacaatttaaccatagtcttagcatcctggagtaatgattttggttcacatccttccagacatttgtatatatatttaagcacatgtgtcatgtgtgtatatgttattacataaattgactcagaggttagatactattctattttcttttaacactatgttatggatatctttatatgttaatgtatatagctatatcagtagtctcaacttggggtgatttggcctcctaggggacgtttggcaatccctggagacatttttggttctaataactggggaggtgggttcctggcatctaatgggtagaggccagagacattgctaacattctagtaggcacaggacaacttcccataacagaattatttggccccaaatattaattgtactaaagttaagaaactgtcctatattattgtttttataattttttattgattgattgattgagacacggtcttactgtgttacccaggctggtttcaaactcctgggctcaagcagtcgtcccacttcaccttccaagtagctgagattacaggtttaattttgattttgaaatagttgtagatttttatttttatttttatttttttgagacagagtttcgctcttgttgcccaggctggagtgcaatggtgtgatctcggctcactgcagcctccatcccccgggttcaagcaattctcctgccccagcctcctgggactacaggcatacgccaccataaccagctaattttgtatttttagtagagatggggtttctccatgtgggtcaggctggtctcgaactcccgacctcaggtgatccatccgtctctgcctcccaaagtgctgggattacaggtgtgagacactgtgcctggcccgaaatagttgtagatttacacaagagtttcaaagatagtaccaagagttcctgtatacccttcatctaccttgtcctaatattaatatcttacatcatcatggtacatttattaaaactaagaaattgatataggtacaatactattaactaaattatagtcttggatttcaccagttttttcacttatgtcccttttccatttcaggattcaatttaggatactatactgcagttagtcatcatgtatctttagtgtcctccaatctttgacagttttcagtctttccttgtcttttacgaccttgatacttttgaagggtactggtcagctcttttgtagatgtctctccatttgggttttggtttctcatgattagacttggcattatggattttgggaaagtataccacagaagtgaagtacccttctcattggatcatatcaaagtatgatatcaacatagtattagcatggcttattactggtgatggtaactttgatcatttggttgagattgtatacacgtttctccactgaaaaagtcacgatttttctctttttgtgttatttttcttttccatttccataaaatgacagtacctagtcttatttgttggaaatcatttgccaagtctggcccacactgaatagaaggagaattaagcttcatttccaggatgaaagcttatcaaataatttgcggacatatgttaaaagcaccacagtaattaataaatattttaggggagataccctcaggctatgcagatgtcctatttctccttaaagtttcaccctctgattttagcattcatcagagtctttcttttctttctttctttttgttttcttcctttcttccttttccttccttttccttcccctccctcacttcttcccttcttccctccctccctccctcccttccttcctttctctctctttctctctctctctgtgtgtgtgtgtgtgtgtgtgtgtgtgtttagtacttcctgtctggtattacaagatgcttctagtccctttcagtggaaagagctaggaaatgtatgtatgtatattaatctatatatacacacatttatatttatttctctatctgtatgtatattaaaataagcatgggtttatactggtatctctgactaatccagcaccacaagattcattctagtcttccccccttgcttatttgtgacttctttctcagagtaagaaatttagctctcattccctatagtatatttacttatttgtgtaacctgtagtttcagtgattactcctgtgagaaacagatttaccaactagagtacaatgtttgcctacagtttgtttgtttgtttttatccttacagtatcgagtagtaacattgttttatgaagttacttagatcagctccttttgttttcctctctgaggttatatcagacgtttgtaatgcagttagatttcatttgttacagtctgtagtctatcctgggttcccagatattctggttattttaaaaaatttgcatacagtggccagctgcagtggttcacacctctaatccaagcactttgggatgccaaggagggaagattgcttgagcctagaagtttgagatcagcttgggtaacatagtgagagcccatctctacaaaaaaaaaaaaaaaaaaaaaaattagtcaggcctggtagcacatacctgtagtcccaatttctcctggctcaagcaggaggatggcttgagccagggaggtcaaggctgcagtgagtcatgatggtgccactgcactctagcctggacaacaaagcaagactctgtcccaaaaaaacatttttaaaaattttttgcatacatatagtaaagtgtactctttatgatgtttagttctatgggttttgacagatgcatagagtcagatatataccccacagtaccatactgaacagttctatcaccctaaaaaatcccttatagtggcccctttgtagtcaacccctctatctccttcaatctctggcaacaacttacctgttttccatccctattgttttgccttttccagaatgtcttaaaatgtaatcatacaatatgtagcctttgaggtttggcttttttcacttagcaaaatacatttttttaaaaggtagattgattgattgattggagacagggtctcattctgttgcccagggtggggtgcagtggcgccatctcggctcactgcagcctcaacttcctgggctcaagcaatcctcctacctcagcaccccaagtagctgggactataggcctgtgccaccacacctggctcatttttgtattttttgtagagacggtttcaccacgttgcccaggctggtctggaactcctgagctcaagcaatccacctgcctcaggctccgattataggcgtgagccactgcacctggccagcaaaatacgtttaaaattcttccatgttgttgcatgcgtccaatgctctttattgctgagtagtattccactgtttggatgtaccatagtttgtctagtcaccttttttttttatgagacggagtttctcccttgttgcccaggctggggtgcagtggtgcaatcttggcttactgcaacctccgcctcccgggttcaaatgattctcctgcctcagcctcccgaatagctgagattacaggcatgtgcgaccacgcccagctaattttgtatttttagtagagacatagtttctccatattggtcaggctggtcttgaactcctgatctcaggtgatccgccctcctcagcctcctaaagtgctgggattacaggcgtgagctaccgcgcctggtgtctattcacctattaaaggacatctgggtttctggtttttggtgattataaagaaagctattgtaaacattcatgtacaggttttagtgtgaaatttcatttgagtaaatacctaagagtgggattgctaggctgtttggtaactttatggtttaactttacaggagactaccaaactgttttctaaaatgactgtaccattttgtatttctcccagtagtgaatgagaattcgtgttcttctgtatctctatattatttccagcatttggtattgtcaggcttttttttttttcttttaatttccgcagttctatgtactggtatctcattgtcgttaatttacatttccctaaagaccaatgatgttgagcttcttttttttttttttttttttttagtatttattgatcattcttgggtgttgctcgcagagggggatttggcagggtcataggacaatagtggagggaaggtcagcagataaacatgtgaacaagggtctctggttttcctaggcagaggaccctgcggccttccgcagtgtttgtgtccctgggtacttgagattagggagtggtgatgactctttacgagcatgctgccttcaagcatctgtttaacaaagcacatcttgcaccgcccttaatccatttaaccctgagtggacacagcacatgtttcagagagcacggggttgggggtaaggccatagattaacagcatcccaaggcagaagaatttttcttagtacagaacaaaatggagtctcccatgtctacttctttctacacagacacagcaacaatctgatttctctttcctttccccacactttccccccttccacttgacaaaaccgccatcgtcatcatggcccgttctcaatgagctgctgggtacacctcccagacggggtggcggccggagagaggggccccccacctcccagacggggcagccaggcagaggcgccccccgcctcccggacggggcggctggccgggcagaggctgtcccccacctcctggagggggcagctgcctggcagagacgctcctcacttcccagacggggcggctgccgggcggaggggctcctcacttctcagacggggcggccgggcagagacgctcctcacctcccagatggggtggcggtcgggcagagacactcctcagttcccagatggggtcgtggctgggcagaggcgctcctcacatctcagacggtgggcggcggggcagagacgctcctcacttcctagatgggatggcggccgggaagaggcgctcctcacttcccagactgggcggccgggcagaggggctcctcacatcccagacgatgggtggccaggcagagacactcctcgcttcccagacggggtggcggccgggcagaggctgcaatctcggcactttgggaggccaaggcaggcggctgggaggtggaggttgtagcgagccaagatcacaacactgcactccagcctgtgcaacattgagcactgagtgagcaagactccgtctgcaatcccggcacctcgggaggccgaggctagcagatcactcgcggttaggagctggagaccagcccggccaacacggcgaaaccctgtctccaccaaaaaaatatgaaaaccagtcaggcgtggcggcgtgcgcctgcaatcccaggcactcggcaggctgaagcaggagaatcaggcagggaggttgcagtgagccgagatggcggcactacagtccagcctccagtctgcatcagagggagaccctggagagagagggagagggagaccatggggagagggagggggagggggagagggagagggagagctttttttcagacagagttttgctcttgttgcccaggctgaagtgcagtggcacgatctcggctcactgcaacctctgcctcatcggttcaagcgattctcctgcctcagcctcccgactagctgggattacacatgcctgccaccacgcccagctaatttttatatttttagtggagacggggtttcaccacgttggccaggatggtctagaactcctgacctcaggtgatccacccgcctcggcctcccaaagtgctgggattacaggcgtgagccaccacgcccagccagtgttgagcttcttttcatatccttatttgccatctgtatatccttggtgaagtgtctctcagatcttttgcccacgggagtggggttgttttcttattgatgaattttaagagttttttttttttttttttgagaggaagttttgcttttgtcgcccaggctggagtgcaatggcgcgatcttggctcactgcaacctccacctcccgggttcaagtgattctcctgcctcagcctcctgagtagctgggattataggtgcttgccagcacgcctggctaattttttgtatttttagtagagatgaggtttcaccatgttaggcaggctggtctcgaagtcctgccctcagatgattcacctgcctcagcctcccaaagtacagggattacaggcgtgagccactgtgcctggccaagagttctttatatatatcctgggtataaatcctttatcagatatgttattcgcaaatattttctcccaatctgtggcttattttttcattctcttcacagtatctttcacagagcaaaagttctacatttttataatgcctaatttaatttatctttttttttcttttatggatcacgaggtcaggagatcgagaccatcctggctaacacggtgaaaccccgtctctactaaaaatacaaaaaaaaatagccaggcatggtggcgggcttctgtagtcccagctacttgggaggctgaggcaggagaatggcatgaacccgggaggcggagcttgcagtgagccgagatggagtcactgcactccagcctgggcgacagagcgagactccatctcgaaaaaaaaaaaaagaatcttgaaggggttcagtgtgtggtagctgtcttttcctcagtttctggaatttaatttcacctcagtaggaattcattacttgaagcaaacaaatataccagagtcaaatggggataaaaattctagtgagtggcagcagaaatagcttgggttataggcagagcagcctggcattagtcctgtctctgcttccagccagttatatggccaggggagcctgagtattctcgaatataaaatgttgggtgtttggactggatgcagagcttctccagtgtttgtttgcaggtggactccaagcagccactgcagaagctctgtgtcgcagtttctcatgttttaacttaaaaatatgtgccaattttgcattctctgccctaatgtttgtttagatgtaaaaatgtttcaattttttttttctgctacctagtaagattgatacttcagaagaatgtatcacatgtatgttatacacatctcagtttgaaaactatggccttggccaggcgcagtggctcacccctgtaatcccagcactttgggaagccaaggcgggcggatcacctgaggttgggagttcgagactagcctgaccaacatggagaaaccccgtctctactaaaaatacaaaattagccaggcatggtggtggatgcctataatcccagccactcgggaggctgaggcaggagaatcacttgaacccaggaggtggaggttgcggtgagccgagattgtgccactgcacttcagcaagggcaacaagagcgaaactccatctcaaaaaaacaaaagaagaaaactatggccttatatgattctggtcccttttcccttaaagagaagagccgtaggaaagaataaaagccataatctgcactataaattccaaaccatgagtctcatcacactgactcaacagatcaggcacagattctcctgcttttttattttattttttgagacagtgtctcacttcaggctggagtgcagtggtgcaatcatggctcacagcagccctgacctcctggctcaagcagtcctcccacctcagtctcctgagcagctagaactataggcacgtgccaccatgcctggctgattaaaactgtttttttgtttttgttttgttttttttgtagacatggggtctttgtgttgcctaggctggtttcaaactcctgagctcaagcgatcctcctatcttggcctcccaaggtgttgggattacaggtgtgagccactgtgcctggccttctcctgctttctgagcatcttaatgtgtccagtttattcagcatatctacagttgaatttctgccagagttgaaaagagtaattgccttgatgttcctgcagcaaacttattagtcctaacctactgaagttatgtttaaaaaaagttttcttttaattaaaaaagtaaagtgagtcaagaaatcagcctttcccgtactcttcaacatctcttcagttgaatttgtctaaaggaaaatcaacttcccagtgagtgtcaacatctttaagaaaataatttttcctttcatctacctatgctaaaactatcttttctcccgaagcttggactattaaaactagaagaaattagctgggcgtggtgacaggtgcctataatcccagctacttgggaggctcagataggagaatcgcttgaacctgggagggggaggttgcagtgagccaaaatcatgccactgcactctagcctgggagacagagactctgtctaaaaaaaagaactagaagagatgttagatgtgagaaacttgaggttccagaagaaaaacttgaccttcctccttccttccttccttccttccttccttcctttcttctttccttccctccctccctctctccctcttccctttcttttctttttcttttcttttcttttctttcttttcttttccttccctttctttcctccctttctttcttttccttttccttctttctttccttttcttcttttctttctttttcctttcattccttccctcccttccttcctttctttttcttttctttcctttatcactctcttctttcctttatcactctcttctttcctttctttcttgtctcgttgtgctgcccaggctggagtgtagtggtgcaattatggcccactgcagctcaccctcttgggctcaaatgaccctcccatcttagcctcctgagtagttgggactacaggtgcacaccaccatgcctgactaattttcttttctttttttttttttttttttgtagagacagagtctcacaatgttgcccagctggtctcaaactttgggctccagtgatctgcctgcctcagccacccacggtgctgggattacaggcgtgagccaccatgcctgatgagaatccttactgttaaccacttttctatatgctatgtgcctctcaatgatggaatgtccactagacagttgaatatacaggtctggcaccacaaaaagagaactagattgtggatatggattttgggagttatcagcacaacagtggttgtagaagccatgggtgtcacccagagaaagttcataatacaaaaaggcagatggatgccataaagactgccatttctcaatattgtttcctgacagatactgctaatagatcagtggctggcctcagtaaagtagatggaggaaggcctagtgggataggaagaaaaacctggaaagaatggtgcccttgaagccccaaaggggagtgattatgaaggggagagagctcaatagtatcagattgttgctttttccattacttgctttgagagcttagtagaaaagtgttatatttggcagtcagtgttcattaatgatctcagtaagatatccatagggcagtggagggcagcaagcagtgattatattgagccataatccaaggttgtggttttcaaggcaggtgtaatccattgaggcaagaaagtgattgaaggactttaggatctaatttgaaatgggaaggacataagtgaaaaggtggaagataacttgcagggaaggaaccaaaccagggggcagcttttccttttgcttgtagacagctatgttgggacatcacagccagcactcagagctctgggatctgcccactgccacggacactgctgctgattagcacactcagggccaccctacagcaaggcagcccaaaaggatggagccttaaaaggatgggatctttggctgtacacgtaaaaaactggggggagtatctgcaaggtgaaatttctttagatcggggtttctcaatttcaggactgttgacattttggggccggataatttttttttttttttttttttgagacagagtctcgctctgtcagtgcagtggcgcaatcttggctcactgcaagctccgcctcccgggttcacaccattctcctgcctcagcctcccgagtagctaggactacaggcgcctgccaccacgcccggctaatgttttgtatttttagtagagatggggtttcactgtgttagccaggatggtctcgatctcctgacctcgtgatccacctgcctcagcctcccaaagtgctgggattacaggtatgagccaccgcgcctggcctggggatggataattctttgtgtttggggctgaaggctagaccagagtgcatcattggatgtgtagcagcatccttggcctctaccctctaaatgctagtagcacccccagccctgcagttgtgacaatcaaaaatgtttctggctgggtgcagtggctcatacctgtaatcccagcactctgggagaccgaggctggcagatcacctgaggtcaggagttcgagaccagcctggccaacatagcaaaaccccgtctctactacaagcactagccaggcgtggtggcaggtacctataatcccagctacttgggaggctgaggcaggagaattgcttgaacctgggaggtggaggttgccgtgagctgagatcacaccactgcaccccagcctggacattgccagatgtctcccagtgaacaaaatcacttgaattgagaaccatgggtctggattctgctggttttcttcttctagttctctgttatggatttctttttttgttttttgttttttccatatcttttgttgttgttgttgtttatagtttttttttcatatctctttttttttttctctgttgtagatttcttttaccttcattagttcctccaggcatttcagctctgttgatttggagagttcaggttatttcagcgttgtaccatttttacaaattttttttttcagtgtggaaataaaccatcaatagaggtgcaacaaagtggtatatttttctataatgcccaatttaatgcctagaacattaaatgtttagtggttatacactcttgtatcatgtatcttctttaattacagctatttgtgtctaacttggactctgaggactaggactctttttttttaagagacagggtcttgctctgttgcccaggctggagtgcaggggcacctttttagctcactatagccttggactcctgggcctaagcagtcctcctgcctcagcctcccaagtagccgggaggcacgtgccaccacacccaactaatttttaaatttttggtagagatggagtctcactatattggccgggctggtcttgaactcctggtctcaagtgatcctcctactcagccttctaacgtgctgggattataggtgtgagccaccatgcccgtccatgggactttcttaatcttcttttcataactaacatgttgcagtatacctaacacatagtagacgcttagtaaatgtttgtagagataagtcaattatgttagataattgatgaagtggattaaacctggaatttttcagaatatttcagtcatcaggccttacaaagaagccagttgtcccttagttgtcaaaatatggtttgtgcagagaaaagcatttcattccaaatcatttccatgcacacagatcacaagtatcctttgggagaaggggaaatggagcagagtggcatgctgtctttgaaagataacacagatccttttggctcttcccagcattcaggctgattgtaggtagagtgatgctgaaactgtaattgaagctgaaaaatagggtaagtgtaagagattcagctacaaatctcacatgtgaatgttttctaggctggtaataaaataataagcctgattgtggcatttagagcatggatgtgacctaaacctctggaccaaatgtgatacttacaaaattgattaatttctaagtttgtttagatatttatgcctggtacaaatgtgaaaaatgttgtgtttttgcttcttaactgtgcagtatgattttatttgataaataaaggatacccataaaaacacataattaataactgtacagctcaatacaataataaaaagttaaaatatctgtgtaaccacaactcaactgaatttcaattcaagaaacggaatatcacaagaaatagaacattaccagctcttaataattttgaaaattttatttcattgctgctattcactagtttcttattgtgcctaaaagctatcatccaagtctttttttttttttttttaaattgtgatataacattgaccattaaccatttcggtggccattttagccatttcagtatttcagtggcattaagtacaatagcattgttctgcaaccattactaccttccatctcaataggtttttattttcttaaaatgaaactctgtaccagttaaacaataaatccctattttcccctctccccagctcctcgtaactaatattctactttgtgtctctatgaatttgactactctaggtacttcatatacatgagatcgtacagtgtttgtccttttgtgattggcttatttaacttagcatagtatgttcaaggttatccatgttgtaggatgtgtgataatttcatgcctttctttttttctttttcttttttttttttttttgagacagagccttgctctcttgcccaggctggagcgcagtggtgcgatctcagctcactgcaacctctgcctcctaggttcaagcaattcttctgtctcagcctcctgagtagctgggattacaggtgcctgctaccacgcctggctaatttttatatttttagtagagatagggtttcaccatattggtcaggctggtctcgaactcctgacctcaggtgatccatccacctcagtctcccaaagtgctgggattataggcacgacccaccgcccggccaacttcctgcctttcttaaggctgaataatactcatttgtatgcgtagaccacattttgtttgtctgtttatctgtggatggatacttgaattacttcatcttttggctattgtgaataatgctgctgtgaacatggatgtgtaaatatctgtttaacaccctgctttcaattcttttgggtatgtacctgaagtggaattgctaagttgtatgttaattctgttttattttttgaggaactgccatattgtttttcttccagtttttgttgttgttgttgtttttaagttctagagatcgggtctcgttatgttgcctaggttgattttgaactcctgggtctgcctcagtcttccaaaatgttgggattacaggcatgagccaccttgcccttcccgaaactgccatattgttttccgtaatagctgcatcatcttacatgcccctcatcaatgcacaagggttccagtttctctacatccttgccaacatttgctattatctgtttcttttttctttttctaatagccattataatgagtgtgaagtacatccatgtcttttttgagacagagtcttgctccgtcgcccaggctagagtgcagtggcaccatctcagctcactgcaacttctgccgtccgggttcaagcgattctcctgcctcagcccctgagtagctgagattacaggcgtgcgccaccacgcctggctgatttttgtatttttaatagagacggggtttcaccatgttggtcaggctggtcttgaactcctgatctcatgatctgcctgcctcggcctcccagagtgctggaattacagatgtgagccactgcacgcggcttttttaaaataaactttttgtcatggaaatttcccaacatataaagaaagaagggcaaataatgaaatgaactacccatatatccatcacctagagtcgataattatgaacacttggccaatcttgtttcacttagagtttgtctctcctttccctattgttgcaatgcaggtcacagtcatatactttcatttattgtactttaatgtactgtggtacaggttgagtatccattatgcaaaatgcttgggaccagaagtgttttggtttcctagttttttctgattttgtaatatttgcattatatttaccaattgagcatcccaaatctgaaaatctaaaatccaaaatactccagtgagcgtttcctccgagttgtgtgtttggtgctcagaagttttcagttttagatttagttaacgactataaaacatacccataaaaccatattatatgtaaatcagatgtctagtctgtatcacccacatctttatgacccatttcttttaatctgaatgtgtaagaggcaaagagttaacagactacccaaagatgacaatttatattagtaaccaagatttagtacttttatgagttacagtttttgttaactatgagtaagagctctgctttctttaaaccattaatactcttttcttcttcctgatatttggtggcatttgtattatctatcataagcagtaccataggccacttcctttagtaaataaggtgagctagctctgggttaccttctgtttgaattatatttatgtgtccgtttgtttaagctcaccattttaagggcctctagaagatacacctaaaggcagattacaggaagaaattttatctagccttctagggtttctgatagaaggtgctggtagagatatttacattttgtccttgttggaggtgtgggtaattgtacatttgcagctatgcatttgacactgattaacattaatctcagtgtaaaaatttagaatcctttttactgtaacatacttaacaggatttagaaatcctctactagcaaaatcaagttgttgctatgtgagctctttaaaatgggatcatttggaattctaagctacagcagagccaaccaagggctgtgagaaaaagagagagagagaggaataaacagttattattaactcttttcctccctttagttttcttttctttctttctttcttttttttttttgagacaaagtctggctctattgcccaggctggagtgcagtggtatgatctcggctcgctgcagcctccgccttccaggcacaaggatcctcccacctcagcctccccagtagcggaactacaggtgtgtgtcaccacacctggctaatttttcattttttatagagccgcagtttagccatgtctcccaggctggtcttgaactcatgagctcaagtgatccacccacctcagcctcccaaagtgctaggattacaggtgtgagtctccgcacctggcctctttcgttttttttttttttttttttttttttttttttttttgagacggagtcgagtctcactctgttgcccaggctggaacgcaatggcgtgatcttggctcactgcaacctctgcctcctgggttcaagcgattctcctgcctcagcctcctgagtatagctaggattataggcacacgccacgacacccagctaattttttgtgtatttttagtagagatggggtttcatcatgttggtcaggctggtctcgaactcctgacatcgtgatccgcctgccttggcctttcaaagtgctgggattaccggcatgaaccactgcgtccggcctcccctttagttttcttaatgtgcatagaagacaccagtgtataataaccatatgaccttgtataacattagaaggaagtcttgttcaagatacacagaaaagaatactctatgatttatgattccattaattttcaggtatgagaatgtgagtctgctgtcaggcacaaattaaatgagttaaaaaggcagagttgatgctttccttatggctcttatttacattattttttatttatatgctgttttactgtttaccgattttatttcattgaagatagcttatatccttgcttggtaaatgacctcagtcactaagagcatagagccttctgagtattaaacagtaacactaaaattatttccctttctcctttagttattgtgatagtagtagtgataatgatagcaattaggtaatagtgaccctcaatgtggcccttaaaatgtgccaggcaaaaactaagtgctttttagtagtaactcatttaatccccacaacaaccctatgaggtagatattattattttcattttactgatgagagattgaggcccagagaggttagtaactgacttcttcaactacgaataactagtaagtggtagagctaggaaatgagctgaggcagcctggcgccagggtctttcctcctaaccattacactgtactgtacttatttgacacccgtgtaagtaaagggaaacgtgagataaaaatgcttttaacatctttgtgggctctacggaacttattatttgttcattcagtgctccctgtagaatcagtgattacagagaacatttaatctcaaagtattcatccctattttcaaactggtattttcagatctgttcttggagaccttgcatttagaaaaagtacacttgaactttttagtcgaattggcagatcaagagctcacagacaggatattgcctttgagtatttagattgtccttgctgacccctgaagcagtaattttgatagatcacaatgtttccactagagtacagcagtattaggggttctgacttcaaagtgtgtatgtgtatgttttatatgtatttttgtagactccttctccacaaatggaaccaatcttacacaaattctgaaaaccttttagagctatttaaatccaagaaatacctaagcattttgaagtagaactatgagcaatgaatgcaaatgttacctttctggagtcttgtgataagtaaaacaacctgcccaattttcagtgctttaaagttctggccatgcagaattcgtttttactaattctgggcatgtatttacatatccttcttacctttaaatctgagctaatagctactatttgataagaaaaccaatgctgtattttcttctttctttgttttgggtttcgtggatctggctgtgctgtttgttagaatacatctaccctggtgctttgggtcagtgaagtgtttggcaggagggagaaatagatcaaaatttctattcattaagtatgcatcttttatggaggtggttgactttctcatgttaattttctttcccctaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgatatccttaggaaaggcagcagctgggtttggtgggtgaaagcagcccaagccaagagagaagttttctttctagtggcaatttcttctcagaaggggcacccaaggcctaaatactgatggatgccatccccatcagactatggactgaaagatacagtgtctttgtcacccaaattcttgtccttagactgtggcatcatcattctctgggaacttgttagaaatgctgattcttgggccccactccagacctactgaattagaatctgcattataacgggagtccccagtgatttatatacacattaaaatttgagaagcactgttttagtgataagaacaccaatttaagaatcagaaaatttgtgttacagtcctagaactgccttttttaccatgtgaattttactgggtaaagcatttccttaaccccactgagcttcggttttctatcctttaaatggagatacgaagttaatctataaatataatggagttatagttagaatttcaaaggggttgttagatgggagaggactggaaaatatagttctgggtaaaaccaagaaatttttgcaaaaagaataatataagggggattgcccttatgtcttaacatgcagactgcctttagtatctggattgctatatattaaaagattgaaaagtcataataattataatagcatggaacttatttagtactagatatatttgtggcacagaatagaaaacccagatatagattcaaatggaggtacgtgaatttttttttttttttttttttctcctagagacagtctcactctgttgcctaggttggagtgcagtggcaccgtcatggctcattgccaccttgacctcctgggctcaggtgatcctcccacctcagcgtcctaaatatctgggactacaggtgcttaccaccacacccagctgattattttcattttattattattattttttgagacggagtcttgctctgtcacccaggctagagtgcaatagcgcgatcttggctcactgcaatctccgcctcccaggtttaagtgattcccctgcctcatcctcctgagtagctgggactacaggcacatgccaccacacctggctaattttttgtatctttggtagagacggggtttcaccatgttggccaggctggtctcgaactcctgacctcgtgatccacctgcctcggccttccaaagtgctgggataacaggcatgagccaccatgcccggctattttattttttgtagagatggattttgctatgttgacaagctggtcttgaacccctgggctcaagtggtcctactgcctcggcctcccaaagtgctggaattacaagtgtgagccaccacgcctggccccaatcagccttcttgattcgacaggtgaaggtactagatactgaggcccaaagagtagaagggtgtttgctcaatatcacagtcatttcatggcttgcacaaataagttaaaccttttcccgtgaagtatgtcctatcccatcttctttcctctttccactctctcctcttctggaatcttaacatttttcccttccccttttcatttctttgctcactttccctttgttaatcatactacaggttgaacatctgaaaatctaaaatccaaaatactccaaaatctgaaacttttggagtgctgagatgatgctcaaaggaaatgctcattggagcatttcagttttcagattttcaggtttgggatgctcaaccagtaagtataatgcaaataattcaaaatctgaaacatttccttggtcccaagtattttggataagggatatttaacttgtgtataattgacattttatcttactgtggaaattgtatgctccctatacttaatttaaagggggaaatagagaatttgttttctctttttaaagcaaacagtgttttttctttatgatccttgattggtaacatctttcttcccaccctgccttagccgcttaagggttagtgggattctagtagaaaagaggtggtctgtctctatgcctgcagattggctggcaaggagaaatgtgtaaatgattatttacctggatattgaaagtcttttaaaaaaagttattttcggccaggcacgatggctatcgcctgtaacctcagcactttgggatgctgcagtggatggattgcttgagctcaggagttcaagatcagcctgggcaagtaacatcgtgaaaccttacctctacaaaaaatacaaaaattagccagatgtggtggcatgtgcttgtagtcccagctacttggtggcgggagctgaggtgggaggatgactcgagccctgggaggttgaggctgcagtgaactgttttcgcgccactacactccagtcttggtgacagagtgagaccctgtctcaaaaaaaaaaattattctcaggagcaaaggccgccttaaagcagataattatctgttcaacggagattctaaagagaaaaatttaaagtagcagagatgaaaaaacaatagtggctatagtaaattgagtgcttactattttttaggcattgtgataggggatttctatgaattgtcacatttaaggctcatggggatttttacaggtgagaaaactgaaactcagacaggctgagtaattgtccaagagctgaacctggaaattgaagtctatttatcttcagaacctgtgcatctcacttaatttggtcaagcctcaagtggcaaaatgtgatagtctctccatgatggtagagactgactaagtctaagaaccttagagaaaccagcttgtgttttgccttagaaggcaaagtcatgcaatggatgtcaccttgatggcctcctgagcagctgacacttggttctgtgagagtccttgggcttgtgcttattgaactgatttggaatactaataaaactttgacttttagcagcaagacctagaaagttctagaactggaaggaattaccactatgcatttgtctctggtttctgcaagtccctccagaactgattggacatgattctggaaatttgttggaaacactgagggctggtatcaacgcattttggttcccaccctttctcctctgctctgcagataaatgaatgtggtttcttgctaatggtgtccttccaaagtgagtcaggattctcttgatatcgtgatatctttcttaatgttcacattgaagatatatttgcccgagacaaaattcctattgttgtgggaggaaccaattattacattgaatctctgctctggaaagttcttgtcaataccaaggtaagtttagttcactcgtaactcactgaggaaatggattgctctttcttgctgtctaatttcagtgggagaaaggttgactcttgcctatttcttatacccagcaactataattttcctacttaatattctcaagcaaatgccacctccatgtgtgaagtgtgttcctccaggctggtctatgggaaggggctctgtgtgggaaaaatgttgctgtgtggattaattagcatctccatataaattaacagttcattaggccaggcgtggtggctcacacctgtaatcccagcactttgggaggccaaggtgggtggctcacctgaggtcaggagttcgagaccagcctggccaacatggtgaaaccccatctctactaaaccccgtctctactaaaaatacaaaaattagccaggcatggtggcacgcacctgtaatcccagctactagggaggctgaggtgggaggatcacttgaggcttgaggcggaggttgcagtgagctgagattgcgccactgtactccagcctgggcaacagagcgagaccctgtctcaaaaaaaaaaacagatgcgattcaagaaaaaaatatgtataattctttagaaaaattatattaaaaaaaacccagtacgttagccattagcctgattcagtatttcctggctggcagcacagtatgtatattagggagatgtccaacactgaccttatttacgtaggtgctactatgtagggtaagactgtgtaaactgtaattcactggcaatcctggtctccttgttcacccttgctgagaagactagactcctggatatgctaaaatagacatattagccctggtacctgtttgaacttctgacagggaagcaaatagccaggtgtttccctatgctgtaagtcttctgtcttttttgtttgctgtggcctcatagcacttaccacagcatattggaattttctgtttatgatctctcactatatggcaagatcttctgattattctgtattcctgacagttagcaaagtgcctggcacatacactgtctcagtgttggttgaattaaatatacttctaaaccatcatttaatagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggtaagaaagcctggcgcgctgaccccaaattcctttacaactagagagcagtcagttcttcagtttgcccagatgatgagagagatttggtaatagcagttagtggagattgatgtgttgttctagctcagcaggttgggaggccctgagttattgcttcagttcaactccctcaataaataattgcagcctactttgttacattttaaatgcatagtacaatatcgttttcccctagggcctatataatgttgcttcattttctatttgatctttgcttgtataacagttttcatatacattttttctggcatgcagtttgtttacattgtgatttgggtttcataactgattatgcaatgccgtgttctgccccagcagctttcccagtgggaggtggattttattaactgtctcacagatcagctcacctttgcacatggaaactatctggtagggaagagaggtagtgaatgaactcacaaggtcatgtttttttaggttgttttggaattgcagcctcatgttaggtttatttttctgcagtattaggagtgataccacttccagcatagtagaacatctaatgaaggacctgttctattgatggttatacagattaaatattaaagtaacatctcatattcataggggttgtgaagtattccactcaaatgaatttgatatttttcctcctaattttacccccctcagtgaaacttaatgttagaatataggatttaaaacattcattattattattactttttttttttttttttaagagatagagtcttactttgttgcccaggctggagtacagtggcacaatcatggctcactgcagccttgacctcctgggctcagatgtcctcctgcctcggcctcctgagtagctgggactacgggtgtgcactactatacctggctagttttttaaatttttaattttttttagagatgttttgctgtgttgcccaggctggttccaaactcctaggctcaagcgatcctcctgcctcagcctaccgaagtgctgggattatagtcatgagccacagtactcagccaagaaaaggatttcttcaggtagggttgtcctttgcacggcaggggggtggggcacaaattgtaatatctaagttttttcacccccttaaaggcaatgtataacctcattaagaatgcatgttttagattaatgaagtttatacttttcagtatccaaacattttaaacactttaatagaaaacattcaattttttttaaacctaggaacattatgataaacattcatttttatattgttttattacatgattctagagcttggtgtttattctctccttttactaatcagttctttcttatcacttctcattttgctgcgtctaaacgagtaatgagtttgagaattttttcttagtaagagtcaataggttctaagcaagagctctagagtctcatttagagaatgaggactttctttttttttaatctttcttttggcttgaggctgtattttaactccagataagtgagatatctattactacattttttctcatagatcttctttgagaaaccagtgatactgaaagacaagggggtctacactcttgcgttagggtttcaggaagtagaattgggtcaggaagagaaagatcactttcaggctgataagttgcaatcacccagagtggtagagtgtagatttgggagttaaattacctagtgctgcataacataatagatacggacagaagtggatggtggcttaagaataagtatgtgagttcttttctcagtgatctttgtgccagtagagcactggattagccaggagcattcttcattaatttgacatatttaaaaagaaagctgatgagctggatgtacaacatgcttttgtactgtgggaaaggcacgccagccagaccagacttgttggcttgttacaaagtgtcccaaacaagctcttttactgtttatctgaaagtgagtgagtaccattctgtttgtgtagaagaaacctgttgtttctgaacctatttaactgatttcagaataatttatatatctttagaaaaataatattatttcttactttacctaaagttttctttagtacccttttctgagtagctgtaggactggagtaaccctagaccttcatgtcttttggaacttaatgcagtgaaaatgagaataagcctttctgcatgccccctttttgaagagacagggtctgttgctgcttaggttggtcttgaactcctgagctcaagcagtcctcccagtttggcctcctgagtagctgggactacagatgtgcacactgtcgtgactggctttcaagaaagaggctttctgtaataaacagcctttctccttgttttacttgagaatgaatattttctattggtttttatgggtgtgccccctccctccccttttaaattacttaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcaggtaacagccctttgatgccctagagtccatctgtgatggaacttggagtaataagttactgtatagaaaatgctgagaaccatgggtggctcataataaacactaaacaagtattagctattaattttattatcattatcattatttgttggcttaggcacagtgccattcccctagatatctgtttggaaagggagaaaggatagccctggcattaggagaagacatcacaggtagagtgggatgggatggacggaatgggaaagagactgccatccagggaaggtccaaaggagaaaaagaaggcagtctcttgtggaaggttggctggaggctagaatgttctagaagcagtatgccttataattagcttgctagcctgatggtattttgttgctaaagtataattatgtccgtgatagtagtaacttattcatccagcaaacattcagtaagcattcaatgaagtgctgggtattctgtgtggtacttcggtttcagagttgaagagacagtgcctttccttaaggaattcccagtctagtgggacaacagacaaggagatagatactatctgtctgtctattatttatgtgataaatgctgggctagatatattttcagagtgctgtagggccacagagaagggatgacgaatattatcttggggggagtcagagaccagtttgcaaaggtagcctatgataggcctggaaagatgacatcattatgtggacaaacagtagagtgtagcactgaagagcacaggctcttgaggcagactgtctaatagcaaattcctgctccactagcttctagttatgtgaattgttaagacaaattagtttacctttctgtttcccaattctcctgtaaaatagagataatagtaataacacatatttcctagcttcatcaaggattagatgaattaatacatatatagtgctcagaatgtgcctgacacatgacgggtcctcaataaatgcaaactttctaggaaggttactgttgctgtaggccaataaatcacaatgatagagatgtagaagaacataattaaaatggtgacaatctgttgttaaattaatctgccataaattgataaaaaaggtaatttttcaataatgaaattttataaacaaaaacttttactctacaggcagcataaaataatggtatctgattcatagtaaagctgtttgtcacatctgaacaattacgacctctcactctttgctcctttgcttggctcagtagtttagaatgtatctaggatgtcttttttttttgtttgagacagagtctcgccctgttgcccaggctggaatgcagtggtgcgatctcggctcactgcaacctctgcctcccgggttcaagcgattctcctgccccagcctcccaagtagctgggattacaggcgcgcgccactacgcccagctaatttttgtacttttggtagagacagatttcactgtgttggtcaggctggtctcgaactcttgacctcgtgatccacccacctcggcctcccaaagtgctgggattacaggcgtgagccaccttgcccggccgtatctaggatgtctttggattaaagttccatgttcttatccaaggtgtcatctaggggttcttaaacataaagtaacactaagttgcagtataatgacatattaaattaaaaataagaaaggtaaaccaggggatcctcagccacctctaaaacacattccatatgagaataaaatatttgtccttcacagttgctgtaattgtatgctttctctatataatgaggaggcatgtgcttcattctgactatgcttcatttttatttggagttgcaaagtcttaaatgtgagtaacgtatgaattattataataatctttggaatctgaattctttcttccgtttggacaaattctctttttttgtgaccacctgttcactcgtcatgtaagtatatagtaggtacctacaacttgcttgctggttgatgggctaatttgattcaagttctagatgagcgcttggataagagggtggatgacatgcttgctgctgggctcttggaggaactaagagattttcacagacgctataatcagaagaatgtttcggaaaataggtgaggatttggctgttattctgacctactgtccatattttgcagacaatcaaaagaccataacgctaatactggctttgggtctacttgtttatcagccttctttgcagatgcagttttttaatctttcagacagtcccaggagttaacttttcaagaaagtaacctggtgggtaggggaggggaaaatttcagagaatcagtaactgctcaggatctcaatttccttatctgacagatgaaatggctcaactaggtccatctccaaagcccctgctagcttttaggagcaatggcttatctgctgataccctcctgttcccagccaggactatcaacatggtatcttccaatcaattggcttcaaggaatttcacgagtacctgatcactgagggaaaatgcacactggagactagtaaccagcttctaaagaaaggtgtgaattcttccatctaatctagtcttggacatctttgggtggcagggtactctgctggtatggtctgagaaagagccaaggcttaaagcgtcccaaatagccttcagctcagaactgagatttttgtccaccaagtctgacattgcactgccgtggctgactttttcctgctgggctgggagggcctgcctctctgcagggtaaggagtgcttacctagatgttcttaaatctactgtatctttcaggtattgaggctctgaaacaagtaactaagagatatgcccggaaacaaaaccgatgggttaaaaaccgttttttgagcagtaagtctcatgtttttctttatcctatgggtctgttttcaatagaatatagatgtcctcagctcacccagaaaatgaattttagattctgggcctgttctaagattttggatctgacctaagggaagttctataacataaatgattatccagggatattttcttgggatgtcacaaaaaaaaaaaaaattatttgcattgaggagtctgccttctgccttgaacagatggatactggctgcaaacagctaagaagaacagcagcatcttttttggagagttggtgttcagggctgatttttagcttcagttttgtacctgaagagcagtcagatttctgtagggaagatttcctaattacagtgtttttggggggccagatgagttgtataaaaagacaccttcaccatttctcccagcgtctccacatggtgcttcagattgcttcaaatgaaactttagttgaacagcatttttgagggaaaagaaaggaaattctcattgatttggccctgtactgtgtctttggcactaaatttggtgttatacatatattattgagtcttcaaggtaggtgttattcttttatttttacagataagaaaatgaaggcctagtgaagttaaataacttgccaaaaatcacccagctagtcggcagtagataactgaatgcaggcctgacacagagtccacactcctttatactactcttacttcctttagctgtaactttagcaagacagcattagtattggaccatgggtaaaaactatgtggttatgagctaaaggagattaatttaagcataagtgaaacttcagttttatcttgtggacatgttttaaatatgcttctgaatcatcttgtgtttaccttttgctggtagacttctgctctcaattacagacagggccagctgaagcctctgccccactcggtgcctctgaaaatacataccttgatccctgctgttgaccactaaactgctaacattctttctcccagctcccactctctgcctgagctctccagtggagttctggtgtgaagaggcttgttgtgctttcctctacttatcctgttttctctgcatgtcctggtagatagaagtcttagtgtcatctgaagttgaagctcagtgctgtattacaaatttctaatgcagcttctcttatccccatgtctgacaataagcctttaacagaagacttttgggtaataatttagaacttcttcctgtagtaaaaccacaataattcctccatctctgtggtaggaggagttgatggcacagtgtgtcatatgcctgttcctcattcgtgtgtatgccggcatcgtcctggtgctggagtgaaaggcacagctgccctgtaaatcaggagctgtgcgtgattggccagggctggtctgctgggatatggttctggcaggaagccagggggacttccccaccccagcatggccttggacccaagccagaaatagcagctgggagccgagaacttgttgaaaggtgcttagacagggcacagaagcccaacaaagggcttagaggagaaaggaaaatgtagagtggcctggaaacaggtgcagagcttagccaaggccaggtgtgctgtggatgctgcctgcaccctcctagtctcacctttcctgtggtagcaggtgcagcccagtccagtttatgaagaatcttatttggggttggcacaatcaaaaggccagcacctgccagtcgttggcatccgaaggcctttgatgtttttgcccatgggcgatgctcctttgcctttaggcaactgacttaacctagttgtggaaggcagtttagtgtgtatataggcagggaagctaaccacagagactaaactcttgcaacatggttggctcaggtgggtgaaatacctgtagctgcactctttgctaccttcagtctcatcttcattcaaaagtgtctgccagggagtgtttcttgaataccctctagatcaggtttttaaaagaagttgctcaactacatcaattctaagacttctttctggttcgcagattctgcggcttattggttgatatgattctgttcccagcccatgctttcagagcatttcatgagtcccaggccgctgagggaatatatgcaaacccgagactagtatctgctcctaaagaaagctgtgaattctcttgccacagatcgccatcattgtaagatgatatggaacttagaataggcacttacttaaagctgttagtttatttcttcttacgatgtgctgtctttgtgttgtagctcacacaatggtcacttgagctgttaactctattctggttttctggctgatctggaagatcctgcacccatgtatccagattatgtagctagtcttactagctgcagagcagttaaacctctaggtctttcttggattgtggttcatgtttagttagaattaacagcatggtcagaatgtttactcctttggctctgtgtatttccctggaggatttcagagtcctggctgcagaatagattgggtttgaggctgacctctcacaacctttctttgtcatcattaggacctggtcccattgtcccccctgtctatggcttagaggtatctgatgtctcgaagtgggaagagtctgttcttgaacctgctcttgaaatcgtgcaaagtttcatccaggtaattatgaatcatgatacattctattttctggttttcagagcactttcattagctgacacctttgttgctatattgaagaaccaggccttcttttccatagaataaagcagaagggctggctgctttttaatacctggagactgcttttctacttttacattcagaaaggttgttgctaaaatctgtatacagcccatctgctctctgggttgagaaaaaggaattttaggaaaatcccatttcccttaatagagaattatatccagatctctttgaattgaatactcccttccacccttgttcttttagggccacaagcctacagccactccaataaagatgccatacaatgaagctgagaacaagagaagttatcacctgtgtgacctctgtgatcgaatcatcattggggatcgcgaatgggcaggtagagtatggggaggggcatgaagaaatctataagggtgggttcacattgacttcatgaaatttagagtctttggcagattgaacctggagtctatttatttgtaaagggacagctagattcctctaagagcctgtgctcaaattccttggaggcttctgggaatttgtctctgtattctgagattcagaggaagatcagatgctctccatcttcagctggaattaatattttatactaagagatctgcagttaactttctagagctcctttgactttgtggtcctggcttggaggagtttcttggcctttcatgtttataattcagtgggggtgggatcaggaagtaagggtgtaagggaagccaggcagctcatccaggagactggaagaagcagaagcatagctgggagggggcaggaagtagagttactactcctgagtgtggtttttaaaagtggtatctcttcagtaacttttgaggtaattgttggcatagtggtagttgctaaaactgtgataaaaagaagttaagagaaactgtgtgaaagtaagcctgtcacacatgtataaagaaggttagttccccaccacctcagggccagccccaccctaaggctctatccctgcattagagcctggatctgcctctgccacagagtcacactgcacacacatcattggattttcagatttctgtagtcatccagtcaaagcccaggacttcttccccaagccttgagtttacatggtatttagaaataggtgtaaggtttgctgctttcaggcacagtggggcttgtcgtttactcagcagctgggatccttctgttcagagtactgttttgcatgggattctcagagaagtagatttttctccccaaagcaaccaataggatgattaggtctattaactggtaactggcaaaatgaactccattgtcagagactggggacggctgtgattgcccaaccagcagaagaagcctcgattgtcattggtttataatgatgaaaggggaagagaaagagagtgtctgattgtttttttctaaaggaaacttagtggttcgatttgttgaatgttcttcagggatagccttagagaagcaacatgtgtgagcctttgtgagcttagcttgtgtaagcccttctgtagtgccatctgtcaagtccttactcccatctcctgctgccatggagagccagcccagaagcccgttttttgccttaggctctagctggaaaacaaagctgacttcttccccaagtaaacttttctcttaattctaacctctaccttacttattcttgcttctaaactcttaaaaatgatgtttttaatatgtataaaagagaatttaaactagttgtccatctctttcagtgttcccagatgagatttccttgaaaaaagaacaggatagtgaaaataaatctgtatgagttagtcagaaggtgggaactgtcttaggggtgacaggtcagcagttgatagcaggcaacagtggccctaaagcttgacttccttcttggaccctcagaagagatcgtcggtgataaatgcaccttcctgtctccctggagcagtgtgtgcctagagaataggaatcttgccagagagtcgttcacatgacctttttgacccaggcacagggatgccagaccaggaaggacaacaggcaatgccctgcaatacagatgaggatttgaatttctaacttttcaaccttacaagttaaaaatgcatctataacaggaagccccatactacagagacctgattctggaaagtgggatctctttttggagctataggtctaagtagaagagtttacctgctgtgtgaccttggacattttgtaagacctctctgaacttcagtttcccttgtataaaatgagcagaatagtaccatcttacaagactgccatgaggattggtgatgtaaagtacctaacagggagcacttgatatgtggtagctcactctattttgctagctggctggccatataatttattcttcccttaaaaatgctaagcagctatactagtacatgtgttgatcttgctgtttattgttgaagaaaagcattgtatagttaattttacttgcttctaggattaattctagaaaattcctaatgagtttttttgtttgtttggtttgattttgtcttatcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtggtggggatccagttcaggagggaggggtatgtttgtctcccagtctgggcaaaggagtgctatgcggaattctctgcatagcagaaaagctcccaccattttcttttgatgtggttttaaagtctcacgttctctataatagaaacagcaggtcttgtcagctccttgtgtggctgatgtgtctggaaatgatgtagttcaggaaagcattttttttttctttgaaccttaaaggttctattattaaaagcagcacagattccacatttttatacatgaggatcttctttgtggtgaataccaggattgactgcatccctttaaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcagaattctacagagaaggagggaatcagactgaggaagctgtgacataggacttgaagaccaaagactttgaaatttgcgagctgctcatgtgtgagttattatcactgctgtctttctattgagttacaaatctatatttttattgaagtttaaataaagaaaaaattt

SEQ ID NO: 38412 - DNA, 3677 bp, Homo sapiens
tgtaagggcacatcccgcgagctgccgcccagcgcgcagacagagcccaggggagcaagagaacgggcgggcggtggggctcacggcctagggaggcgcggaggcatctggcagaggcgggtcgggctgggccagctggggtagagcggaggagcgggtgccggctgaagcggggcggtgggcgcggagcgcgctgggggcaccgacaccacctcaccggcagccgggtgctgagggccgcggtgtgggtgcgcggagcagtcagggcgcaggtgggcagcgcgcacggcctgccagcccggggcgccagaatcctgcgctgcggggccgagaggggcgccgcgcccgccgcagcctggagctttccgcgaacctcggggcgcccatgacggcggcggcgacggctaccgtgctcaaggagggcgtgctggagaagcgcagcggcgggctgctgcagctgtggaagcggaagcgctgcgtcctcaccgaacgcgggctgcagctcttcgaggccaagggcacgggcggccggcccaaggagctcagcttcgcccgcatcaaggccgtggagtgcgtggagagcaccgggcgccacatctacttcacgctggtgaccgaagggggcggcgagatcgacttccgctgccccctggaagatcccggctggaacgcccagatcaccctaggcctggtcaagttcaagaaccagcaggccatccagacagtgcgggcccggcagagcctcgggaccgggaccctcgtgtcctaaaccaccgggcgcaccatctttccttcatgctacccaccacctcagtgctgaggtcaaggcaggtaagcccccgggggactgggccctcttctctccttccctcccttctctttcccctacagagagaatgaggactagcattctacttcagagccggacatcttaggggggaggttcctggggccaactgagggcatgggaggcttgggccagtggccaacccagcagatccggactttcccctgaggcaccaggttggccggtccagaatgtgatccaggtgtgtgagaggaagatggaagccctgggagggggatacctgggtgagatgagccttctttcaagttggttcagccctgactcaggtggaaggaagtagagggaggttggcctgcacattgccccaggctgtgggcctctgctttccacgcagagcagggctcctggacttcggctttctggcagctgaggacaaccgagggtggggacgcggatcgtggaggccgaccctctttccctctaggttgaatgcttgtcataaagtttgagcattgaattgatgtagaaagacagtatctcccagatggcgaaggcaccatcaagggttgcaaatagagccaaggagtccggctcccaaggtggggcctcagtggaaggtggggcctcagtgggccgccttggctggactgggcctgagggatccagctcctcctctacatatgtgtgtgtgtgtgtgtgtgtgtgtgtgtgtgtgtgtgtgtgtatggtttgttgttgttgttgttgttgtttgagacagagtctcgctgtgtcacccaggctggagtacagtcgtgtgatcttggctcattgcaacctctacctcctgggctcaagcaaatctcctgcttcagcttccagaacagctgggattacaggtgcctgccaccacaccctgctaatttttgtatttttagtagagatggggtttcgccatgttggccaggctggtcttgaactcctgacctcaggtgatctgcctgcctcggcctccccaagtgctgggattacaggtgtgagccactgcacccagcctatatatatatttttgagacaggatctctacctgtcgcccagactggtgcagtagcatagtcatggctcactgcagcctcaacagcttcaacctcttgggctcaagcgatcctcccacctcagcctccaggtagctgggactacaggcacacgccaccatgcctggctaatttttttttttgtagatttggggtttccccacgttgcccatgctggtttcgaactcctgagctcaagcaatctgcccaccttggcctcccaaagtgctaagattacaggtgtaagccaccacacctggtccccattcttgacagtgggttttgagccctagggctcactgttaggagagcaagggagctgaaggataggcaactgcgccagaggctgggccactgatgccaaggggtgggggcctagctgtctacctgcccctgagtgccagtcaggcctggctgggccagggaaggagaagctggaggagggcatggggcactggggcagggtgggtgggtgcagcaggatggggtcatgagttgttatttgtgatgtcttaatcctctatgagcagtagggcagggagtggggggcggatttgtggtcaggaaggcccaggggaggggccaggaatagaatctggaagccctggctctcagccctgtgccctcttccccagatgccactcccttcttgtgagaagtaggagtagggctgagaaaggatttagccttccttctagccttaatttttccagtggaaacctagatccttctctccccactaccacctcctaggcgaccttacccgcctgcagatgtcttcaacagtagagagtcctagtgagcctggggccccatctagtgccataccccactttgatggtcctgttaatgccctcccacattgtagttagggtttagctgagaagtggggtataaggcagaccccctgtgctgaggattgatccacattgatccctcaggtcttgggggcctgggaggaagcagattcctttaccacagtacgtatgcaaaaaatgttttccatgtttatggaaaaggctgggaagtgctggtgtaaaatgcccaagctcataatagatactcctttctccattgttgcccctgctctaactgctgttctttcttgccagcttcgttgttccctctggcttgtgggggcacggctgtgctccatgtggcaaggtggaaggcatggacgtgtggaggaggcgctggagctgaaggaatggacgagccctgggaggagggcagaaggctacgcagggctgaggatgaagatgcagcccctggatggtcccagactctcaggacatgcccagctcaggggcttcgagccacaggcctggcctcatatggcatgagggggagctggcataggagccccctccctgctgtggtcctgccctctgtcctgcagactgctcttagccccctggctttgtgccaggcctggaggagggcagtcccccatggggtgccgagccaacgcctcaggaatcaggaggccagcctggtaccaaaaggagtacccagggcctggtacccaggcccactccagaatggcctctggactcaccttgagaagggggagctgctgggcctaaagcccactcctgggggtctcctgctgcttaggtccttttgggacccccacccatccaggccctttctttgcacacttcttcccccacctctacgcatcttccccccactgcggtgttcggcctgaaggtggtgggggtgagggggggtttggccattagcatttcatgtctttccccaaatgaagatgccctgcaaagggcagtaaccac

SEQ ID NO: 38413 - DNA, 22261 bp, Homo sapiens
actggccgcatagagacgcagcgcacgcgcagtcgcgtatccgtgtgatgggcgggctgttgacggcgctgcgatggctgcctgcgagggcaggagaagcggagctctcggttcctctcagtcggacttcctgacgccgccagtgggcggggccccttgggccgtcgccaccactgtagtcatgtacccaccgccgccgccgccgcctcatcgggacttcatctcggtgacgctgagctttggcgagaactatgacaacagcaagagttggcggcggcgctcgtgctggagggtgagggtcgcgccgggctgactggggcccggggctgccgtgcccgccgccctcccagactgcggctccgagcgggacctgggcgggcggactcgactccccaggcgccgccctctccaccccttccccgcaaaaaggggcaaatgtgcgttcctggttggggcagccgtgggcggctcgcctgcagcggtctcagcggcccaaattctgcggggcggtggtgggaagagggctcagagccccagcaggttttctgggcttcgttcgcttttctgcaaggtcctggcccaggcgcctgcccctcttggagcggaaaccggaggttccccgtggtgtatgctcccctcggtacagtgagaaatgagcccctcttgattggctcctggtctgttcgtggtggtctcaggccgaagggcattgataaccacatgcggactgtgcatcgcctgggcggtgcctgggctacatctgtgggagtcgcaggagtctttctccactgttgatgaaatgtgacagaaatgtttctgcttttttcttatcctcgtctcatctgcaccactgtattaacgacatctgtagtattgtcccagcaatgttcctactccctgctgagagggaacttctccccattcaaaataaatagagctggccgggcacggtggctcatcccgcgttccacccactacactccagcctaggtgtaacagaatgagaccctgtttccaaaaaaaaaaagaaatagagctgaacactggatcttccagaagaattccttattgtcctcacagtttgtgacagttgagacgttccgtgtgatatattcagtaagaaatgtcattctctgtacctcccttagaaatggaagcaactgtcgagattgcagcggaatatgattctcttcctccttgcctttctgcttttctgtggactcctcttctacatcaacttggctgaccattggaaaggtatcagaaacacgtgtacttgaaaacgatatctgtgttgagggttgattgggcagaagcaatcttgcattctaccttaaacagctccaggaggcatatatggcaacgaattggcaagaaatcaagataaagagaaaggtagagctgtatgtaaccacctggctagaacacagatgttaatttgatgctgtctgactactttctaggtctctggtgtaagtactgatatgtccagcctcccttatagagtaagtcagctggtgggcttgaacactcagcctaaataaccacacaaatttcgtagcactcattagcgtgtgtttggaaaagaccaggcagagttctggtgaggatgtggagaatctcttctcacttggtctaagatgcttctctttggagcaaagctaaagggctcctgcccacctgccacatgctgaacgtccctgaatggaaaataggaaggcaaaagatgtggggttctgtgttatggacaaggacacaaactgccaagtgttttgaaaaagatttcattcccttgggacattgttgaattcatttcagtgactatcaggtatcataatgttgatttgtaatggatagtgcctgccaagtgtttttataaagcagtttaaatctcttgtaggccttgtggcatatttgaaataaaatagcttctgttattcagctctggctttcaggctagaggaagagcagaagatgaggccagaaattgctgggttaaaaccagcaaatccacccgtcttaccagctcctcagaaggcggacaccgaccctgagaacttacctgagatttcgtcacaggtactttgagcaaatggtgtggggttataactggggttcaatccagaggcatttcaaaccactgaagattgagaagaattattttcctttaccatttattaccacgtgtttacctctctctcgttttggactggtcggataatacttggggaaagagaggcgtagtctttgcttcattctttttgaagaccagccatggccagttccggttttacttctgactgtgcagtgttgaataagacagacctgtttcctctcaagaggccacagctggtaggagaggctggtgagaagccaggcacagatgggcagaggcagatggcacatggtgtacatcctatgtggaaaagagcagggcgctggtgaagaacagtggctggtcctgagggttcaggggaggccgtggcactgagggcaagatctgagggctgagaagctgctggcaccgggcaaggtggggagaggcagacttgagcctgagtgaaactgcctgaggcaaggaggaccttggcatatgcgggaaggtgaaattcccagggctgggagagggagcaggggttggctcagtccagctgtggtcctgcaggtcctggaggcagcatggagggtccagttgatgtatgcgggaagattttggcgtggactggaggtctgagatgtttactgtgaaactgctctggctgggtggagacacagtggagggcaggaggccaggagagctgcctggccgtgggaaaagctgagtggggggaggagtgctccgcaggagtgggccttgggagaaggagggtgagtccccgggtggaggggccagcaaaggctgtgcaggctctggcttggggacactgaggagctccgttttggatctgcccactgtgagatgtctgggaggcgccatggagaccttggtgggcaggtggtgccaggatcagagtctgccaggggagacaggttttaggagtccctaggtataggtggtttgtgtcctctggaaacgttggaagaaggggccaggcctagtcctgggcaccaccaggctgagaagattggggtcagggaggagggcagggggagtggagactggggatgggtcaggaggcagctggagaaccaggaaaacgtcctgtcagtgaaggtttggttcaggaagaacagccaaatccccgacaccgttgagaacaccagggtggtgctgactctggtgtggctgctcggaacccttagaaggcccttagggtgttagttactgttgttggtacatctgtgattgtgtctagcaggtgtgggagtgccttgggagcttcacctgtggccagagtcctcagcgccaggtggacttccctgcagggctgtgacagggacagacagcgctttctaacagtggccttgggagtggtaacctgccgaggaacagctcctgggctggggagctggaggcaggctgctgcccactggctaaggatctcagcaagaggggcattggggcattggcccccatgagcttgggccaccctcagactgccgtgggggtgttttgatttttttttttttcgaggcggaatctcactctgtcgcccaggctggagtgcagtggtgtgatctcagctcactgcaacctccgcctcccgggttcaagtgattctcctgcctcagcttcccgagtagctgggattacaggcgcccgacaccacgcacagctaacgtttgtatttttaatagagacgtgtttcactatgttggtcaggctggtctcgaactcctgacctcttgatctgcccacctcagccccccaaagtgctgggattacagacatgagccaccatgcccggccctttgatttctttaacaagaaaatgtgtccttttaaaatttctataagctcaatagagaggggatggacagtaccaaaaagcagaaggaagcaaacccacattctcctttcaaaggcagcattcctgtcgctgagcagcttctccaagggtggtctagccgggcagagggtgtagggtgggaattggcccctagaaggtgccgtgcctgatgggagagtcctgctcttgattggccatggggccactgctccacactcttcggtgtgaggatttctgcctttgaccaaggtctttgtctacaaattgaattttcctgactggaaagccgacaggtgcttcctttccttctttggtccttcgtctcctttgcatatggagtatcgtaactgcctgagagcagactgtggtattttttccattgaaagatgtgtttccaccactcacaagtgacccataagccagcacctagtgtccaggagcagctggggtggtggatggtgaatatttctgtctttctcaagcattgacttggagacatcctgccctccagggatcacttgcactgcctctcctgttcagaccctggcacttgtctagacctggttagggatgaggctgtgtttaggccagatccctttctgttaacgttttactttggttgagttcaaatttttttgttttatatttttttttttttttttttttttgagacagagtcttcctctgtttcccaggctgcagtgcagtagcgcaatctcaggtcactgcaagctccacctcccgggttcatgccattctcctgccttggcctcctgagtagctaggactacaggtgcccgccaccacgcccggctaattttttgtatttttagtagagacggggtttcaccgtgttagccaggatggtcttgatcacctgacctcgtgatctgcccgcctcagcctcccaaagtgctgggattacaggcgtgagccaccacgcccggccttaaaattatttaatagagatgaggtctcactatgttgcccagactggtctccaactcctgagctgaagtgatcctcctgcctcagtctcctgaaatgctgggatcacaggcataagacaccacacctgtctgatttcaaatgttataggggcttaggagagaaaatgggaacattgagaaggtataaaggggaatacacagccacacattacccctgttcccagtccaactcttgaaacacttggtatatgtctttcaatttatgtggctgggtatggtggctcacacctgtaatcccagcactttcagaggccaaggcaggcagattgcttacgcccagtctgggtaacacggtgagaccaccatctctaccaaaaaaaaaaaaaattagccaggcacgacatgcctatagtcccagctacctgggaggctgaggtgggaggatcgcttaagccagggaggttgaggctacagtgagctatgatccagcctggatgacagggagaccctgtctcaaaaaataataataataattttatttggataaacacatgtatacatcattgagggttaggggctggattggtatttggatacacacgtgtgtacgtaattgagggttaggggctggattggtccctgtttctttttttatgcacatgagaatattccctttcatacagatttttatagctcttctccattgcttggataaaccatcattttctaaatcatttatctgttgattctttcttcatttgtaaatgtccccattacatccgttgtacgtaaactattaagagttaaaggttgtgaagattttgatgtcctatgacgtgtatcatgacaaactattcccgaatttgcttcccctgctacggtgctgagagtagcagtcagtggtgccatggcagcactgggcattctcgtgtcggcaatgtttccaatgcaacagtcagaaactggcgcctgcttttcgtggatgcttgtgtgtcttgcctagaagcagggacacttacaggaggggagaggtgatgaacggccctatgtgctcccatcccggaagctgtccgtgtcctttgatgagtcttaggacttttatattttcctttattattggtattccctttattattagtatgactgttgtgagttagaatatttcatcctttaccaagtatgcttcttatgacttcatccggcttagaaattagttttagagaactttgctatatagtagcagtaatcaattagaaaatgttattgaaaagagatctcaggaggttgcagtggctcacacctgtagtcccagcactttgggaggccgaggcaggcggatcacttgaggtttgaggtcaggagtttgagaccagcctggccaacatggtgaaaccccatctctactaaaaatacacaaattagccaggcgtggtggtgcgcacctgtaatcccagctactcagcaggctgaggcctgaactgggaggtggaggctgcagcaagcggagttcgcaccactgcattccagcctgggtgatagtgagactcagtctcgaaaaagaaaagaaaagtgatctccatcacaatcacaagaaaagaatgccaccaagtccgtaggagtaatcctgatactaaaatatataaagtcagtataaataaaagtacaacactcaaggtatttgaaaagacctaaataagtagacattttattcttctgctgtgaagatttaagcagtggctcacgcctgtaatcccaacactttgggaggctgaagcgggtggatcacaaggtcaggagattgagaccatcctggctaacacagtgaaaccccgtctctactaaaaatacaaaaacaaaattagccgggcgtggtggcaggcacctatagtcccagctactcgggaggctgaggcaggagaatggcgtgaacctgggaggcggaggttgcagtgagccgagatcgcgccactgcactccagcctgggcgacagagcaagactctgtctcaaaaaaaagagaaaagatttaagttctccctaaattcatctgtaaatccattgactccctatcaaaattccaacctctgtttttaaagatgattttaaaattcatatggaaagaaaatttgggagtaaaactcagatgaacttccctacaagatcataaaactgtgatcattgaacccatggtgattttttttttttttgagacagagtctcactctgttgcccaggctggagtgcagtggcacaatctccactcactgcaacctccacgtctcgggttcaagtgattctcctgcctcagcctcccaagtagctgggattacagggatgtgccaccacgcccggctaactttttgattttttgtagaggtggggtctcactttgttacccaggctggtctggaactcctgggctcaggtgatcctcctgcctcggcctcccaaagtgctaggattacagatgtgagccactgcacctgaccctcgtaacggtgatttttaagactaggtgatcttagtgacataattctaatagtttgttccgaccttccactgtggactcaatagcagggagatgaagaggacagtgattgcatgacctggtggagaagagactagagaaacacagtggaactagtggctcacatctgtcatcccagcactttgagaggccgaggcaggcagattgcttgaatgcaggagttcgagaccagcctgagcaacatagtgagaccccatctctattaaaaaaaaaaacaggctggggccaggcatagtggctcatgcctgtaatcccagcgctttgggaggctgagacgggtggattgcttgagaccaggagttcaaaaccagcctggccaacatggtgaaatcctgtctctactaacaatacaaaaaattaacctggagtggtggcgggcgcctgtaatcccagctactcaggagtctgaggcaggagaatcacttgaacccaggaggcagaggttgcagtgagccaagatcacgccactgcactcctgcctgggcaacaagagtaaaactctgtctcaaaaaacaaacaaacaaaaaaaacaggctgggcatggtggctcatgcctgtaatcccagcactttgggaggctgaggtgggtagatcacctgaggtcaggagttcgagaccagcctggcaaacatggtaaaaccccatttctactaaagatacaaaaattagccaggtgtggtgacacgcgcctgtaatcccagctacttgggaggctgaggcaggagaatcgtttgaacccaggaggtggaggttgcagtgagccaagattgcaccattgcactccggcctgggtgacaaaacaagactctgactgggattacaggcgtgcgccaccacgcctggctaattgttcgtaattttagtagagatggtgtttcaccatgttgcccaggttggtcttgaactcctgacctcaggtgatccacctgcctcccaaagtgctgggattacagacgtgagccaccgtgcccagccataagtaagcattctttccttttttaaaaaaaaaaaaagtggagcaatctaaatatccatcagtaaagaagtacaaaattatggcttgtgccgggcatgttggctgcaacctgtcatcccagcactttgggaagccaaggcaggaggaattcgtgaggccaggagtttaagaccagcctgggcaacataaggagaccctgtctctatagtaataataataataaaaattaaggtttggtaataccacagaaaactgaggccataggagagaatggatttgcctctagactcacgtaggaggacctaagcctcagtccgtgacacggtctgcagctttcccacgctcctgttcacgtggggaagggagcagaggacggggctctgtgcctgcaggtgtggaaacagggaacagggtggtgggggctggctagaaggcccgcatcacacagcagggggcgcctggcaaggggaacccagctccatatgtcatcggaagctttgtgctttgtagtgaggatgtgggtgcctgcctcactttgcagatgactgtgcgggaggcctggggacccagaggtgttgctggagctggtgtttactgcagccctttgttattaacgctttaggacctgtgagagtttggaaatattcccaccgtgggaggggcttaagcgttttgtctggggccgtttagccagtcggcagtgtccccaggctcctaaggagctgtcttctgaagctgcctgtcgtattgaaaaacgaaagtaatttagtcagaggtcagaagctcagtctgtgaggtgtgggctgcacctgagggcgtcccatagagggaaagaagggcagctcgcagacaccccgtgatttcctgtgtgaccaatttctctacagaagacacaaagacacatccagcggggaccacctcacctgcagattagacccccaagccaagacctgaaggatgggacccaggaggaggccacaaaaaggcaagaagcccctgtggatccccgcccggaaggagatccgcagaggacagtcatcaggtacagagcgcagggcaggctgcacgccgccgctcagggcttgatgttccgaaaaacaagattgcggaaacgcattgtgtctgagatctattttcctttgaaactgacagtgtatgctctgtaatctgtcctcattaaccttagattacagaatcgaatttttaaaactggaggtcagagctaaattaggtccccgataatgtcctcatggtatgcagtaacatttcagaatgttttgtgtgcgtgtgaagggtgcacaggtgcgtggggatggggagccaggctcagaggtggacgctggctgcctgggccacctcctttcccgagccccatctggtcgagcagagagcagagggagagggagttgcccggtgcccaggctcccagagtgctgtcctctgcccggttcgtcaagtccaggtagtggatcccagtggagcttcggtgctggaggcgtctctgcctcgtttccggctccatgttacgctcttagaaacggagttgattgtggttgaggcggaaggaagggttccccgcagacgtcctctctcttctacaaagtgtgggcagagccagggccagtgagggctgctgtgcaggagtggcctgagacaagcgctgtccgccgtgagagatgggctccgaagaaacgggcccagaggccctgaactcaagcgcgtggtgagaggcgtggacatgtgcatgtgaggggtcctcacggccaggaggagaatttgagggccactgtgctctagttagcgttggcatgaatgcaaggacgctttacttccagagcaaaagaggatttgacctcagcttgtcaaaagtgccacgtttgtactcccagcatgtaagccatctgtggttgtaagaggccttttgctgatcctgggacagattcaccacagggccccaagagaacgctcgggcccagccacagttaggaggttgcgcggcaaaccctctacacaacctcatagctgttcctgatggccattggacagaactcgatggggagtttgagtggccatgcgtctcgtgtgtagggacagcccccgtctgtgtggccatcctggcatcttggggccacctcactgtcactagtgctcctgtttggatgaaagattctctactcctccaccatagaggccccccgcctccggcctctgcagagggatttctcacgattctccaagctctggtctctgacctcaggccagccttgaccctggagcagtgctgtggtcttggctctcaggcacgggagctcaggactgaactgtgtgtttcctgccactcagcagcctgcacctcaggatgatggggccgctttgggtgcagggctgtgccttggccgtgggtatggagcgtgggggtgggaaacatggagccacaaatgtttgacggcagctgacacccttccttctcccccgaagctggaggggagcggtgatcgagcctgagcagggcaccgagctcccttcaagaagagcagaagtgcccaccaagcctcccctgccaccggccaggacacagggcacaccaggtgaggccacacctgcaccccttcctccccgggcgctcaggggctggtggctgatgggtgcaggcttcgtctcagccatggtgggtggcgcccccgccctggtgtgcaccttgcccttcagcatccccctgttgtctgagtcctcacaggctctgcaaccttggtgacaccatgtggctcttggcctgctgtccctgagcacatggctgcagaagaaggtgtgtctgagaggtttgtgtctgggccaggctgccccacgggatccctggagactgctgcccgtgctgtgtcccctgtctcggcctggccagtcccaggcagctctgggggccacttcattctcagcaccgtttgttgggggcctcccaggtgcgggccttcggccaagctcagtgcatgacctgaggcctctttcaacctcatgacaccctctgacacgataagccactcaccctcccgttctccagactgaaaagcagggctgaggacagccacccccagagtcgtttgcttgtctgtgggggctcatggcaggtcgctgagtctggagccctgctctcatcatgccccccaggtgtctctgaggtggggagggagcccagagccaggactcccagccccgggcctgtgagggatgtgtagcaatctctgcggcatcaatgagggcagaggcagaggcagaggcatagacatgccatgagcacaaggaggcctcagaacctttcctgagaggacgtgtggtttggtgccgttacacacgtgtcaatccacacattagtcaatgttggccgggcgtggtggctcacacttgtaatcccagcactttgggaggctgaggtagaaggatctcttgagtccaggagttcaagaccagcctggacaacacagtgaggccccatctctacaaaaaaaaaagaaatttatatatatgtgtatatttgagacagagtcttgctttgtcacttcactgcaacgtctgccttctgggttcaagcaagtctcctgcctcagcctccctagtagctgggattataggcacccgccaccacacctggctaatttttgtatttttagtagagacggggtttcgcgatgttggcgaggctggtctcaaacttctgacctcaggtgatctgcccacctcggcctcccagagtactgggattacaggcgggagccaccgtgcccagccaaaaaaatttaaaaaaagggaacgaagggactgtagcgcgtgtgcacagtgcgattcccgtggagcacctgaagcccacgtggcagaaggagcgtgtttgagtcgaggatgttcatcgcgaggtctgcacccgtccgtgtttcacattctgagttggcaccacactcacccacgtctccacaggctgtgctcactgtgctgtcccagcgcccttggggcagccacccttgtccctttggccagaggccaccgaggcccaaggagggtgtgcctgcccaggcgccaggtggaggtgcatgggccccagtcaggtggtcgggtgacaggtgccatcctgtgcagtctccagaggtctcaggcccttggcaggctgtgttctccctgggggctgctgcagcctctgtggccctggcctttgctgtgcccaccaccgcccttcccgtcgtcccaaacccaccgtcatctttgccccatgggggtcacagcagtgctctgcctgagggtgtccatctgtgccgacgccaggaccacgtccgccatggcctgtgctctctcccccctactagtgcatctgaactatcgccagaagggcgtgattgacgtcttcctgcatgcatggaaaggataccgcaagtttgcatggggccatgacgagctgaagcctgtgtccaggtccttcagtgagtggtttggcctcggtctcacactgatcgacgcgctggacaccatgtggatcttgggtctgaggaaaggtacctggtgctttctggggaggggctgagccctccgtgtgggcctcgtgtgctgaggcagagtgtgggttgcacacggggtgaaagctgctgtttgcatctgaccatgggttttcccttctcctgggtgcgggagtggacgtgttggctgtggtcagttcctgttcttgtccagccacccaaggcacacacagggccgctgtccccagacctctgcaggagttgagtgtggactctttgggggacgtccaagggacattcccaggctgtgcttctcttgcagctgggggtggtgggatgagtgactgtggggccccgctggtcccagatctcagcagcatccttcatagaccagcacatccactttgaattgggagtatgtgtcttcggttatttaagcgataatttaaacatttgcctaattttttgaataggttgaagaccaccagtaaacgacgtgtgtaatttttttgggtcgtagcctttggttgtgacccattggtggccatagcaactgcactgctgactccgttttattaacaaatgttgacgacttcaagatttacccccttgagataggaggtgatattgaagccctgcaggggaacgataacgccccagacatgggtttggttttttgtttttgtttttttgtttttgagatggagtctttcactgtctcctgggctggagtgcaatggcgcaatctcggctcattgcaaccttggcctcctggtttcaaacgtgggttttttggagacagagtctagtggtgtggcccaggctggagtgcagtggcacgatctcagttcactgcagccttcgcctcccgggttcaagctattctcatgcctcaccctccccagtagttgggaccacaggcatgcgccaccatactcagctaatttttgtgtttttagtagagatggggttttcccatgttgtccaggctggtctctaactcctgggctcaagcaatccacttgcctcagcctcccaaagtgctgggattacaggcatgagccaccacgcccagccaaatgtattttgaagatggatagataataggaaaacgttggagccatccatttgtctctgcatcctttactgttttatgtcatagaatttgaggaagccaggaagtgggtgtcgaagaagttacactttgaaaaggacgtggacgtcaacctgtttgagagcacgatccgcatcctgggggggctcctgagtgcctaccacctgtctggggacagcctcttcctgaggaaagctgtaagtgtcttggggtgtcctgcagggagatggtggactcgcattcaagcagttacccctttagtggacttgtggggacgtgactgtcttcctgtttcctcttcaaatgcactggagtctgtttctgagctcatattcgtgagctgatgaagccactttgatcaccactggccttgtagagacattcactcagtgcagagtgatgcccgtttccttgctgctgtgttgaccccagagagccttcagtgtctccactgaactgcatgaaagggtgtagacgaggcctctgggtgacctgaacgttggttctctactctgctcatataccaggaggattttggaaatcggctaatgcctgccttcagaacaccatccaagattccttactcggatgtgaacatcggtactggagttgcccacccgccacggtggacctccgacagcactgtggccgaggtgaccagcattcagctggagttccgggagctctcccgtctcacaggggataagaagtttcaggtaagggggcaggctttctggctggatgcgcctcccctggagctaccttttgctcatcacagcaggtactgtgtgtgtgtgtgtatgtgcatgtgtgttttcaggttttttactgtgataaaacacacaaaacgcaccaccttaaccatttccaggcgtggtcggtggtgttacattcacgctgttgcaggcgtgcaggtcggtggtgttacacacattcacactgttgcaggcgtgcaggtcggtggtgttacacacatttgggctgttgcaggcgtacaggtcagtggtgttacacacatgctgttgcaggagtacaggtcggtggtgttacacacattcatgctgttgcaggcgtgcaggttggtgctgttacacacatgctgttgcaggagtacaggtcggtggtgttacatgctgttgcaggcgtgcaggtcggtggtgttacattcacgctgttgcaggcgtgcaggtcggtgctgttacacacattcctgctgttgcaggagtacaggtcggtggtgttacacgtgctgttgcaggtgtgcaggtcggtggtggtacacacattcatgctgttgcaggagtataggtcggtggtgttacacacattcactgttgcaggcgtgcaggtcggtggtgttacacattcacgctgttgcaggcgtgcaggtcggtggtgttacattcacgctgttgcagacgtgcaggtcagtgctgttacacacgctgttgcaggcgtgcaggttggtggtgttacattcacactgttgcaggcgtgcaggtcggtggtgttacacacattcattctgttgcaggcgtgcaggtcagtgttacacacattcacgctgttgcaggcgtgcaggtcggtggtgttacacacattcacgctgttgcagatgtgcaggtcggtgctgttacattcacgctgttgcaagcgtgcaggtcggtggtgttacattcacgctgttgctggcgtgcaggtcggtggtgttacacacattcacactgttgcagacatgcaggtcggtgctgttacacacattcatgctgttgcaggcgtgcaggtcggtggtgttacattcacacttgcaggcgtgcaggtcggtggtgttacacacattcatgctgttgcaggcgtgcaggtcggtggtgttacacacattcacactgttgcaggcgtgcaggtcggtggtgttacattcatgctgttgcaggcgtgcaggtcagtggtgttacacacattcacgctgttgcaggcatgcaggtcggtggtgttacacacattcacgcttttgcaggcgtgcaggtcggtggtcttacattcatactgttgcaggcgtgcaggtcggtggtgttacattcacactgttgcaggcgtgcaggttggtgttacacacattcacacttgcaggcgtgcaggtcggtggtgttacacacatgctgttgcaggcgtgcaggtcggtggtgttacattcacactgttgcaggcgtgcaggtcggtggtacacacattcacactgttgcaggcgtgcaggtcggtggtgttacacacattcatggtgttgcaggcgtgcaggtcggtgttacacacatgctgttgcaggcgtgcaggtcggtggtacattcatgctgttgcaggcgtgcaggtcggtggtgttacacattttcacgctgttgcagacgtgcaggtcagtggtgttacattcatgctgttgcaggcgtgcaggtcggtggtgttacattcacgctggtgcaggcatgcaggtcggtggtgttacacacaacgctgttgcaggcgtgcaggtcagtggtacacacattcacgctattgcaggcgtgcaggccggtggtgttacattcacgctgttgcaggcgtgcaggttggtgttacacacattcacacttgcaggcgtgcgggtcggtggtgttacacacattcatgctgttgcaggcgtgcaggtcggtgttacacacattcacacttgcaggcgtgcaggtcggtggtgttacacacattcacactgttgcaggcgtgcaggtccgtggtgttacacacatgctgttgcaggcgtgcaggtcggtggtgttacattcacactgttgcaggtgtgcaggttggtgttacacacattcacactgttgcaggcttgcaggtcggtggtgttacacacattcacacttgcaggcgtgcaggtcagtggtgttacacacattcatgctgttgcaggcatgcaggtcggtagtgttacacattcatgctgttgcaggcgtgcaggtcggtggtgttgcacattcatgctgttgcaggcatgcaggtcggtggtgttacattcacgctgttgcaggagtacaggtcagtggtgttacacacattcatgctgttgtgcagctatcacttccatctccagagcccttttcatcttaaaactgaagctctcccatcacacagtgacccttcatgtccctccccagtccctgaaaaacactgttcaggtttttcttcctggacctcattgtgtggagttcctcgtgtgagtgcagtcacacacgatttgtcctttttttgttttcgtttgttgagacagagtctcattctgtcactcaggctggagtgcagtggcgtgatctcagctcactgcaacctccactcccaggttcaagtgattctcctgcctcagcctcccaagtagctgggattacaggcgcctgccaccacgcccagctaatttttgtgtttttattagagacagggtttcaccaagttggccagactggtctcaaactcctgacctcgtgatccacccgcctgggcctcccacagtgctgggatgacaggcgtgagctaccacacccggctgatttatccttttatttgggctcctttcactcagcgtctttaagcttcatacgcgaaagatgcttcagagattcctttttcaggctgaatatctgctgcgtggctaggccactttttgtttaatcctctctcctctggtggacaccaggactgtgctgttttggttgctgtaagcgcgggtgcacacgcctgcctgaggctgtgttttggccgttgtgagtgtgggtgcacacacctgcctgaggctctgctttgttgtgagtgcgggtgcacacacctgcctgaggctgtgttttgggtgttgtgagtgtgggtgcacacacctgcctgaggctgtgttttgggtgttgtgagtgtgggtgcacacacctgcctgaggctgtggcgcgatctcggctcactgcaacctccacctcccgggttcaagcgattctcctgcctcagcctcccgagtagctgggaccacacccaccaccacaccccgttatttttttgtatttttagtagagatggggttttgccatgttggccaggatggtctggaactgacctcaggtgatccacccactggcctcccaaagtgctgggattacaggtgtgagccactgtgcccggcctctttttactttgttaatggtgtattttgatagataacagattgtcattttcatgaagcacagctggtcagtttattgttgctcatgtatttggcctcatgttcgagtccctgtttttaatcatgagctggacacagccctctttagagcaactgtgaccacttgtggtgagaagtgcagcccacaccatccacgtgaggctcccacacgccatccacgtgaggctcccatgcagacatttagaaggcgttttcactgcagctcagaaaatggccccaggcccccatgggcacccccatgtcaccagggcctctggttgctgccggtacacagggataggcagccaggcctcgaaggtgctgggcatgggtttgggtgtctgcgttgggtagagacccggagcgcccttgctgggcgtgccctaacatcccggtaccctgtgcccctctgtgggccaggacgcctggtgctgccagctgggcgtaagccctgaggagctgagggtggctgtgacttggaggatgagtaggagctcaccaggagggcgtggagccgaggcgtttaatatcatcaggagcaacactgggctcagaaggcaggcacacttgccgtccctccagagccatggctgacggccaggcctggtgggctctcgtgaggacagtgcctgtggttgtcagatgctgtcccttcgagtaagggatgagagccatcctgaagatgggtcagctctgtggtgaccacccgttgggagcagtgacattcaggtgcgttgcactggtggctgtgtggctgtgtggtacggccaccaggagccatgtgggcaaggacagctgtgggctgggcacagagctctctctgctgggagtcagtcggtgctggggcgaggggaggcagagctcacagagcccctctacagctcaccctgcagctcggccctggccagtaaacccaccatccccctttctgccgcaggaggcagtggagaaggtgacacagcacatccacggcctgtctgggaagaaggatgggctggtgcccatgttcatcaatacccacagtggcctcttcacccacctgggcgtattcacgctgggcgccagggccgacagctactatgagtacctgctgaagcagtggatccagggcgggaagcaggagacacagtgaggcccggcccgctgcccccagctcccgcggctcccccgttcccgcagccccccactcctgctgcccccagctcccacggcccccgctcctgctgccccccgccacactgtgtgtcaggaaaccgcagccgtgccaggcctggcccaggcatttatgtggagggcgtattcattcacctctcaccgtggcctctgggggggtgaggggggcatcttcactgagggccatgggctgtgcagggtggcaccttctgtccggcaagggccaggcctgctgtacttgtgtgggcccaggatgtgcctgtccctggtgccccacgggagccgatgcaccgtcctggtagagtgagatgactgctggtgtccacaggctgctggaagactacgtggaagccatcgagggtgtcagaacgcacctgctgcggcactccgagcccagtaagctcacctttgtgggggagcttgcccacggccgcttcagtgccaagatggtgagtgtgtctgcggggccttccggccgccgccccttttaccttggcttccaaggtgcctgagtcatgatgtcaaaaagaacgaaatcctggccatggcgcccacgtggaggccctgggtggaccgtggctgcctggccaggcctgtcttggcaacagggcagtaaggccttgtgtggcacctggggtgggcagggcttccccagggcagctccctccccgtgcccggtgtgtagcaggtcctcgggcggtgtgtgggggccgggttggagggcctggtccaggcagctccgctgttccatgccaagtgccctcgcgtggcctcccctcccagggtaccagggccgaggcagcgctgggctcccacgttggctgcccgtgcagctgcaggctgagggcagggcctgggatctggggctgaagagaccctctgattccaggaccacctggtgtgcttcctgccagggacgctggctctgggcgtctaccacggcctgcccgccagccacatggagctggcccaggagctcatggagacttgttaccagatgaaccggcagatggagacggggctgagtcccgagatcgtgcacttcaacctttacccccagccgggccgtcgggacgtggaggtcaaggtgggcctgggcctgggtcagggtccatcaggaggagggtgctggcagggctggccttgccctgagctctgctccgcccacagccagcagacaggcacaacctgctgcggccagagaccgtggagagcctgttctacctgtaccgcgtcacaggggaccgcaaataccaggactggggctgggagattctgcagagcttcagccgattcacacgggtgagcacctgtcctcgccccgcgtggtcacggccaccgggccacaggcacggctgggctgtggggctcaggctggctccgctcttggtggtggctgtgacctggatccgggaggggcgggcttgccgcagcctcggggtggccacactgcagcttgggggccctggcatccccatccccactgagcttcatggttgtgggacccagagtacttggaggggctgggcacccctcattttcatttctcagggcctgtctagggagggtctctgctgtgggcccagcatccccccagtttaggaggcacacgcacccatgactggggcaccatccccactgtggaccaggccctgttttaggtcacgccctccacgccagagtgtcacttcctggctctgctgtgatcttggcctgaggcccccgctgcctccgctcccaccgtctgccctgtgccctgtgccctgtgcggcaactgtgaggccccctgagcccaggttctgggggaggcggtttctgtcgtggtcacttgagggttgttggcatttccaggtgggctccggtggaaccacacggctcgcctgggggtggccatcatccaggcgccctccaccctgagcttgcgctgggggccacattcaccatggggtggagagcgcttcggtgatgaggctgaggggggtgcagggtgccccccgtgtggtgacgaggccctggctgctgcacaggtcccctcgggtggctattcttccatcaacaatgtccaggatcctcagaagcccgagcctagggacaagatggagagcttcttcctgggggagacgctcaagtatctgttcttgctcttctccgatgacccaaacctgctcagcctggatgcctacgtgttcaacaccgaagcccaccctctgcctatctggacccctgcctagggtggatggctgctggtgtggggacttcgggtgggcagaggcaccttgctgggtctgtggcattttccaagggcccacgtagcaccggcaaccgccaagtggcccaggctctgaactggctctgggctcctcctcgtctctgctttaatcaggacaccgtgaggacaagtgaggccgtcagtcttggtgtgatgcggggtgggctgggccgctggagcctccgcctgcttcctccagaagacacgaatcatgactcacgattgctgaagcctgagcaggtctctgtgggccgaccagaggggggcttcgaggtggtccctggtactggggtgaccgagtggacagcccagggtgcagctctgcccgggctcgtgaagcctcagatgtccccaatccaagggtctggaggggctgccgtgactccagaggcctgaggctccagggctggctctggtgtttacaagctggactcagggatcctcctggccgccccgcagggggcttggagggctggacggcaagtccgtctagctcacgggcccctccagtggaatgggtcttttcggtggagataaaagttgatttgctctaaccgc

SEQ ID NO: 38414 - DNA, 5244 bp, Homo sapiens
ggcggatgtctccggcgcgtcggtgcagggggatgagggccgcggtggctgccagcgtggggttgagcgaggggcctgctggctcccggagcggtcgcctcttccgcccgccgagtcccgctccggcggcccccggcgcccggctgttgcggctcccggggagcggggccgtgcaggccgcgagcccggagcgcgccggctggaccgaggcgctgcgggccgccgtggccgagctgcgcgccggcgccgtggtggccgtccccaccgatacgctgtacggcctggcctgcgcggcgagctgctcggcggctctgcgcgctgtgtaccgcctcaagggtcgcagcgaggccaagcctctggccgtatgcctcggccgcgtggccgacgtctacaggtaaggccgccccgacccggccccgctaggggcggcaccgcgggaggggtttccggtgacaggcttgggagactgaggcgcagagagcgggaggggcttgtccaggctcaccaaggaatccggaactggaaatatgtaccgaggacttaacgtgccccgggccctgaactacatgctgctgggaagcagcaacacacgagaaaggcagggaccctgttcccttggcgtatttgtgctaattggggaggcccccgggaaaaaagcaaacaaacacagtagcttaatttaatagcgaatgccttgaagaaaataaaacgtggagcttgatcccactatcatgatatcacagcggtgcagctgttgtagtccctgagaccagaggcacatgggcgtcaagccaggggtgcgcctctggagccctgctttctgctcaagctcttagggaggtgaagcagggagacaggcggctcccattgtaaactcgaaggattccttttctacgtctgcctagagtctaggaaaggaccaccagtggcccttcaattttgaatggatttattcttctgtgtttcccagatactgccgtgtgagagtacctgaggggctcctgaaagacctactgccaggaccagtgaccctggtgatggaacgctcggaggagctcaacaaggacctaaacccttttacgcctgtgagtcaagttttctcttgtgtccccagactccaggccacttggctttcactaggatccagataagacttaccctcttatcccttccaacctttctcatgatccctttccccttgccttacagcttgtaggcattcggattcctgatcatgcttttatgcaagacttggctcagatgtttgagggtccgcttgctctcactagtgccaacctcagctcccaggccagttctctgaatgtcgaggtgagtttacccagtccttcccctggaaatgtcaccagcgcacatactgttttctgtgaatcagtggcattgatagtacactgggatggccaggcatgagagttcttgggccaacagtgggaaggttgcccagctggcagggaggtggtggggggcaatataaattaaaaaaatttgaaagattttatctcaaagtctgaaaagccagggggagaattggtcttttcttcagtctttataataataggaaagattataagaacaatgtcttcctgtttttctggagataacagtttctggagaacacagttaggctataaatcttcacgacagtgctgtaaagaaagatgaagaaggccaagggcagtggctcatgcctgtgaccccagcactttgggaggcccaagcaggtggatcatgtgaggtcaggagtttgagaccagcctggctaacatggcaaaactccatctctaataaaaaatacaaagattagccagacatggtggcgcatgcctgtaatcccagctacttgggaggctgaggcaggagaatcacttgaacctgggaggcagaggttacagtgagctcagattgtgccactgtactccaggcagggctctagagcgagactctgtctcttaaaaaaaaaaaaaaagatgaagtttagcctccagaaagttaaatcacttgttccaggtcacacagccattaagtgactgactcagatttttaaccagtttttgattctcgcccctgttctcttatctctgccacaagccagatcaaagaaaggatcatcctaatcctttcttggctacatagattagaacaaaggaggacacatagaaatttcgttttttttcttattactaagatgtaaaacgtagtaataagctacattgtgtccccagactcggccagacacatagtatcacacatagtatccagcatcaggccttgggccttccttgggcttattacatccagctaataagcctggatagagtaacttgcgtgcagtcacatagagatacgatggaaagtccagagttagagcccgtatccctgctcagaactccattcgatgggttttccattcccagacctagagtggggctcagggttcttagaaagtgagagttcagcatcccttcccattctcagagtgcaggtttgacttggtcctggtggctgtaccccaggagcaagaatcgggatgtggcacagggaggggaggtttttaccttgtcagcaatcatttgacctgtccaacacagtaactggtatttatgatttcctgtcccagatttccaggcctaactgccactgcagtgtcttccttggggggttggggaagctctagctcagttaacaattcagtccactgctctagggggagtatccttctcatagcccaaagactgagtgctggtggcatgcagaatctaccatgttctactcttcctaccctgatcagagtcgcagtgagatccaggagcatagttctagagctagaaggagctggaatcacttgttccaggttacgcagccattaagtgaccagatttttacctagtttttttttgttttgttttgtttgagacagtctcactctcttgcccaggctggagtgcagtggcaccatctcagctcactgcaacctccatctcccgggttcaaacagttctcctgcctcagcctcccgagtgagtagctgggattacaggcgtgtgccaccatgcccggctaatttttgtatttttagtagagatggggtttcactatgttgaccaggctagtctcaaactcctggcctcaagagatccagcctcccaaagtgctgagattacaggcgtgagccaccatgcctggtctttttacctagtttttgactcttgaccctgttctcttatctttgcggcaagccaggtcaaagaaaagatcatcctagtcctgtcttggctacatagattagaacaaatgaaatgaggacataggatcatctagtccagcccacttgtcttgtaggcctggatagagtaacttgcatgcagtcacacggagatacgatggaaagtctagagttatagcccgtatctctgcccagaactccattcattgtacttatatttccctaactgaagcaatgtgtgaaatttccttttgacatagcaagattttctttaaaccctagataggtgttacttggagtgctaacccaggaggcctccaaacctcatagaatacagtgtctttggcacagttgaccttaactaaatgaagctcctttctctgcttagaggaaagtgccttctgttttaagactatatggcctttgatgactgcgtgcagtttgacattattggatacaccagggatagtgtccatgctcttccttctccctcttctcaggagttccaggatctctggcctcagttgtccttggttattgatgggggacaaattggggatggccagagccccgagtgtcgccttggctcaactgtggttgatttgtctgtgcccggaaagtttggcatcattcgtccaggctggtaagtctctttcctgtggtgtggggaaataatttgagggaggttggagagatgcaaaaaagctttgacaagataaagatggtgcctcctatgttgccctgaaggagtgtgggccaggtttggagaagtggtagttgcagtgggactaagtttcctggctttcttaggattcaaaaggtttcatcaagggttgatgaacagggcttaacaaggctagccagtttcgatgtccctgctcaccagcctctggtgggctcgggacttctgagaagtcagactggtaactgtcctgtttcctcctcagtgccctggaaagtactacagccatcctccaacagaagtacggactgctcccctcacatgcgtcctacctgtgaaactctgggaagcaggaaggcccaagacctggtgctggatactatgtgtctgtccactgacgactgtcaaggcctcatttgcagaggccaccggagctagggcactagcctgacttttaaggcagtgtgtctttctgagcactgtagaccaagcccttggagctgctggtttagccttgcacctggggaaaggatgtatttatttgtattttcatatatcagccaaaagctgaatggaaaagttaagaacattcctaggtggccttattctaataagtttcttctgtctgttttgtttttcaattgaaaagtaattaaataacagatttagaatctagtgagagcctcctctctggtgggtggtggcatttaaggttcaaaccagccagaagtgctggtgctgtttaaaaagtctcaggtggctgcgtgtggtggctcatgcctgtaatcccaacattctgggaggcccaggcgggagaactgcttgagcccaggagttcagaatcagcctgggcaacatagcaatactccgtctcataaaaattaataaataaaaagtctcaggtgaccaaaggctcctgaagctagaaccaggtttggataaagattgaagagccacaggccactcttccctctgagccattgggcctagtggtgtcatgtattgtaattgctcgcagggagagcagtctttttggtgtaatagtgggatgtctgcttagttggcaggggttcagtccaaatggaagaatattgggaaataaacctccactatcctttatagccagggacttttttcttatttattcataaaataaattatagttaattatacccataacacctttatttaaatccagtgttctccgcagccttttgtctatttatatgtgtaccaagtgttaaacataattattattgggcatttgaactttgtttttctttaaagaaatgctgctattaaacatatttgtaaatggttt

SEQ ID NO: 38415 - DNA, 115407 bp, Homo sapiens
ctccggggccgcggcggctcctctgccgggtcgcgccggacgactggcttcgggcggcggccccggcggcctgtggacggacgggtgggccgaggtacaggccccacggccgccgtctcccgcttctgcccgcgcagagtccgcgccatggccgcctcgccgggctcgggcagcgccaacccgcggaagttcagtgagaagatcgcgctgcacacgcagagacaggccgaggagacgcgggccttcgagcagctcatgaccgacctcaccctgtcgcgggtgagggcccgggccggcgcgggcgggggcggccacggccgcgggcgggacccgcgcggcgggtgagaggttgcggggccaaggcgatggcggggccgggcgggggccgcgcccgggaaccggcggctgggagggggaccggagcggccgcggcctcggcgtttccccgcctggcgacacccgctagccgttcgcgatcccgggctgaggtgggagggtcgcccggccccgtgtgcgggaagatgggcaggggtgaagcccgtggaggcgggcggccgtgcgagggcggcctgagggggaggaggacgaggagccccgagaggaaatcgcaaacagctcggaggccggccgggtggcgcggcgcggcttctggtcgctccgaacatcccccaccatcgagccctgctgttctgccggcgtggaaggccgcgggcaccccagggtcccacgcgctcgtggggggagctctgtgcacaagtccatccagggcccggccctggggtggctcgggttgttggaaccacgacgggattccgtgtcgagtgtgaggctctgctccttttactccttggaggtgctttatcgggtccagtttactttgttcggcccgggatatttagtgagaactgacaagcgtcgctggtgactggagagggacctggaggaatgagtaaggcgcgagccgggacaaacacctggagaggttaggtaaccgctgagtgaggcagtggaggatggagagccaaccggagtgtccgcgcagggttgcagagaaggggggtcagcaggagtggggctggccttgaggatcctgaatgctgaccttggaggaccatcgggaggatgggggaggatctgcagattctgggggactgaggcgggggagacagtttgaaggagagctgagagcagagttgcaaaccagctgagttgcagacacattattttttggccagcgcagtgtttgggaaaaattattgaatctgttgccagaatttttaaattggaagacttccacacaaaatccaaatttccgtattatttatttattattatttatatatgttaaaaattgggagacctggtaacactaattctgaattcctacatgacagctaccgacctgctggagctgggtgatgatgaaagggagctgagctgagctccctttcaaatggagtaagaactctagtttgccaccgtccactctctgtcacagtcccccaaggggagattaggtgacagttgccatttatactcatgatggtgttttctttcagtgaagttaaggaaaaagtgaaatatttcctgtacttacatttctgttcacattgagaaaaaatatatatatagagagaaagaagctgaagatttcaagaaaatgttttcttataccctatcagcttcactcattttttacctgcctggcatccactggcatttacatctgtgaccttggttagattcagagatgaactcgataagctcagagcacgttgaaaagaatgggtgggtgaaagctgaggattagtgttggggcctgtgttgttatgtgtttttaaatacatactgtacattgtttatgtacaaatacatgcactgtatatgtctgtatacctatggcggatccaatctttcacccaattcatgaatcttctttaaaatatccctgacaggtgaggccatgagtaatgtacagactctcttttaaaagcaaaaatttttcacagatcctcactgtttacttactttcaagtaaaaaaaaagtgtttacttactttagagaccctgctatagctcagggtctcttgaatttagcaagcctaatcaactgtggcccatatgataattcagtcaccactttattctaattactacaaaattatggtgtcattttgcccttcacctggtacagggaatcatttacatattaattctgcccgtgttttcttcttggccagttaccagtaaagtaacactgcttggctccaccgtgttcataaacacatctgtaaatgataacactgaatttggctactaatgtttgcttatttaaaaatcttaagggttattttcatgaagaaatcacaaaattagaacacttctcatagagaactcttagattcccagcatgtctatgaagaatgcgtctctaaggatccaaagatcccagttggaggagtatctgcctagttcataattggtaactgggtggcagatatactgacttttcattactagcccatgacagacatgctaattcctgacttttcattactagcccatgacagacatgctaatcgatagggcagacattactgatctatctagatgctctttcccctctgagcctgtgttgggattcaagttcttctctacatgatcaaagcaatccttcagagttggccttacttacctattcacctaggcgttacttatcctattcacctagtgggtaggatagactagactgtagaggattttctctagctttagaagtccggcattatcaggaagcagtgggaaaattttgagaagggagtactaggaggaggagttgagtggtggtacctggaatggtaaagagagggaggaaagtggggtcgggcgtggtggttcacgcctgtaatcccagcactttgggaggctgaggcgggcagatcacgaggtcaagagatcgagaccatcctggccaacatggcgaaaccccgtttctactaaaagtacaaaaattagcctggcatggtggcgtgcgcctgtagttccagctactcgggaggctgaggcaggagaatcgctcgaacccaggaggtggaggttgcagtgagccgggatcgcaccgctgcactccagcctgggcgacagagcaagacttcatctcaaaaaaaaaaaaaaaaaaaaaaaaaaaaaaaaaaaaaggccgggcgcggtgggtcacgcctgtaatcccagcactttggaaggccgaggcgggcagatcacgaggtcaggagatcgagaccatcctggctaacacagtgaaaccctgtctttactaaaactacaaaaaaattagccgggcatggtggcgggcgcctgtagtcccagctactcgggaggctgcggcaggagggaggctgcggcaggagaatggcgtgaacccggaaggcggagcttgcagtgagccgagatcgcgccattgcactccagcctgggcgacagagcgagactccgcctaggaaaaaaaaaaaaaaagggaagaaagtggttgcaggtatgcctgggaagaggctgttctgttgttcatttattaatgtattcatttgtcagtatttgagtgcctactttgttgttaatggggtgtgtgtttgtgagggagaagagtgaaaacatggggctgtcctttaaagatcttactgatttgttccacaaatttacttactgagtgagtccttagtgtgtgccaggggttaggatggacactgggtatatagtaatgagcaagcaaaacacagtgtcccagtggattttaggatttaatgaggaagacattcatttaataagtaaggacacattttggtgaatatcaccaaaacagaagtaggtggagctctggacctgtatggtagggaattctcacctcttccagtggcctaaaggctcagggggagtgggggaggcattcgagggtttgtgtgttgagggagggaatatgttgcaggtacagagaacagagattcagtaaaagaggatgaggaggggatgtgagatgaggctggaggcattcatagggatcaggttgtagagacaggatttggaacttgatcttaagggcaatgggaagtcactgaaggggttaaactatgtgagatttgcttttttaaaagattcctctagctccagcgtggtgggtagaagagaggaggaggaggattttagtaggagatgtgatagtggcatttactaagatggtggcagtcgggaggcagagcggtgagcagattgatacttaggaggtggaaagggccagattttgtgaatgggtgaggaaggtgagaaagagggagggctggaaccatttcagggtgttcttcattaagtggacactggcaggagcaggtttgtgcggaaatgctgagtttgaggtgcctgtgaggcacataagtagagatggtccagcaggcagctgtttagatggttttgcagctcgagaaggaaggctgagctactgagaaaaatgggggaatttttgttatgtagccacagaagtagatttggctgcctaggaagaattgatggaacagatattgtaaactggtggcttaagttctgtattttgccctctaacatgtttttggttttggcccaaaatgtggttagttggttggttggttggttttaattagggctaacaatgaatattgggattttatagtaaaatctggactttggtttcttttgaaaaatgagataatccaacgacactcacccgacatttctggacggcaccagttgcctggagctgaatggtggctgccccattagaaaggccatggatgtggtcttcagtttgccacagtccctaccaccctctaaggtattctttgcagtgatcccagactgcttcacttagattccctgcttggcagctgtaggcatttgagtttgttacccttgtcagaaggtgaactgtgaggccaggcgcggtggctcacgcctgtaatcccagcactttgggagaccaaggcaggcggatcacctaaggtcaggagtttgagaccagcctgaccaacatggagaaaccccgtctctactaaaaatacaaaaaattagccaggcatggtggcgagtgcctgtaatcccagctactcaggagactgaggcaagagaatcgcttgaacctgggaggcggaggttgcagtgagccgagattgtgccattgcactccaacctgggcaacaagagcgaaactccgtctcaaaaaaaaaaaaaaaaaaagaaagtgaaccatgaggagggcctaggagaagccaaaggaactaaggaactacaccatttgaaagggaggtggaggagctggccaagaaggcttgaagagcaaccagaggggcaggagaaagccaggagtactcttatgaagaggagggaatgccgaccagctgagcctagtgctgctgacttggtctgacacaaaagatgtgtcctttggtctagtcatgtggaggtcatcagaggaggtcatcagtaacctcggtgagagatgctgtattctcagggtgctgggtgaaaggctaattgtgagacgttgaggagtggacgggggtggggaatggagatagggttggaaacttattccagaagtttggctgtgaagagcaacttgtgttgaggaaccagaggactaactcagcatatcaccctggagtgttgattggacttgaatatttgcgcagactcattattttcatgtgaaaataaaccaatgataagacatagatatgtcatagattagcgagctctcaggatggaggagagagagaagatggaaatattaggtttgggctaaatattgaggactttccttttgcgaggcactgtaatccctttcacatgttgttatctcacatagtcctcaaaatgagcctatggtgtgtatatctggaattttcctcatttttgtggatgagtaaactgaggcttagagaggcatggttgcagagctggtaagtggtagagccagggtttgaatctagctatcacagtgaatgtctgtatacttagctactttaatttccctcataaggatcttcagctgcttttactccctgctgtaaggtatcagtatcatttgttgaaaagacttttctttgcccattgaattgctgtggcaattttgttgcaatcagttggccatataagtgttggtttatttttagactcttttctgttccagtgatttgtatatctgtctttttgacaatagcacactgtctgtatattatagctttataataaggcttaaaacctggtaatttaagtcctctaacttagctctttttgaaaattgctctggccaggtgccatggctcatgcctgtaatcccagcactttgggaggctgaggcgggtagatagcttgagcccaggaattctagaccagcctaggtaacatggtgaaatccgtctctaaaaaaaaaaaacgaaaattagctgggcgtggtggcgcgtgcctgtatttgggaggtggaggttgcagtgagctgtgattgtgacactgcactccagcctgggcaacagagaccctgtctcaaaaaaaaaaaaaaattgctctgactattctaggtcatttgcacatccataaattttagaattatcttgtcaatgtctctgaaaggacccgctgggattttggattgtaatcgtgttggctattgtgagacttttctcaaaaaggaattaatgaggcctggatctcatttcctgtaggcattaaagaaaattccactaagatgtgtgactgtaggccaaaggtcactaactcagtaagtgaggcaggtaaggaaaatgaatggaggggccaggaatgagatgatcatggcagctgatcctgggccatcgtgaagggataatagggtacagtgaggacttggcaaacacgatctaagggggtggcctcttctcagcttcatccagcgatgccatgcaagaacatgggttcagtgttgtctgatctttcaatcaggagaagttggaaatccatatttttatgcagtgtcctgattttttcaattgaaatttaatacactgaatgggtcaacatctggtgggtaaacagaacactctaggtgaaatgtggcctatgggctgccagtctgtgacctcggccttaggctaatcattctttggttcacatgttcatcatctgtaaacatgaaggtgttgaagacagtctcaaagttctttttctagctcaatgagtctaaatttcaaaagaggaaaatgtcaaaataactcagagtttgaagaggtagctgagatcagcaataatgataatatcttaagttgaccagagctttacatttgacataccactcttgtgtctgtgtcatttaatcctcactttatcttgtgcaggaggcgtcagagttgtttgcccaaccacacgggagttgcaggttacaaagtcacatcatccgattccaggtccagtgctttttgtttttttagagtctcgctctgtcgcccaggctggagtgcaatggcgccatctcggctcacggcaagctccgcctcccgggttcatgccattctcctgcttcagcctcctgagtagttgggactgcaggcgcccaccaccatgcctggctaatttttttgtacttttagtagagacagggtttcaccgtcttagccaggatggtctcgatctcctgacctcgtgatccgcccgcctcggcctcccaaagttctgggatttacaggtatgagccactgctcctggccttttttttgagacagagtctcactgtgtcacccaggctgtagtacagtggcatgatcttggctcactgcaacctctgcttcctgggttcaagcaattcttctgcttcatcctcccaagtagctaggattgcaggcatgcaccaccacagctggctaatagttagtagagacggggtttcaccgtgttggccaggctagccgtgttcttttttaacagtctttgaaggcttcggaaataggtgctttgggagggagagcagttatgggggattgtgagacggccttcagctcagttgagggcaggtccctatctggatttataacttagtttggttgaagtgtcaaggcttttgggtaagagttgaagcctttgtgagaactctctgaaggcaggaactttagcatacattcatcttagtaagccagtgcctggcatactacctgacacacagttaagtttttgtatcagtaaatcaatggataaattgatccttcaaaaaagaaatcaaaggctttaaatcaagatggctgagaattttgtccagagaatttcaagaatagtcagatgcttctgataagtacttttagaatgttaagattgaaagctgagagactttattcctataactccactcctagatggaaaaaacaccatgtcgtcctcctcatgtttgactctgagatttgggttttgattaataggttataactgtctccctgtgcagtacatttaagaaatcaaatacagcaggtataagggaagttaaagccactgaaggatttcgtatgcctttaaaatttccaaacaagtataagtctttatcttttgagaatacatattgaaatatggagtgataccatgtctgaaatttctgtcagtgaggcactgcgggtagtggagagggtaaagatgaaagatgattgtatataagttggtaatttttaagctagaagatggatagatggggtttcattatacttgtctttatttcacatatactatttgaaatctttcataataaatgtaaaaaggaaattatcagagagcttcataggttcaacaatgcttttggtaaaccaaacttcaccttttttttttttttgagtttgtaattagtatgatcatcgagggaaagatgggacaaaggaaaagagcatggcagaaatgggcatatgggctttgaggctgacagccgtggctcagcctcctgctagccacgtggcaagtcactgaacttccgagtctgggtctccaggtctgtaacagcaggagagtacagtctcatttgcatggttgtggggaggattagggatgaagtgggccaagtgtccgagaacagcacctggcccatcctaggggcttagatctggtagtgttttattattgttagagacagagagtgatgaagggtaaaaatctgccccagggctctcgtctataaccctttcttctctatatgaattatagtgccaagggttatgtaaccatggagctaatttattattttagaaacagaactcttaaagaccagatcagaccactttgagatttacaagaactgtaaccagtttattgctttttgaaaaatgaagtaaggaagaacttacaaagaaaagcatattaaaatggtgggatgccattttatacctattgaattgacctccttccttaccccaattaatggtaatatccaatatcaatgagtttttttggtgaaacttttctcatatgtatattataaactctttgggaaagcatttcggcagtatacgttgagagccaccaaaaggcccatatccagagatttagtaatcaccctttggaaggtgttctaaggaaataattcagaagaactgttatatacccactaaaaattactctgtaatagcatagaaaaggcttatgatgagcatgctaggttgtacctatcttatgatcacagctatgcagttcttaccataaatgtaaacggaggctggaaaagagcatgaagaagggaaaacagctaatgtgttagggttgtggatagtagcttagtttttctttcagaaattcttttattgttgttaaagattatgccagtgtatccaaacatacacactcaaagaccttgcaagaggacgttactatcatggtatatgggacatttggaacatgggtaagctctttccgaaaatagagtaatcaaaacccagaaagcaccggaaaccttgagggtgtgatcacttacgtcgagaagaaattgaaacaagactttcattcttgaaccgttcccctacaaaatactatactttgatgcttctttagatctttgctgttacctctcagcgttcttaaatcactttgtttccaggttcaatttcagaagcttcagcaactgcgccttacacagtaccatggaggatccttaccaaatgtgagccagctgcggagcagtgcgtcagagtttcaggtacctccagatatgtactttcttgaagctgaatggagtgtaaaaaatagacaaagattatcactaaaaagatgagatcttgaaggataagctgggcctaggtacagttcagtcttcttttggaaagtccattaatattctctctcatagtttctacagcatacgatagtgttatttcacaaatggctgaaggcagcactggcaagtagaattataacacaagcatatgtaatttaaaatgttctagtagctacattaaagaagaagaaacacgtggggttaattttaatatctatatttttcaaaatgcagctttctcatctataattttaatattacttaaataaatgtttggctgggcatggtggctcacacctgtaatcctagcactttgggaggccaaggctggcagatcacctgaggtcaggagttcgagaccagcccggtcaacatggtgaaaccccatctctactaaaaatacaaaaattagctaggtgtggtggctcacagctgtagtcccagctacttgggaagctgaggcatgagaatcgcttgaacccaggaggcggagggtgcagtgagcagagatcataccactgccctccagcctgggcgacagagcgagactgtctcaaaaaaaaataaaaataaaaaaataaatatttaatccaatatatccaaaatatgatcattttaacatgcaatcagcataaaaaaactgagaaatctcacatacttttctgtgtactatgtctttgaaatctgttgtgtattttatactcaaagcatactttaatttggaccagccgcatttcactagtttcatgtggctggtggctaccacatggctcagtgcaggtgtaagacacagataagtagtctgtattgcatttagattactgcagtgtcctcgggtgctttcatcgttcacatcagtggaaagccttgttcaaaccaatgtggaattggtgtttcagacaatggtatatggcactattgttaagacctgaattagacctgcttagatatcccaatctgtgaaacattaggagcctgtcattctaattatgcaatttaagattcggtgttaaagttgagatataaactttaagatgaagcattaattgattgtttggatgcctgaccattttaaaagcactgtcttatttctttgtggtagaaactgggttcacttttttgatgatgtcaaataaagccaaatgtattatttaagttggggacttccatttgagagtgctgataggaactccaaatataatggtgattagaaaaagtactacatgaacatatttgtaccctattgcaccggaatcttgtcttcaatataatgacaatggactctttaccatattactgcctgtattagagatctaccttcatatatcaaactaccttatatattaacccactgggttatttagtatccaaataacataggtctctgccttatgcgggatttcatacttcaggaaatacagcattgtgcaagtttgctgtgtctgagatcccaattttgtgctactttattgtcaactttagaggaatatagaatttactatgatgttcccctccggttgcattggggaatgggataaaatgataatccttggccttcccaggattctttttttctttttttttttttgagatggagtctcactctgtcgcccaggcaggagtgcagtagtgcaatctcagctcactgcaacctccatcacctgggttcaagcattctcctgcctcagcctcctgagtagctgggattacaggcgtgcactaccacgcccagctaatttttatatttttagtagagatggggtttcaccatgttggtcaattggtcttgaactcctgacctcaagtaatccacccaccttggcctcccaaagtgctgggattacaggcatgagccaccgtgcgtagcccccaggattcttttcatactgtttttgttttgttttgttttgtttttctttgcaacagtcacaaacttacacaatacttggaagtatagtccacttaatttttttttttttttgagaccgagtctcattctgtcgcctaggctggagtgcaatagcgcgatctcagcttactgcaacttccagctcctgagttcaagagattcttctgcctcagcctcccaagtagctgggatcataggcgtgcgtcaccacgcctggctaatttttgtatttttagtagagacagtgtctcaccatgttggccaggctggtctcgaactcctgacctcaggtgatccgcccatctcgtcctcccaaagtgctgggattacaggcatgaactactgtgccctgctgacataacttttttttcacttgggaataagttcctgacctgatgccccatcaccccctaatatttcactgtgtttttcctacaagcaaagacgttgttctatataaccaaaatacagccatcaagataagaaaattaacagtgatccattattacaatctgatcttcagactgcattcaccaaatgtccccctgctgtcctctgtagcaaaaggattcagttcagaatcacatgcagttattgcctgcagtctccttcagtctggaacagcttttcagccttttatttttgacattaattcaagtactcttaacgtttgtgatcctgtcacatttgaagattacaggccagtttttttgtagatataacccctcaattggggtctgcctaatgtatctttgtgatttgattcagactatgcatctttggcaggaataacgtagaagaagtgaggctgttatggtatcacattagggacatgattttgatgtgtcctgttaatgatgatgttctcttttatcaattaaggtggtgtccaccaggcatggtggctcacacctgtaatcccagcattttgggaggctgaggcaggcagatcgcttgagctcaggagtttgagccagcctgggcaacatggagagaccctgtctctactgaaaaaaaaaaaaaaaggccagatgtggtggtgcacgcctctggtcccagctacttgggaagccgaagtgggaggattgagtgcttgagtccagagagcagagatttcagtgagctcacatggggccacagtactccagcttgggtgacagagccaaaccctgtctcaaaaaaaaaaaaaaaaaaaggtggcctgtctgtcaggcttccccatttaaagtaactcttttcccctttgtaatgaataaatattttgcgaggagatactttatcctgatcttcattaaactttcaatctatacattcattttttatctctcggtatatggttttatgattttctattttattcaatctattataatctattattttatttattcatttttgaagcaatgaaagcacagatttattgaaataaaagtatgctctacagagtaagagtgggcttgaagcgcaagctaatctattatttttattttgatcttcacattctccccaattaggctggtgggagccctcttccgaactgagaaaaattcttgaaaaactgaggagagtcccagagcacagattttttttaagtaaatgtttttgaggtattatgtaaatacaatataatttataccttttttaggtatacagctctttgccatataatcaccaccacaatgaagatgtagaatagttccattaccccaaaaggttcccttgtgtctgtttgtaagtattctccatcccccacctccagcctctggaaaccaccatctgtagttttgactcttccagtgtcctattagtggaatcaaatgtccgtagtcttttgagtttttctctcacttagcatttgagattcatctgggtggttgcgtgtgttagtttcctagggctgctgtaacaaagtaccacaaacttagtgccttaaaacaacagaaatttattttctcatgttctcatgttctgagtccagaagttggaaatcagcatggtgtcagcagcaccatgaatgctctggggaagaatccctccttgtctcttcctagcttccgtggtctgcggcagtccttaacttgtagctgcatcacttactctctgcctctgtcatcacacgactttcttcattgtttgtctgtgtctgtgtttaaatcttcctctcctttttcttataaagaactagtcattggatttagggcctaccctaattcaatatgatctcacctttgcttgattacatctgcaaagattctgttttcaaataaagtcatattcacaggttctggggcttaggacttgaagatatctcttttggtggccataatttaacccactacattgcattgatcagtagttcatttctttttattgctgagtagaattccattctatggatgtagataatttatgcattcatcagttagttgatgggcatttgggttgtttccaccttttggcaattatgaataaatattctataaacattcacatacagtttttatgtaagtagctagtagtggaattgctagatcatacagtaagtgtatattaactttagctttataagaaatcgccaagctgttctccaaagtggctctactgtttcacattcttaccagcagtgcatgagagttccagcgaccctgtatctgctctagcacttggtatttcagagtttcaaaaaaatggtggttaaaaaacagaacataaaatttaccatcttaaccattttttaaagtagtttattggtatcttctaaaaccatttttaaatgtatagttcagtggtattacatacattcatattgtgcaaccaatctccagaattttttcatctgacaaaactgaaattctatgcccattcaataagaattctccatgttcccttcccaccagcctctggcaactactgttttttctgtctctatgactttgactattctaagtgcctcatatgagggaaatcatatactatttgtcttttttgtgactggcttgtgcttagtataatgtcttcagggttcacccgtgttatagtctgtgacatgatttccttccttttcaaggctgagtaacatttcattgtatgtggatgccacattttgttccattcatccgctaatggatacttgggttgccgccacctcttggctattgtgaataatgctgctatgaacatgggtgtgcaaatatctcttcaaggctctgctttccattcttttgggtacatactcagaagtaggattgctgaatcatatgacaattgtggttttaatttttttttttttttttgagactgaatctcgctctgtcgcccaggctggagtgtagtggcgtgatctcagctcactgctgcctccgcctcccaggttcaagcagttctactgcctgagcctcctgagtagctgggtttacaggcgcgccccaccacacctggctaatttttgtttgttttttttttttacttttgagatggagtctcactctttcgcccaggctggagtgcagtggcacgatctcggctcactgcaacctccgcctcctgggttcaagcaattctcctgcctcagcctcccaagtagctgggactacaggcacctgccaccacgcccgggtaattttttttgtatttttagtagagacggggtttcactgtgttagccaggatggtctccatctcctgactttgtgatccgcccgccttggcctcccaaagtgctgggattacaggcgtgagccactgcgcctggccttgtctagtttttaaattgagttgttaattttcttaatcagttgtgagagttgtttatatattctggataccagttctttatcagatatgtattttgcaaatattttctcccagtctgtggcttgttttttcattttctcaagtctcgaagagtagaagttttaagttttgaagtctagtttatcaattgtgttattttatgatttgtgcttttgtcttatctattaataagagttcttcatctaactcaagttcccgaaggttttttttctatgtgtttctctattagttttatagctctgtcttttacacttaagtaaattatgagttaatttttttgtgtggtacagggtttgggtttgaggctcactcattttgcatagggatgttaaattgttctagaaccatttgatgaagactttcttttccctattgaatgccttggtacctttgttgaaaatcaattgaccatatacatgtgggtctatttccggactcttctgtgtcattggtttctttgtctatcattttgctaataccatcttctgtgtcattggtttctttgtctatcattttgctaataccacactgtcttgattactgtacctttataggaaggcttggaattaggtaatgagagtcgtctttgttcttttttgaagctgttttgcttattttcattcctttgcttttccataacattttagaatcagcttgttaatgtctataaaaacacctgctaggattttatttttatttttttgagacggagtctcactctgttgcccaggctggagtgcagtggcacgatctccactcactgcaagctctgccccctgggttcatgccattctcctgcctcagcttcctgagtagctgggactacaggtgcccgccaccacgcccagctaatttttctgtatttgtattagagacggggtttcactgtgttagccaggatggtctcgatctcctgacctcgtgatccacccgcctcggcctcccagagtgctgggattacaggcgtgagccacaacgcccggccaacacctgctaggattttaaacaggattgcattgaatctatagataggttggggataattgacatctttataatatggagtcttccacgaagaagacttccatgtacagaaaaacagatttttattgaagttcagttgcttataatcatttatatacaattctccttttatttttattatattgatatatttttgattgacaaaattgtatatatttatggtatacgatacgatattttcataaatgtataccttgtggaatggctaaatcagacaaacatatgcatcctctcacatcattatcatttcttttgtggtgagaatctgctctcagcaatttgcaatatatgatacattgttattaactttagcaatcatgatgtactatagatatcttgaacttgttcttcctgtctactccttttatgtttgtaaatcactttggagtttacaaaatgctttcatatctgttattttacttcatcctcttactacaacattggttggtaagtgtagtactattttaatatactaaagaccaattttctatcctaatggaggatctcaaagtgcattctttttttctaacccaatgagcccttatgcaaagaacgtagacttatcagatgagtaaacaaaagccaacttttcaggctgccttctgataatctttagcaaggggcagaccatcagtaaaggggtagctagggttatagccctcatgtctctaggcagggcctggcacacatacactgagggcagagaggaggaagtgggcattatcttcttctctgagagcgagggctagggctgtctcttctgcttagtggagggatagcatgttccagcctgtgtaacagctagggcacatgttgactgaatggcttgtcaggcagctgtagagagagggacaaagggcttctctctgtatagggctttgtaggtatagttgtagcttttcgtatccttttttttttttttttttttgtgacaaggtctcaaggtcacccagctggagcgcaatgatgtgatcttggctcactgcaacctccacctcctgggctcaagggatcctcctgtctcagccccccagggtagcagggagtacaggcgtaagccaccacacccggccagtttttgtatttttgtagagatagagtttcactatgttgcccaggctggtctcgaactcctgagctcaagcgatccacccgccgtggcctcccaaagtggtaggattacaggtgtgagccaccactcccagcctcgtatcctttatataacctaccctagtcctttcaaatcatatcactaaaaactaattgtactttttacatctctgattaactacattttaacaaaattgcatcatgtcatgtgtaactgagggcttttaagttctaatttagggaacaatctgatggtcaagggaagaaacccttataccaaggcagtttgcaaaggcctggagggccaggtccagcaaggtggttttcctggggcccactaccaatatgagtagtataatgaggcccagagttcgcatagcaagtaagtaagagaaccaggacttaaaaatcatgtctttgacttccagttccatttccatggttttcctttactgcatttcctttcaagttttcataaggttctttaaaggaaaaaaaaagattggcaaaaagatacatcagttaaacaaaagaaaacctaagtagcagtattaatctcaaaataccactactaaccacagctgacatttattgagtatgtgctatgtgccagacactgtgttaagctctctatgtagatggtaattgtcatagcattatatgacttttatgtgataaaacaacatagcaacaaattgcaaaaaggaaaaactccaagaaatgagaattcgacaatagcacaattctagatttttaattcactacgactgagccaatattcaaaataaagataataaagagttacaccattaacaaatcagaattactgtataccaaaatttattccctagagtttattctctaaaaaggtaagatacctttctagatatttctagactcattttaaaagcaatacttctttttctgattataaatgtaacacttgcttattacagaaaactggttacatcttttttcaccatttggccttttctttcagtagttttgcagtgactataaatattttttaacaaaatcagcctcatatgtatgtatagttttgtattttccttctatgtgttcaatggttttcagaaacagtatttctagtgactacatgctattctgtcacatggatatgccacagtttcactgcccccttattgtttgggttgttttcactctttgttcatggtgtgtgtgtgtgtgtgtgtatgtgtgtgtgtgtagtgtaaattgatcacatactgggccaaataaattctcagtaaattaaaaaaggagaaattgaatctgaacataattaataaaattgcaattaataattaaatttaaatttaaaaatccagctatttgaaaattttaaagcctttttaataactattagatatactatcaggcaggctgggtaccatggctcacgcctgtaatcctagcactttaggaggccgaggcgggcagattgcttgagcccaggagttggagaaagatagtgaagagctagaagaatgccttcactttgaaaatctgaggaatgccttggatccctcctgaggaaaatatgtaaatatgtatacatgctcttattcacttattttattttattctttttctttttttttttttttttgagacaggtctttctctgtcacccaggctggagtgcagaagcgtgatctcagctcactgcaacttctgcctcccaggttcaagcgattctgctgcctcagcctcctgagtagctgagactacaggcgcctgccaccatgcccggctcattttttgtatttttagtagagacagggtttcaccatgttggtcacgccagtcttaaactcctgacctcaggtgatttgcccgccctggcctcccaaagtgctgggattacaggcgtgagccaccacacctggccccattcacttcttttaaaaaagttttattagtgaaaatttcaaacagattacactcatttttgcttaaattttgatcctgtgtcaagaactcttggcctaggatgacttacatttgtaagtttgtattaaatatttaaaaattggctgagtgtggtggctcacgcctgtaatcccagcactttgggaggccgaggtgggcagatcacctgaagtcaggagttcgagaccaacctgaccaacatggagaaaccccgtctctactaaaaatacaaaattagccgggcatggtggtgcatgctgtaattccagctacttgggaggcttgaacccgggaggtggaagttgcggtgtgctgagatcgcaccattgcactccagcctgggcaacaagagtgaaactccgtctcaaaaaaaaaaaatcatttcccttattttcctttgcctgtttttttttttttgagtctataaaatgtatttgatggaaaattgtggaaaatgttttagtaacttagtacaaggttaaacaagcagatggcactgtcatggagttatttgaagtatatttgctgttgctattgtcccctttaatactcaagcagccttttagcagcctttgaaatctcatttgtcctcatgcagataatccagttctgtgtgcatatttgcatgtcagatctcgaaacctgcttttttttttgttatttcaaggtaatataaagtagcatataggtaccaccatgcataatccagaacccctttgctttccatggaagccaacctctcagggctcctgccccctcactgaggatgcaggcctgggaaaggggatcagaaacgggtttgtagggaaggatgagctctgcctgtcctgttgcccagggagcactcctaataatgccaaggagctcaattccaagcaggtgagaagcttacggaatgaaacaagagaggctgattctcattaaatattttcaggttgtgtagggcagaacaatgagatgaacaaagcaccgatctgtcctctacttcctttttctgaaaggaagaggtgaagtttcttcatgccatctggacagtgttggggttacataattagactcctcccgactgagtctccttaggtaaatcacagaattctctgactcatctagaagtgatgataatgacggttacttgatagagttgttcataaggatctaatgaatgcggaataaatgcatatctctggaaactaaagtactaagcaaaagtcagtagtatagtaatacaaatcgtgcttaggaacaattgtgaagtaggaagtttgtctttatcactttctacctctttttttctgtgcttcttactgtctccccctcaccgctgctgtccaatatgttagtcactagtcatttgtggctatttccattaattaattgtatttaattaagattaaatacaattaaaaattcagttccttggttgcattaagccacatttcaagtgctcaggaggcacatgtggctggtggccaccgaactggacagcactgccccctattttgagaagtgggagagttcttggaggaggtaggcattctaatgctgcgttctaggtcccagtttcagcaccggattaagtcctcaccttcccttaagagcccagggctttaaggtgatcttcccttccctgctcgtctttatcagccaatcagatttctatgccttggttgaagtgtttcttttagtggtaagcaaagcaccctgattaagttcatatcaaaaactttgaacctccacttaactgctctgagtacaagcatttcaaaaaaggatgcccccaaaatcagatctccgcttggtagaatttctcactgtaaaatgtggcggttcctctgaaagggtgtgtggtaaggcgcgcccttacattacattacattacacacacgcacacacacacacgcacacacacacacacacacacacaaatgtcttctaaaggaacagactgaccctgtgaaggtgttgggtgtcgtggtctcctgctccgtccctactccaagagtggtgttaactacttttctttttcactcttcattaattgattaataaataattgaattggcaaatgtttcccgagcgcctgctgtggcagcaggtctgtattaggcacaggacacatagaaacgaagaaattggcccttccacagaagtcagcagcccagttagtcctcgtttaacaccatcaactctgtgtccagtactgcggcccgagcagccggcatctggccactgcccctcggtgaagaaggctgctctgccttaagccacaaatgaccttggaatctcagagactattccaaaatggttctgtcttgagtcacagatcagagagtctccacagagatctcaaagtagcttcttgtgtcatctaatggtcttcagaaattctgtctctgtttctgtggtcagctcccagctgctcattattcctgatcacccctcatctagttcttttgtctcctggagtatgggcagtgacttgtggaaactctgcttcctttcgtactccctaggatgagctgtggtgtgataaagatgactcgggcagcaggcaaacctggtttgagtcctggttctgccactcttttaatctatgatttgggcatttcctcaactatctcagtctagttttttgtatgtgaagtggggattataatagtaattatccataggataaactgagctaaggggaggcatgaggccttgaccaagggggttttggagctggattgtgttaagggaactggggtgtaaagaaaactgattccttcccaagcatctaactaaattctgatcatgtgtagtcattcttcatagtttgtggcatagttctttgctcagaacttaaatgtgagagggaattttgttcccaaggttataatgttatatttttttcccttagccagccctactcttggtacagcatgctctctgccagccctgagacaatctgcttttatccaaatactgttagatgtaatgaggcagggcagtgaccttgggcttctgcatgagatttagaaggccacatttataaattattttagcatgaattatttccgggaaagatgttcactgattactaatatcatctattttatgttgtttcttattttctttttcagagattgacatttttctgaccttgtctgaattctttttaagagttcgtacctcctgaactacatgcactttgcaactctgatttttgtactgtgtctgtgtgtgatgtgctcactggtttgcctttgattttgacttccagcagcatgtccttctattctgcctaaggaaatagtgagaagcacagagagttagggggttacttaatagttttggaatgtgcatctgtcccgaaataggagctgtgaccaagaatatggttgtcgtatttttaatccatattcgaatcatttttcccttcctttttatctagccgtacatgttgaatagaagacttatagaatgagagagaaaagtagataactcatgaatctctaatcatctgggataaagcctttgtttgaaattatagaaggggcggggaaacgttggtcccacacactgaattaggaacatctgtacccatgagaacttgagcaagagaactggaatattgccattttcattctgcctcctacgtgctctcaattgttcatgcagtggaggggcagcaatagcatggatacttgagatctttaaaatacccctccaagtaatgttttaaaagactgaatcagattccattaatcgaaaattttcatgccagtaaagttggaagagatgggaatgtttcctgagaagtctatccatgggataaaaccaatgatctacttgaaaagaaatacgacaagtactaaagtgacaacatatactttgccttaaaatattatggcagaagctttagggcagtacagaggctgcatagtgtgatgggcaaaagggtcatactctgaatccaaatgtggcctctgccactttctagctgtgtgaccttgggcaaaccacttagcatgtctttgcctcatttttctcacctgtaaaatgggcatagttctaatgccaatatcagagttttgtggagaagaataaatgagttgttatacataacacccttagaacagtggttggcacaaggcaagcacattagaggtgtttcctctttttttttttttttgagtcagagtcttgctctgtcacccaggctggagtgcagtggcgtgatcttggctcactgcaacctccctctcctgggctcaagcagttctctgcctcagccttccgagcagctggaattacaggtgtgtgccaccaagcccagctaatttttgtatttttagtagagacggggtttcaccatgttggccaggctagtctcgatctcctgacctcaggtaatcctcccgcctcggcctcccaaagtgctgggattacaggcatgagccaccatgaccagccaaggtatttcctcttataattgttcctattgctcctgcttccactgctgtaattccttctgccatcgctgacacctctattgccacaactacagcgtaggcttgggcgtcagcctggctttgagttctagcactgctgcttacctatttaagtccaagtcccatttctatatttgtaaagtaggagtgttactagtacctacttcacaggacctggtgaggatgaaatcagataatacgtgtgaagcgcctggtgcagtaaatgcttatggttttgttgttactgcagcagctctcaaccagggatcctcccacaccagagtgttgtactccactatgggttgggttacaagttatgtttcttactaaaagtaccaatggttgggaattattttttaaaataattagagttaaatcaagggtatccccaccctgacaatattgctgttcacttctattttgagaagtgggagagtgcctggaggagacagccctgcccttctacaattggccatactctggctatatctacagctgttgggatatgcgggtgggggatgcacatgtgaaaggtgagtgctttgtgtgggggcagaaaacaaatttgagagttgctggccttagggtgctgtcatttctgctgcagaatgtaccactcgtgctcttccatgtggcagcccccctttttagttgattgcccagaccaaagcatcattatcccccaaagcccaactgttcttatcttgcctaaacatatatagatgccaggaaacatttgttctgactattaaaatcactttttattatattaagcagctactgtaacttgccctgaatttattcattaataagtatttatcgagtgcctttatgagtaagatattatctggtttatgaagaaaatgcagacactatcagtttaagaagctcataatcaagtatgatagactaggaggatatacaataactatagcacaaagacgttaactctagtgttctttttcttttttctttttcttttattttttatttttgagatggagtcttgctctgtcacccaggctggagtgcagtggcatgatcttggctaaccgcaacctctgcctcccaagttcaagtgattctcctgcttcagcatcctgagtagctgggattataggcatgcaccaccatgcccagttaatttttgtatttttaatagagacggggtgtcaccatgttggcaggctggtccgaaactcctgacctcaagtgatctgcctgccttggcctccccaaagtgctgggatttcaggtgtgagccaccatgcctggcctctttttcttttttagcttccatttttaaacctttacgttcaggaaaatacattgcatttgtttatagcttgttccttaattctttgtttttcattataaaagtaatatgtgctcattgtgtaaaatttggaaaatatgtaaacattaaaaaggaacagaaaaaatgagccatttttcatcaactagagattaccattttaatgttaagtttatttttcatgtatctttatacaggtgatatcagtcttcatatttatattatttttttctttttcaaccattatataataattatttccctatgtcattaaaatactttataagtataattttaatagctaaataatatttcatcatatatgacttataatttacaagcatttccccaacggacattttagttgattctgatttttttaatgaataatatggtaataaacacttttatgtatgagtcatccatatttctgatcatagatttccacaagtagaattctgaaaccaaagggtagaaatatcgccaccgttgttaatagatgtggtttcattactttttggcaatgatatttaccttagcaaaacttctgacactgatggatttggatatttattaccttaaggataggagatccttagctttttcagatctgacgttccaagtgtatgttgactgttcaagaatgactccaaagttcatgacataaagtagtttgcatatttactgaagcacaaaatttaatcacacgggcctagaggctggtgagtgaccaaggctgcctagcaaatgtttcattggggcttcatggatctctgtgtaatacgtcttatatattgacttaaaaacttaatttgtttgaaaatggacagcttttgtgaaaatcaaaagggccattaatttatggtatacaattatgcacagaaaatctacagccgtcagagaaatatgactcaagaaaatactgagagttgatatagatactttcatattaaaatagaaggtttacaacggtctactacttttcaatgactactttctaattgcttaatagtatgtattgacttgtcatttctagaaaataaatctaatttcatttttagtgccaaccattggaattattctctttataatcaccacatggctatatatatatatatatatatatatatatatatatatatatctttataatacaatatgaaaaataaatacattaatcaaattatcagaccgagcttctacagatgtttgccccttacttgctttaattttaaaagttctctttggcaggaatgtcttatactctagctagggaagaaaatgtgtagaaaacaattttaatcagtgtctgggagtctgagaacaaacttagcaaatttagcttagaacaatcgcaagtttagcttagcatctttccttaaccttgtacttctaggtaggaccgcctacactgccagcaccccctcacagtctaggagcagcttctctctcccccacattttgagctgttccccttgaggttgctttctcgccctttgctgacagggaggtggtggtagctgcatttgtctcccatctggtccccagaacgtttcttgcttttgttttacagtcttgtgacaaactagcacgcccccttcctatctcagggcctggcttccccagcccccaactaaggtctcagacacgtacaaatggtgcccctctttgaggggctcgtacatctgcacatctggacctttcacatagtgatctgttaaaggcatagaatcagcctgtaatatgctgagatcaccctggtaatatggtggagtacagacagagccgggtctgtctggtttctggctctgtagccttttcccctgggtctcctggggccacttgaacctgactagccagcctctcacccatctctaggacccagcctgaactgaggcagagggactgaggctgcctcacactctgtaatttggcctcaagtcaccattgctggccttgtgcctcagctctgataactggactcttgtctggctcctgcgtgccagaatcccatggtaacctgcctcgtttccctgtgccttgtttttatcagcctgcctcccagggattgaaatcgtgccctgaaacacagtgaccaatgcactttcctgatgtcaaccaccccacttgcctttctgattggattccagagtaccttaaatttctcgttgttctgcagtgcctgtagtcaggaaacctctgttctggacacttttctctgtaaatgacaacttagttcttccagttacttgtgccaaaaccttggagtcacccataactccttgcattgtctcacatcccacagctaagccttcagcaaattcttggttctgttttaaaaatgtatctagaatctgactaccctggtcggacccgttatcattttgtccctggattcttgcaagagcctcctgactgggcttctggcagaggagtcctgtcttctttcagtatattctcaacactgccacctgactgatccttttaaaatatgagccagattatctcactccccacagtcctccagcggcttcccgtttctctcagggtaaaggcaaagtgcaaagtgcaggcagtccctgtagggcccccatcatctctgctcttagctgcttaccacacatctctccaacaccctcctcactcactccatgccagccacactggcctttttctctgttccttgaaccttgcttaggatttctctaccaggaatgctttttttccagatatgtgaatggcttacttcctcacttccctcagctcctcactcaaatatcacctgtcagggaggccttgcctctctaaaatctaaattccctccaccgtctttcctgcttgatttttctcctcagcacttatcacgatccagtatactatatatatatatacatatacacatttatttttttttgagactgagtcttgctctgtcgcccaggctggcgtgcagtggcgtgatctcggctcactgcaacctccacctcccgggttcaagccattctcctgcctcagcctcctgagtagctgggactacagacgtgtgctaccacgcccggctaatttttgtatttttagtagagacaggatttcaccatgttggccaggatggtctcgatctcctggcctcaagtgatccgcccgccttggcttcccaaagtgctgggattgcaggtgtgagccaccgcgcctgtcctactatgtatttttatttatttatctcttttatattctgtctcctccaagccccctgggagcaagggtgctttggttcactgctgtatttccaaagtctagagcagtacctggccagggtatgagttccataaatatttcttgaatgaatgaatcaaatagttgagtattagcactattctgagaattttgtatgtattatctcattgaattcttacagtaaccttatgtgatggtacttttatgactcccattttacagatgagaaaactgagtcttaagaggttaggcgacttgcccaaaaggacctgagccaccacacaagtattccactagagcagcaagttagaataaacacagactttattattatccagatttatgttcaagttgcagctctgtcaattactggttgaattaaaacctctctaaactttaatatccttacttatgaaataattattctacctcccaggttattggaagaattagatgagatcatgggtgcattattttcatgtatattttcctgattgctggaaaagttgaaattttttcattttgtggttgtttgtttgtttgtttgtttttcgaggcaaggtctcactctgtcagtcaggctggtgtgcaatagtgtgatcttggctcactgcaacctctgcttcccgggctcaagtgatcctcccacctcagccccccaagtagctggcaccaccggcgcatgccaccacactcggctaatttttgttacccggctcatttttatgtttttggtagagatggggttttgccttgatggccacgttggtctcgaactcctgggtgcaagtgatccatccgccttggcctcccaaagtgttgggattacaggcgtgagccaccatgtctggcctttttcatgtatttaccggccattctggtttcctcttctgtgaatttcctgttcataaccttttctcagttttttttcttatcaaattgtaggagttcttcgaatgttagagatacatgttgtcttatatgttataaatagctttcctcataccatcatttgttgtttgatgatgttttttggaaccttcttttattcatctagttagcgctccaggtttggtggttgatcaaatacttgagaatagggatttattcattcagctagtatttgttgagggctggaactctgtgggatgtccattcagtcaggacacctctaaatcctgacttccagtttacgtcactgatgatggctctcatccttggttctaccagattcttgaaagagaatgtgttttctcagagccaagtagacccaaacatttcccagactttggccacataatcagaaatttcaaaagagttctggaatttgtgggcttagctccaagttaccaggcatccgttgtcttccctgtgggcagaattcgcttttagcttactccaccctcctcagctacgcagcatgattggggcagacgatgaatacttcagatatcccctgtggggttaactccagaggcagcctcagaaactagacacataattcatatggtcaaaacctggcaggctcttctgaaatcgtgtgacttcctatcaggccaccagctctgcagatcctcaaaggtctggctgtcagaacaatagggaatgagagcagcgcccagatgctgcctgctggagctgcaggtcctgtttgagtctgaacaataaaagtcctggaatgaattaccaaggctcctgattgcaccctgcaggttcaggtttagtttgtggagatgtctcacataagaactgtcttgtaagccgcttggggggttcaacaaaattggtcaacaaaatttaataccatacaagcccttttcttgatcaagcaatttagtaagtctctgtcataagtctctatgacctgccatccaatatgtcaaaataaacaaaattttcatgttgatggtcacaagtgcagtccctagagtggggatctggtgaccacttccaccactaactagcactggatcgtagacaagatcgttagtctctctgtgtctcagctcactcatctgcaagatgtggctactaatagtacctaagatagagctattgggaggattaagttaggtaatgcatgtaaatccttagaataatgcccagcacagttgttgttcaatacatattgcaaagttcctagtataaactccctgttgcagccttctaatttgacttcaatagattgttggtaccatttgcctctttctttgcaggtatcctacctaggcctagagaactaagcttttgctgttcattatatgaagcttcttaaatgtcatacaggctagttgcatcctactaattcttcacagactagataaaaatacttttgctgaagtcttaatcggcctgtcctgaagtcaaccaggctgtatgttagtgccttgactcagtgcagctttcaagagaggcagaaagaatacccacagagaaggcacatgtgggcggtggcagtgtaggaccaggaaagaagctaggtctctatattccctcgcattttgaatctgtgttaaattcaatcatattagtatgaagcaatcctcttacctatctccttaatccagcctctgactgccagctcacaaaagagggagaagaggcactacatttaaagtagtgattatctctaactagaattttaagtccctacatgttttggctgtagaaccagccaaagttttgttccaattccctacaaaatttcacaatagtcaggagttagaattggtccctatgttatgaaacagctagtttttatactttaaacttaaaatgaagctttagttgtttattattactgtggatattttccaagagacagaataacatctgtggaagattctacacaggccttgatgccagacattgtaattatttccctgctcaaaggcaatagtcagtgcctcaaggaactccctggctataagcagttggctgcctcgacaacagatagctaatgtcttagctcttttctgtctctaccgccagcctcttggggatgtgacttgagaaagctctcccctccccattttctcctgtaacctctttggaggaagtcaccagggtaaccactttcttttatgctagttttcttgagtgcaagggaaaacacttccccacagacatatgacagaagtttaagagtggtgaggagaagaacacgaacagttactgagtacctgagctatgctttgtgtacctgatatcattgagttcccacatcaaccttctgagataggcattatcatccccattttactgatgcttaaacagtaacatgcccaaggtcacacaagtggcaagtgacagtcaggactcaaacccaggtttatctttctcgggcctttgctcttattttgcaaattaagcaagtgtagacacacaaaaccaatttgtttttacctaggaaacgtgttttatgctttgtttttctcagtctggatagatgccgttttctagtcccctggaaccatcgtatgcccagtttagtaccacttttgtttggtttctcgtcttagaatatattctgcttattcactcccccggccacctgagaaatctttttactacttttagtccaaatcaaactttccttcccttgactacctaggaagtctctccttgggtgagtcttaactcgcctgaactgagagtctcaccctggaacttggttaagaaaggccagagttgggaggcaacagcctggatggaagaggggggtcagttgacactggagggggcaagccagaccagccgcaagcaggagccaaaaggtcagaaagccagtgagaatggggtgggccaacaggagcagaccaggccacacaggctgtgactcccccttgcagtggctgctgggcactggccatgcctgtgcttgtctctctcagtatctcttactctgccatcttgtcattcatgaaattgctcaagagacgctttctaccagtccgtgcctgcttagtctccgagaagttttgggggttcatttagaattaattaatttagaactagcatttaaaagttaaacgggctgggcatgatggctcatgcttgtgatcccagcactttgggggactgaggcgggtggatcacttgaggtcagaagtttgagaccagcctggcaaacattgagaaaccctgtctctactaaaaatacaaaaattagccagatggagtggtcaatgccggtaatcccagctactcgggaggctgaggcaggagagtcacttgaaccgaggaggcggaagttgcagtgagtagagatcactccactgcactctagcctgggcaacagagtgagactctgtatcaaaaaataaataaataaataaaataaaaataaaagttttaaaacagcttataaacttgagttaaaatataactcaagtgaagcagagagaagaatattaaaggggaaacatttaatgaggagcaaagcatagccttgaccgagcttctgctaagagcggatggctctcacttggcacagacatctttctgtattgcactacttgccctggcagaggcatcagaactgttagaaccacaatggactgtgcagcacttttcatgcaacactccccctttaaggttagccaaccgagagcaagaaaaaataggtaataagctcaacattactcagctagtaagtggctggtacaggaatcaagttctgcttacttagtctgaaggttttcagccacttcataccatttgatcaacatatttgccctttgtttttgaatgaaatagaaaaaataatttccttctttccttctttcttcccgccttccttcctttttttcaaacaaaattactgccatttatattagtgtttctaccacttctatcatgaccactgctggcaaaaatgtactgaacttttgctgtgcatcaggcaatatggctaactaaggctttgcatacatcatttactctttctagtaaccccagagtaggtactattactgtctctatttacagggaagactgtggaggccaagaaggattaaacaatttccctgcatcacacagccaaaaatggtaaagccagatttgaagtccaggctctttgattctggagttcatgctagtaactaccagctctccgtctggcagtgttttgttcttttgttgaattactaaaacagaactattttctctgaatgcagaagttgaaacctgttgaggaaattcaaccagagtatttcttgaagaaaaaagaaaccatttcctgatttctttatttgttaaccctatgacatcattagggttggtagtagctgctcctttgccttcacacacaagaaaaaagtgtgcaaatagttcttaggaactactgaagctgttcagaggaccagaagctagaccctcctctattattttctctgccctacgtctggcctttttagcttgtggaacttatcatccccgccatccagtaaaggctacaaaggccccgagactagtccctgcagttactactgatgttcttttcttgcttctcatctgcttttactaccagttctgtcttgcccatggtcaaaccattatctctaaaactccaccttctaagctacctctgacccttcgaatttgccatggttagaaaaatcaggaaaataggaaacctaaccagcaaagaaacatctgggagtgtatttgttgtcactgtaagcaatgacacatagattaaaacaataagataccataggcaggaatggatagagtatggactcaagagtaaggcagcttgggttcaaagcctgtctctacccattacaagccttgtgttcaacaatttaaccaaccttccttccttccttccttccttccttccttccttccttccttccttccttcctttcatggagtttcgctctttttgcccaggctggagtgcaatgatgcgatcttggctcaccgcaacctctgcctcccgggttcaagcgattctcctgccacagcctcccgagtaggtgggattacagacatgcgtgaccacgctggctaattttgtatttttagtttttagtagagacggggtttctccatgttggtcaggctggtcttgaactcccgacctcatgtgatccacccacctcagcctcccaaagtactgggattacaggtgtgagccaccgtgcctggccaatgtaagctttctaagtctcggtttcttaatctgtaaggtggggataataatagtagcacttcacagtgtcgtgaggattaaacgagataatgtatacgaagcatctaacactgtacctagagcatataaatgccaataaaggctaattatcaaagtcataacttagcctttttacccattaaattaggacaaatttttgagtgatattcagtgttggtgagtgggtaatgcaatgtgctcttgtatacaggcacaccttgttttattgtggtttgctttttctgctttacagatactgtgctttttacaagttgaaggtttgtggcaaacctgcatggagcaagtctattggtgccatttttcaatggcatgtggctcacttcatgtctctgttgcatttcagtaaatcttgcaacatttcaaactttttcattattatatctgttatggtgatctgtaatcggtgatctttggtattactgttgtaattgttttggggtcccgtgaacatcacccacataagttggtgaacttaatcaagagaaatgttgtgtgtcttctgactgctccattgatcagccattcctgtgtctctccccctccttgggcctccctcttccctgagataacaatattgaaattaggcctctaagtgttcaagtgaaagaaagagttgcatgtctttcactttaaataaaaagctgcaaatgattgaggttagtgaggaaagcatgttgaaagccaaggtaggacaaattcttgaaggaaattaagtgctattctgatgaacacacaaatgataagaaagtgaaacagccttatttgctcataaggagaaagtttaagtggtctggatagatcaaactagccaccacattcccttaagccaaaggctaatctagagcaaagcctaactctcttctgttctatgaagactgagagagctgaggaagctacaaaagaaaagtttgaagctagcagaggttggttcatgaggtttaaggaaagaagccatctcacccaggcgcagtttctcatgcctgtaatcccagcattttgggaggctgaggtgggtggatcgcttgaggtcaggagtttgagaccatcctggccaatattgtgaaaccccgtctctactaaaaatacaaaaattagccgggcatggtggcgtgtgcctgtagtcgtagctacttggaaggctgaggcaggagaattgcttgaacccaggaggcggaggttgcagtgagccgagatcatgccactgcgctccagcctgggtgacagaccaagactctgtctattaaaaaaaaaaaagaggaagaagaagccaactccataacataaaagtacaggatgaagcaagaattgctgctatagaagctgcagcaagttatccagaagatctggctgaggtcattgctgaatgtggctgcactcagccacagattttctttcctcctttcttttttttttttttttgagacagagtcttgctctgtcgcccaggctggagtgcaatgacacaatctcagctcactgcaacatccacctcccaagttcaagcaattctcttgcttcagcctcccgagtagctgggattataggtgcccgccaccacacctggctaatttttgtatttttagcagagacagggtttcactatgttggtcaggctggtctcgaactcctgacctcaggtaactcacccttcttggcctcctgaagtgctgggattgcaggtgtgagccaccgtgcccagcctgcattttcaacatagatgaaacagtctcttttggaagcagatgccatctaggactttaattcctggcttcaaagctccaaaggacacttcgattctgttgttagagactaatgcagctggtgacttgaagtggtttcaaaatcaacgcttattaccattcctaaaatcctagggcccttaagaattatgttaaatataccctgcctgtgcagtatgagtggaataacaaagccaggatgacggtacatgtgtttgcagcatggtttactgtacattttaagcccactgttgagacctactgctcagaaaaaaaagattcctttcaaaatattgctgctcaattcagtgctttttcttggttgataaaaaacaaacaactaaaatattactcctggctgggcttggtggctcacatctataatcccagcactttgggaggccgaggcaggtggatcacctgaggtcagcagttcaagaacagcctggccaacatggtgaaaccctgtctccactaaaaatagaaaaaattagccgggcatggtggcgcatgcctgtaatcccagctactcgggaagctgaggcaggagaattgcttgaacccgggaggcagaggttgcagtgagccaaaattgtgccattgtactccagccagggcaacaagagtgaaactccgtctcaaaaaataaataaataaataaataaataaaatatcactcctcgttgacagtgcacctaatcatccaggagctctgatggaaatgtagaagattagtgtttttatgccttctaacacaacatctgttctgcagcccatggatcaagaagtaatttcaactttcaagtcttattatttaagaaatacatttcataaggctatatatagctgtcatagatagtgattccgctgatggatcatggcacaaagcatactgaaaaccttctggaaagggttcactcttttagatgccattaagaacattcatggttcataggaagaggtcacaaccttatcaacatgagcaagagtttagatgaagttgcttctaaccctattggatgactttgaggggttcaagacttcagtggaagaagtaactgcagatgtgattgaaatagccagagatctagaattagaagtggagcctgaagatgtgactgaattgctgcaatctcataaaacttgaatggatgaggaattgcttcttgtggatgagcaaagaaagtggtttctagagatggaatctactcctggtgaagatgttgtgaccattgttaaaatgacaaaggattttaaaataccacataagtttattaaatcagaagtagagttcgagaggattgactccaattttttttttttaaatagtctcgctctgtcacccatgctggagtgcagtggtgcaatctcagcctactgcaacctctgcctcatgggttcaagcgattctcctgcctcagcctcccgagtagctaggattacaggcacatgctaccatgcctggctaatttttgtatttttagtagagatggggtttcatcatattggccaggctggtcttgaactcctggccttaagtgttccacctgccttggcctcttaaagtgctgggattacagacctattgactccaattttgaaacaagttctattgtgggtaaaagtgttacccagcagcatcacatggtacagagaaatcttttgtgaaaggaagttgatacagccaacttcgttgttgtcatattttaagaaatttccacagccaccccaacgttcagcaaccaccactgatcaatcagtggccttcaacatcgaggcaagaccctctactaggaaaaagattacaactcactgaaggctcaaatgatccttagcattttttagcaataaagtatttttaaattaaagtgtatatatttttcatgcataatgctattgcacacttaatagactacagtatggtgtaaacaagtataacgaaactttttttttttttttaaagagacagagtttctcccggtcacccaggcgagagtgcagtggtgcaatcatagctcactgtagccttgaactcctgggctcaagcagtcttcccattccagcctcctgagtagctggaactacaggcatatgccaccatgcccagctaataattttcatttgaaaaatttttttgtagagatagagtttttctttttggcccaggctggtctcaaactcctggctttaagccgtcttcctgccttggcctcccaaagtgctaggattataggcatgagccaccatacatggcctgtaaacaaaacctttttttttttttttttcttgagatggaattttgctcttgttgcccaggccgaagtgcagtggtgtgatcttgactccctgcagcctctgcctccctggttcaaacgattctcctgccacagcctcccaagtagctgagatcacaggcatgcgccaccacacctggctaattttgtatttttagtagagatggggtttcaccatgttggccaggctggtctcaaactcctgagacatatacctgttgtaaattggtatacgtcttttttgctttttgttttagaaacaggatcttgctctgtcacccaggctggagtgcataggtgtgatcatagctcactgcaacctcaaatttcaagattcaagcaatcctcccatcttagcttctgaagtagctgggattgtaggttcaccccgccatgcctggctaattttttattttttgtagagacagagtctcactatattgcctaggctgacatcttttcaaaaacagttttggaatatatataaaggatgttaagatagtaatattatttgacagattctactttggggacactatcctaagaaagtaatttaatatctgaaaagaaaacctgtagcctgataatgttgtaatattatttattatagtgagtaattgatttcagtaaaatatgatctatcagctcagtgcagtttgaaattatgaatgtaaagacttcagctacatgaaaaaatatattactatgttgaacaaaatacttaaaaaggaatacaattatatggactgatggttataggagtatatgaagttttcacacagttgctaggacataacttgtttgtctttagtgtctttttgacattgccaaaagcttctgacactacttttttaaaaatgtggcttaaaaaattgtcaagtaatgagcaaaacagagactctacttctgtgccttagtctcattgccagttgccagcctctgatttcaggtgggtgtgagggatggagggacaatgagggatgaggcagggctcggagatggtctaagaagtcacttgtatctcatgtgggtttcttctctcaaattcttgagtttctctttatagaccctcattagaaaagtcggttatgtgggcatcagtatgagcccttactcttgactccaccactgttagggacatcctcagtgaaatccctgacaatttcttcagtaatacatatgttatataacactcctttataatgatttttttggggaaagaatagtaattctttagatgctaacccagccggctgtaaacaaatcatggttctttaaaaaccatggctcacacctgtaatcccagcactttgggaggctgaggcaggtgaattacctgaggtccggataacagtaatgcatcctcataagagttcaagccagtaattaatgaaatacaaagccaaagtccccagaaatgagagatggtttgtgatgagagaggatctggggtgtctgtggtctgttacacacattacttgatgataaaaacagtgatctttactttggcttacaaaaggctcgtgcttcagcagagtgcagcaaaatgttccctgaccaaaacgactgtgtctgaagggcacagcttgggggaatacagctatgaaaaaaactacacgaggaacaaaaacattggatgaaaatagtggttgtatttggaaggtagaattataatcctccccttttctacgttcctaaattgtccataatgtggttatatttttttaataataaaagtccaatttaacaaatatttattggacactgcgtgtcagacacaatgcttgatgctggagatacaatgacccagacaggcacagtcactgcttggcggaacttcagtccagtgggagaggcagatgattttacaagtcattgtgacaccatgtgacaaacccacaatagaggagttcagagagtggctggattgtgtccgagtggtgcctaacccaaacgggttgggaggaggtcccaggaaaggcttcctggaggaagaggtgactaagctgggacctgagggctatataactgaagattggagtgaggagtgttctaagcaaaagaagctgcatttggcaaagcttggaggaactgaaagtttggtgacactggagcatagattgagcatgagaagggagtggtgagagatgaggctggagcttgaagtaggaaccagatcacaaaggactttgctttcttattaaggaatttggattttgtcctaaggcggtgtaaagctattggaaggatattcatttgcttgcctgcttgctcacttatttattcttccaaatttgttgtagaaactcaaataatatggaagcatgaaacatgaaaagtaaaagtctccccttctctacttcacaccctccccccagttctaatccccatggtacctattgctaagtgtttcatctgcaccctttctgcagttttctgggaagtatatgcaagcgtgtgtgtgtatatacatattttctttctacacaaatggaatcatgctatactgaataactcccatcttaaaagcaaaacttgactgggtgcagtggctcacacctgtaatcccagcactttgggaggccgaggcaggtggattacctgaggtcaggagttcaagaccagcctggccaacatggtgaaatcccatctctactgaaaatacaaaaattagctgggcatggtggtgtgtgcctgtaatcccagctacttgggaggctgaggcaggagaattgcctgagcccaagaggcggaggttgcagtgagccaagattgcgccatcgtactccagcgtggctgacagagcgagattctttctcaaaaaaaaaaaaaaaaaaaaggcagaacttgatacaccttaggtatctttctatgtcagtacctaaagatatatattctttctaatgacagcagcacagccatttatgtagctatcccatcatttatataaccagtctcttattgagagacaattagattatgtctagtttttcactattacagaggaaaactgcagggaacattcttgttatgatatcgtgttggatatttacataagggtatttgtgagatatgttcctagaagtaaaatagctgggtaagaagggttgtacatttaaaattaaggtagatattaccgtattattccctgttaaggtgatatcaatttctactctcaccaacatatgagtgtctgttctttcatatactcttccccactggatatatcctttttttgatttctattttttgagatggagtctcactctgtcacccaggctggagtgcagtagtgcaatcttggcttactgtaacttccacctcccgggttcaagcagttctcctgcctcagcctcctgagtagctgggattacagctgtgcgtcaccatacccagctaatttttgtatttttagtagagacggggtttcaccatgttggccaggctggtcttaaactcctgacctcaggtgatctgcccaccttggcctcccaaagtgctgggattacaggcgtgagccaccatgccccgccaatatatccattttttaaaaaaactgtggttaaaaaacacataacttaaaacttaacatcttgatttatttttaagtttacagttcattagtgttaagtatattcacattgttgtgtaaaacagatctccagaactttttcatcttgcaaagcagaaactctgtacctattaacaactccccatgccacctcccactagctcctgaatcaccattctactttctgtttctatgaatttaactattctaggtgtctcgtacaagttaaattacacactatttgtctttttgtaccagcttatttcacttagcataatgggtagaaacaagtcacaggtgttgcctctactcaagggcggggattccacaaaggcgtgaacaccaggaggtggacatcattgtgggataccttggagtctgtctaccgtaatcttccttgtatattccaaatattttctccatctagtagtttttgtttgggagttttatgctctaatttgtatgagttaaatgtgttggtctttctgtgactgctgtgttacaatttctagtatgtttagagtggccttaatcatgccaagatttcttaaacattcacccgtttttcatccatattgtattctaatgctattattactttggaatttattttgatgtgagatttgagagagggttcccattttttttttcctctgtagctaatctattgtctcaattcttgaataatttcttttttacatagcttgttctgttttttactgttttttttcccattgatatggctacctattcctctgtccatttccacatcagtatattattgtaactttgtaatatgttctttgattttacttttagttatgtttttaggcagatacatatgaacatacattcatgtggtctaagattaaagataagcaaaaagtgcagtgaacagtatcctctccatctctgtcctagccacccagttcactccccacaggtgcaaccactgttgtcacgtttatttattccttcaggaatattttatgtatgtatcagcaaatgtgaatatatagtccacctcatgccacacttttctctgaagatagttgaccatacacatgtctgtaccttgcttgaatgaagttaagtgaataaagttaagtgaataatacatcttggagatcttcccatgtcagttcacaaagtacacctttatctgttttaaaaattagtacacagtattcttttatatgactttgtcataatttattcagctagttccctattaatgaacatttaagtaatttacagattttaaaaaaatatataaacttattggccgggcgtggtggctcacacctgtaatcccagcactttgggaggccgaggttggtagatcacgaggtcaagagatcgagagcatcctggtcaacatggtgaaaccctgtctctactaaaaatacaaaaaattagctgggtgtggtggtgcgcacctgtagtcccagctactcaggaggctgaggcaggaggatagcttgaacctgagaggcggaggttgcagtgagccgagatcgcgccactgtactctagcctggtgacagagcgagactctgtctcaaaacaaaacaaaacaaaaaaactatgcttcaatgaacaacattatgcacatacagtttcatacatatacaggtatagctgcaagaaaaatgactagaagtgaagttgctggggcacaagcatatgcatgtgtagttttagtagatattgtcagttcaccctccctagaagttgtacattcctctctgctgtatatgaaagtgcctgtttgcccacatcctccccaactcagtgttttgtcaaactgtttgatctctgttagtctacatagtagaaaaattatgtttctgtttagttttaatttgtgcatttttcttatgagtaacgtgtgttttttcctgtttatgaaccatttgtattatgtttaccgtgaacaatctgttcatatcttttgcctttaattcttttgtgtggttgatctttttcttactgatttttaggagtttttatatattagaaaaactagccatttatctgtgatatgagatgtaaatattttccacatttgccacttgtcatttgactttctttatactgaaattttttttctaacagacattacaattttttcatgtatcaaaagttaatgttggctggatgcagtggctcactcctgtaatcccagcactttgggaggctgaggtgggtggatcacctgaggtcagcagttcgagaccagcctggccaactgagtgaaacccccgtctctgctaaaaatataaaaattagatgggcgttgtggcaggtgcctgcaattccagctactcaagaggctgaggcgggaaaatcgcttgaacccgggaggcggaggttgcagtgagccaagattgtgccattgcactctagactgggctagaaggatgaaactccgtctcaaaaaaaagaaaagttaatgcctttttggttgctcccaggttttttgttatagttagaaagttatcttcttttgtttttgctaacactttatacctttattttcaaatataaaatctttgatccatcatgtgcttatgccagtgtaaggtatgcagtgtgaatctggcttattttttttccactttgctagctagttgtctcaacactatttatgaataatcatcttttctccgatagtttaaatgctacttccatcataaactaaattctcatagtttgattggattttgagacttcctattctcttttattaatctgcgtgtctattcatacaccagaatcacactattttaattaatgattatagcttcatattatattttagaaacctggtaagattaattcactttcatgctgcttttcggtgatttttctaggctattcttgcatgtttatttttccagatgaactttatttatttatttattctctttacaccagtgttactgccaaccaaatgaactttaaaatcggcttgttgaggtctttttaaaaaatgcttttattattgggttttatgcagctaaggatatgatcagatttgtgttttaggaagattattctgactgcagggtagaactaggttggaggaaacaagattagagacaaaaagaccaatgacaagattgttgcagtaatccaggggagaatggatagatgaggagttgaggatagtattgggttcaagaggtgtttagaaagtcaaaatggccaggtgcactggcctgcatctgtagtcccagctactcaggaggctgaggtgggaggaccacttgagcccaggaaattgaggccagcctaggcaacacaatgagactccatctctaaaatataaataaataatacaatacaataaataaaaataaatagatggtcaaaatgaccagacttggtgatgactgagatgtgcagggatgaggaggaagcactcaaggatgaccccaaactttctgggttaggccgtcgagtggcgccattcccagcgatttgaaacacacgagataggggctggtttaggaggaagatggcaaattcacttctaaatatattgagtttgaggtgcctgcaggtagtcctagaagagtgtggtccagtgggctgttgaatgtataagtctgaagctctggagagacatctgggctagagagatggagtgatatgacagagccctgaggaaccccagcactaaaggatggtcaggaagttcaggagtgtgcgaagaagactggaaagaaacactcagagaggtaggagaaaaatgggacggcatggagccccaggagccaggagaagaatgttttcaatagagcaaactgtcagtaatttccagtgttccaagaggtcaggagctgaaaatgcccatttggatttagtagcgtgcaaagtctgtggttatcttgggaaatttcggtggagcagagggatgggggctgaggtctgtgggagttgaggaagtggagttgaggcaactccttcatcacaaagcttggctgtgaagaggagagacaccgggacaccggggcaaggaggaggaataggatgatgcagcaagttagcgacttttgtgtctcctccttccccagctttacgtgggagaggctgggccatttgtttgttttttgttttgttttgttttgttttgtttttttgagatagaatattgccctcttgctcaggctgccatgcagtggctcacactggctctcctcttcccagctgtggcacatcccagcggcagttaatcttgccactttcaatctccccattaccattataagtgctgggattacaggcaggagccaccaggcccagcctttggcccacatttaaatgcagatggaaagagctaatagaggagaggaggaagcagtctgtgatcctgttctttgaggaccaagtaatactgagaaggatataaggggttggagaagttggccaaatcagtctggcagagagtaagtcaattatagtgttggtatatgttccctgacagttttgacttttaattttgttgagctgtctaatatttttgcttggctattttgagaaggagcctctaagaaattggattcaggtttagaaatttagttgaagattaagtttaaaaagtaaggtacagacagtgtatcagtaagttaccatttgtgtaaaaagggaggagatatctgcactcccatgtttattgcagcactatttacaatatggaatcaacctaactgtccatcaacagatgaatggataaagaaaacaggttatgtatacacaatggaatatcatccagccataaaaaagagtgaaatcctatcatttacagcaacactgatggaactggaggccatttatgttaagtgaaataagagaaagacaaatatcgcatgttctcactcatatgtcggagctaaaaaagtagataccacaatgacacacagttagattggtggctaccagaggccaggaaagggagagggggatgaaggaagaaaagggatatttatttatttatttttaaatttttgagatggagtctcgctctgctgcccagactggagtgcagtggcacgatctgggctcactgcaacctccatctcccggattcagcagttctcctgtctcagcctcccgagtagctagtagcttggattacaggcgtgcgccaccaggtccagctaattttttgtatttttagtagagatgaggtttcaccatgctggtcaagctggtctggaactcctgacctcaggtgatccacctgcctcggcctcccaaagtgctgggattacaggcatgagccaccgcacctggccaaatgtatttattaccactgaactgtacatttaaaaatggtaaagatgggctgggcacagtggctcagccctgtaatcccagcactttggaaggctgaggtgggcagatcatctgaggttaggagttcgagaccagcctggccaacatagcaaaaccccgtctctactaaaaatacaaaaattagcgaggcgtggtggcatacacctgtaatcccagctactaactactcgggaggctgagacaggagaattgctcgaacccgggagacagagggtatagtaagctgagatcgcaacattgcacttcaggctgggcaacagagcgagactccatctcaaaaaaaaaagaaggtaaagatggtaaattataaatgcatgtatagagttatattatacacatatgtttaataaagagcagcagtaatatgtattcttatttgctgtacatgcataatcagtatttcaaaggactcacaagaagcaaaaaatctggtatcgattgtgaggtgggaactgggtcgaaggggagcgagaattgaggatgccttgtcactctccactgttatatagggtatttgttgagaatgccaatatattacttatttaaataacgtgatgtaaactgtttagttatctttaaaagtaatgattacaacagggcctgaattttcttatttactaatgattctaagcatctgtaatctgtctgttctgtgtctaagaagctaaatcttgctgtgtgcctgtgaggtgtggatctttgcctgtacagttggtcctccattatctcattatctgagggttggttttgcatatgtagattcaaccaattacagatcaaaaatattagaaaaaaaattgcatccttactaaacatgttttttctttgtcattatcccctaaacaatacagtatgacaactatttacatagtatttgctttgtattaggtattataaataatttggaggtgatttatagtatatggaaggatgtttgtaggttacatacaagtactgtgcccttttatatcagggatttgagtatgcatagattttggtgtctgtagggggccctggaaccaatccccctgcgtactgagggacagctgtgctccactcttccccactggggaccgacagccttggggaagtggacagtcctggttcttgggtcaaggaagaggaccatggcctggaacatcctggccctatccactatagcttgaccgagtgggctctaaggctggtttatagggaaggaaagaggaaatggggtagtaattattgtgtcataggcaaaagcctcacactggctgtccccttcccctgggaaaaaattctttagcatttctctgtaaatttcattgtgattttagagcatgtgtctgaatgattacatggagtaaacgtatttcactttttttttttttttttttttttttgagacagagccttgttctgttacccaggctggagtgcaatggcacaatcttggctcactgcaacctctgcctcctgggtttaagcaattctcctacatcagcctccccagtagctgggagcacaggcacccgccaccatgcccagctaatttttgtattttcagtagagacagggttttaccatgtttgccaggctggtcttgaactcctgacctcaggtgatccacccgcctcggcctcccaaagtgctgggattacaggcatgagccacctgcccagacacgtattttacttttaatctctagttttatattacatgctgattgcacatccccactcaggaacatcagaagaaatacaaaaagaggaaatatttcaaaactttgaaatcccacaaaaataatcacattcactaataaatatttctccttatttattttttagggtaccaggtaaggagactctccagtttagttaggactatgcctaatctgagttcccataaatcctcaaatgaactatatatgttattcttctggagactgaggaagctggttaatcactgttcccttgtctgggttctcaaaggttcagcactgaagccgggagccaggagaggatagcattatgacctttactcctcagtaactcctaaggctcacagagtggttagttttccctcccctgtctgtaggcaaaagtggggacttgcagataggaagaataggcttccttagtgtcagtcccgctggtttttcttcttcttcttttttttttttttcctgagacgagtcttgctcgctctgtcacccagactggagtgcagtggcgtgatcttggctcactgcacctctgcctcctgggttcaagcgattctcctgccttagattccagagtagttgggattacaggcacgtgcatgaccacacccagctaatttttatatttttagtagagatggggttcgtcatctggccaggctggtctcaaactcctgaccccaggtgatccacccgtctcagcctcccaaagtgctgtgattataggcgtgagccactgcacccggcccactggtttttctgtttgtttgacaaaaggaatgccagaccaactcagtctccaaacaagcgcccagatccagttatggctttaactgagattaaatggagaatctggtttcagggaccagttcttccatttttggtagcttggttcgttatggagactaaagttcttaccatgatgaattaaaaaaaaaaatttatttttgtatttttctgctgtttaaaccatgatgaatttttagcaacctctcatctgggcagattctcccaagagatagtgaatgcttaggaacactttacagctcagcctaagggagaacatatcagaagcatggctggatgagaaaggagtggcctgcctgggaaagtactccgttcccatcttcagaggggtctggtggcggctagatggcctttggtgaggatgctgtctggttgcattggctggcccggaagatcattccaaactctgtggcttatgagtccagacagaacaggacaaggacactgtgtgtgtcttttcatgagctagtggccagatgaggaaaagtaccctatgctcttttaaataaaaaacaggatgtaagtttttttaaaaattcaatatgctttatttagaattaccatgtgctttatctaactaaatattccagagcattttattctttccagacatgttttctcttatactttcctagttcctttgtgacatcgtatgcttattttgtcctttaaagttatcaacagtgtgaaaaaaagttgttttgttggctggctgtatggtagaaaacacagccttcatctctttttttggcatatatgtagaagttattgagttaaaactgaaaaggcacctttaatttatgacagtatcataactttaattaaaaaatcaaacttgttatttggaaatgtaaaatcttccccaaagtagaataaagaacccccatagactcatcaccagattcaatatttttcaacattttgccactcttgtttcatctgtcccctcccctttgttttttctcttttaattccaaattacaatctcttctaaactcagtgaagtgtcctaccaagttgaatcacagcggtggatctggtgtgattcagaatgcagtgggggtgaaaggagggagtcggcaggctgacaggtgcctgtcttttacatatatttcctacggcaggaagaggttggtgtgggatgaacagaggctcaggcactttgtctcctttcctgcttggcctgaagtgcctacctgacccttgtggcctccaagggtgcctttggccagttgccttaccagccactaggccggactcctgccactgctcaagtcttagttgatcaaaagccagttcttcccttctgcagttcctttctatcaccataagaagcaaatcagcttcctctggaggagataaatgggcaaacctgatttacccagaacatatttctctagtcattgtcttattagcattaaagttaaaaggagaactacactcaacggaaggcctccctcaccacccaaagatatcacaccaggtggggaggtggggatgggaacaggcagtttaaaacttctacttctgtggaggcttgggtggcgctctgtggaaagacagtaaagtgcctttagaggcttgggtctgcattcaccctgctatgccatccctgagaacttgaagctgaaattcttcattttatcgtggaaatttgtagctgtacagaaaagtaggagtagaataagaagctcccatatagccctcaccagtttttaataacgatcaacactttgcatttaaactttttgattatgcagcctagtagtaaaaagagttttatatccccaatttgggtatgttctttgttttttaaattatgtacatataacactgtattgttaatattaagtatacaaaaaaatagaaagctaagtggaaacagaacttctaatgttttccccataccctatgccatcctgtaaatcccctgggggtacacattcctctttggagccaaatcatttagaaacattatgtaattcagcaaacacgtgttggagcccactgtgtggctgacgctgtgcaaatgctggagggaagatgctgggggaggtctcactgcttacagcctgctccatcagggtcagggaatgaacatgatccatcttctccaggtgagaagctctgcctgagacatagaccttattctctgccttttcttgagcaggatcccccagcatgaactctgggcgtgttttatgcattgtcgttatttcttcttctttttttttagagatggggtctcattatgttgcccaggctggcctcctattcttgagctcaagcgatcctcccacctcggcctcccaaagtgctgggattacacgtgtgagccaccaccacacccagccattatttcttattttgagaaattattttgcctggccctctgtgatcattttgattggtctgattttgactttacctgctaaaaacaaaacaaccccaaaactgttttatctctatcattttctggagtcaccttttaacttagtttatctgttaactttacttcccttttatctttcatttaaaaatacagactaggaaggggcaacacaagggccacagacatggtgataggccaggtcctaaatcagcaggttgggtgctggtgccttctctggtctgttctgctcttcatctcttcttttcatgcctcacagcaagacttatttggtcctttggagaagattggatccccagatcagctggtcaaaaaaggcatagcctccaggttaaaaacaaacaaaaaacccatctaggtggttcaagggctctgaaagtctaatcacttctgcgagactggaatagactagccccaaagatagtgtagtgctggcaggctgctgggggaaaagccttccaaaacccagaacagctgggagcctcacaggagttttgtgaactgaagcccctgcctgctggcatacctaagcactgcagagggcaaaggaagagtgttgggggctgctgtcagagaggctggctgggtgctggcaggtctgacgctggagatttgttatacattttgaacttctcttgaagtttctcttttcttttttttttgaatgatgttataatagggtatttaaccaagtatgacatccttttttattccgcttagtttgtaaggtagacttaaatgatccatttaaccccaaggcagtgtgaattaatagcagcccctttgttgtggacaggccttcacgactcccccacttgtcatgagaatcaaaggaggtgctggcagtgcctagaatgatctccagctgggttcccaagagaggcacagttgttcctttgttatttagacttgtcctttttaaaagaggggggctataacatcttccattagcttcagtctgcatataaataaagagccctgcaagcttcaggaacctgccttacttcctaaacttgataaatttccactcttcaccaacgctttttttttttttttttgagatggagtttctttcctgttgcccaggctggagtgcagtggcacgatctcagctccctacaccctccacctcctggattcaaacaattctcctgcctcagcctccccagtagctgggattacaggcatgtaccaccatgcttggctaatcttgtatttttagtagacatggggtttcaccatgttggtcaggctggtctcgaactcctgacctcaggtgatcctcccgcctcagcctcccaaagtactgggattataggcatgagccaccgtgcccggcccccagcagaatttttaaaaaagagttgtggtctcattatgtcgtccagggtggacaccaacagaaatttatttagtactggtggccaatctgtcgcacatttgtcaagaactaaagaagtaaactaaagaagaaccaagcagcatcatgggcaagctggaggcccagtagagctaagtgatgagtttaaggatgccgttagagccaagcattaacggcagatagggtagatagacactaccctatctagtgtctctactaccagctacgtttccaaccagtctcctctcctacccaagctctgttggaaacagatacaaacccaagtatacagaggaattaagaagggttggggtagcattttaattctatcagaggaagcattatcgtcaatgaatagctttgtgacttttagctaaccgtttacataaatattaagttagatacttactccaaatgagactactggagccaacgtcaatttgtaggtgtgccgtttgtattgcatcatagtcaggtgtcttagcaagactgttaacctgtaattgaatcttaaatcttcagtggatttagaagaatgtaatacaatttatctggagaatttctttttcatttttcttttttgaaacaacaaggtctcgctctgtgccccaggctggagtgcggtggtatgatcatagctcactgcagcctccacctcctgtgctcaagggatcttcccacctcagcctcccaagtagctgggactacaggtgtgtgccactgtggctagctagtttttaaattcttagcagagacaaggtctggctatgctgcccaggctggtctcgaactcctgggctcaagcagtcctcccaccatgagctcccaaagtactgggattacaggcatgagccatggtgcccagtctggaaaattccttaatatttttttttttaacttctgtatatatcagtacaaatctgtgtaaaatctcaaaaagaattgattttatgtaggctatatagcaaaggaggcaaagcggtgaggtaaagagaatactgaatgaggctcgggatcctgagttttagtttttaggctgctacaaactagctctgcaatcttgagaaaaatcacttcagctctctgtaccttggtttcccatctgtagaaggaaagagcagaattccactccctcttgcttttacttgtgttgctttctctgctaagccagcaactccagttcccttcctttgcctatccccaccttattttcacctactgcaagctggaaaatgagatgcctcagtttgttagacctgggtggggtgtgatgcagaactggaggggttcctttctaactgctgtcctctggggttcttatccatttttgttatttaggggctttctttgctttctggctcaccactgagatggttgaaattgccacataaatgacccctggctcaagctagcacattgtcctcatagcataaaataatggtgacatcacattccggtgcagtcctctgtaatattgaagcttcatgcaagtacccattcccagtgttgacgatggtattccaggaaaatatgtgttgctcttgcaggagttttatcactttttttcttgatcacgagtcatcatgaggtctgtcattgaagctactaagagttgtcttatgtagaattgcttctgtttgagaatatcgattaggcacccctttgtacagatgctgaggttgtggtattctggatcaatactttttcaaagtattaaccatttatatgcttaatcctggttttctgcatgtttttaatatattttttaaaacttggtagaacttcttttttttttttttttttttttgagatggagtctcgctttgtcgtccaggctggaatgcagtggcacaatctcagctcactgcaacctctgccccctgggttcgagcaattcttctgccttagcctcccggtagctgggactacggactctcactaccatgcccagctaatttttgtgtttttagtagagacggggtttctgttggccatggctggtcttgaactcctgacctcatgatcacccaccttggcctcccaaagtgctgggattataggtgtgagccaccgtgcctggccctgtagaacttcttacatggaaggatgtatttggtcataccattagcatttagaaacccatatttcacttcaaggtatttggaaattacatttctcctgtttttaataactgtataaaaatacaactataagctaggatttattttgctacttagctgcagaagaaaaatgtatgtcttgattgttcacacataaagaatatactgtaccatatatgcttttgataatgataatcttcctagttgataataaacaacaactctccaattcttggacttcagctcatttcctaacttagcgtgggcttatgtaggaatctgcttatggtttaccagtcaagtaagatctggggtttctaattaaccacaaacataatgatatgccaacagtacagtacatctacccaaacagttaatgcaaatgtaggtcacattgatagatcaatagtgtctaaattagaggaagtaatttcccccctaggtgacgaaatctagttgcaacttttcagccattcatcccaggctgcagctttcagatgctatgtgataggtaggtgtgcacctacacgtaactgatatctcatctaactgagctctaggtcccttggggaagtactccgggagtatggtactgtctgccgttagctctaaacttctacctggaaatccacaactctgcttcttttggaagattcacacgtcctgtttcattacagaaagagttctgccgttagcattagccatgtcactcccctccccggtctatctagcactggatcccagacactgatgtggagaaccatttctgtatggaggcacagaagccttctcttcctcatttgatgtctaggtcccatgttctgaaacagtagagtgcttttcagatcctgagcctaaggccctccttaaaacacatagagtcctatttacaggttcgtttctttcttgcttgctttctgtatttatttactagagacaaggtctcccctctgtcacccagtctggagtgtagtggcaggatctcagttcactgcaacctctgcctcccaggctcaagtgatcctcctgcctcagcctcccaagtagctgggactacaagcgtgaaccaccacacctgacaaatttttgtattttttgtaaagatggggttttgccatattgccaaggctggtctcaaacttgtgagctcaaatgatccacccacatcagcctcccaaagtgctgggattacaggcctgagccactatgcctggctcccatttgcagattcttttgacttacacctcccttgttcttcaagaaaatggggccaggcacaatggctcatgcctgtgatcccagcactttgggaggccgaggggggtggatcacttgaggccaggagatcgagatcagcctgggcaacatggcaaaaccatctctactaaacataaaaataaaaaaattaaaaaattagccaggcatggtagcacatgcctgtaatcctagctactcaagaggctgaggcaggagaattgctcgaacttgggaggcagaggttacagtgagctgagatcacgccactgcactgcagcctgggtgacagagtgcgactctgtctcaaaaaaaaaaaaaagtaagaaaaatgggactctctatttcattcagtctctctctgtcatcactaccatattagccagctttgctttagtaacaatccaaaaactcagactctcaacaaacatttatttttcactcatattacttgtccgtggtgctggaataccttctacgtctctcctctgtgtatcttctccatctgcaactgaggctgaaggagcatcccctacttaagacatgatagtctcatggcagaaggaaaagagtatgagagtttctgtttgaacaatatgaacatcacatttgctcataagccattggccaaagcaagtcacatgggccagtcaactttttttagccattcatcccaggctgcagctgggtgacgtcagaggtgacttggaatggcaacagatggtgcctgagctgtaggaccgttggggagcaccgtgggaggctcagaatgctggggcagtccctaatagtgatgctgctgctcctgaccacgaaaggactctgcaggtcagccccacctttgacaagatgcttcccagggttccaccatgcagacactcatcctcctttccaatgtccgggtatccctgggacaagcagctcttatgtatgtaacatcattttgtcttctcaacaagcctgtggaagttattatcatttccactttttagataaggaagatgaagtaacttgttaataagtggaacatctgaacttgaactgtttctttgactccgaatcatatgtgtttttggggttttgttgttgtcgtcgtcgttatttttatttttattttttttctgagacagagtcttactctgtcacccaggctggagtgcagtggcgcgatctcagctcactgcaacctccgcctcccgggttcaagcgattctcctgcctcagcctcctgagtagctaggattacaggcatgcaccaccatgcccagctaatttttctatttttagtagagatggggtttcaccgtgttgaccaggctggtcttgaactcctgacctcatgatccacctgcgtaggcctcccaaagtgctgggattacaggcgtgagccatggcgcccagcctgttgttatttttaagagacagggtcttgttctgtcacccaggctggagtacagtggctcaatcatagttcactgtagcctgacattcctggggtcaagggatcctgagcctcaacctcggcctcctgagtagctagcactacaggtgcacatcaccacaccagctaatttaacaaaaatttttgtagagacagggtctcacactgtgttgtccaggctggactcaaactcctggcctcaagtgaccctcccctttggcctcccgcaatgctaggattataggcgtgagccactacaaccagcccaaatgatatattctttgaatggcaacgtgcaatgtttaaaatactggccgggtgcagttgctcacccctgtaatcctagtactttgggaggccgaggcatgtggatcacttgaggtcaggagttcaagaccagtgtggccaacatggtgaaacccagtctctactaaaaatacaaaaattggccgggtgtcgtggcttgtgcctgtaatcccagctactcaggaaactaaggcaggagaatcgcttgaacccaggaggcagaggttgcagtgagccaagattgcaccacactccatcctgggcaacagagagagactccatctcaaaaaataaaaaaattaagtaaataggctgggtgcagtggctcatgcctgtaatcccagtactttgggaggctgaggcgggcggattgcctgaggtcaggagttcgagaccagtctggccaacatggtgaatccccatctctactaaaaatacaaaaaaattagccgggagtggtggcatgttcctgtaatcccagctactggggaggctgaggcaggggaattgcttgaaccaaggaagtggaggctgcagtgagccaagatcataccacttcactccagcctgggtgacacagcaaaactccgtctcaaaaaaataataataaaataaataaaagaaaatactgtatgtactctgcagatataaccatgtaagaacttacatggataaaacttgaaaaggagtagaaaaagtgaagtgcttggccttttgagtggcacgtagtatttctttgtcacccaggctggagtgcagtggcatgatcttggctcactgcaacctctgccacctgagttcaagtgattctagtgccaccatgcctaatttttgtatttttagtagaggcagggttttgccatgttgcccaggcagatctcaaattcttgacctcagacgatccacctgcctcggcctcccaaagtgctgggattacaggtctgagccactgcacccggcccagacttagctccttcagtttctggcttccctaactgaacagccactctaattcatttgatgaggaagatctttgagaagtaattgagaaggttaagccaaatatagtttggagtaagatcagatactgcaggggcagagagttgagattaggccacagtgaagaagagaagaaaatatcaaatgtaagcagagattaacaccccacaactgaataccagcagtaatacaggatttgggccagcagcagggttaatgcaaaagaggcagctgttaaatcgaaaataagagcttttgttttgttttttgttttagagacaaggtcttgctctgttgctcaggctggagtgcggtggtgtgatcatagttcactgcagcctcgaacacctgggttcaagtgatcctcctgcctcagcctccccagtagctaggactacaggtgggcaccaccacgccccactatttttttttttttaatttttttttgtagaagtgagggcttgcagtgttacccaggctggtcttgaactcctggcctcaagtggtcctcccacctcatgctcccaaagtgctgggactgcaggcatgtaccaccatgcctagctaatttgtttgtttgtagagctaatttttctttcttttgtagagacagggtctcactatgtttcccaggctggtctcaaactcctggcctcaagcaattctcccacctccgcctcccaaagtgctgggactctagacaggagccactgcacccagctagaaaatttaataggaagtctaaaagacatttcaggaactctctgcttttgggaacgccttctaaagacccttctccccaccttgtggactggccttcaggagcccagtttggcagtaattgtgcagtggctcaggcatgtaatcccaacactttgggaggccaaggtgggtagataacttgaggtcaggagttcaagaccagtctggccaaaatggcgagaccttgtctctacaaaaaaataaaaatgtagccagcatgttggcatgcactgtagtcccagctactcaggaggctgagcctgggaagtggaggttgcattgagccaagattgtgccactgcactccagcctgggcaacagagtgagaccctgtctcaaaaaaaagagatcctgtgtcctcattgcatcttgccaagaagcacctgatgtcagtttgtcccattatttttcaggtatttcaatatattattctctagaatagagtattccattgtctgagataaatctagcttccctatatcatagtggctatttttcttccagcccagaagtttttccttggtaagataactttattttgtgagtttatagatttggattataaaaatagatcggaactgttagactaatttggcccagagattttatgagtccacttgggagaaataggagtaattctcaaaaccaaaatgagaaaatccatgtttaacaaagaaaaattagtttttagctgaaggaagtcccctataaaaacattgcgtcacaggattcctttcacagtaagctaccaattttatatgtgactcaattgacgtaaaactctgttttaaatgaatagtatgtgaggtgatggatatgttaataacttgatttcatcattttgctatgtatacatatatcaaaacatcatgttgtacagtgtaaatatatacaatttttctttgtcagtaacaccttaatgctggaggggatgggagaagaaaatctgttttctatatttcacaagcacatctattgcacaatgtatacacattgcctcattatgtgagatttattggcccagcctaggatttggcttttgacaaccaaaaaggttgccctttgtgataccagtctcaaaaatgttaagaacgtaccccaagcatctctttaaaaaggattttggatttattgaccatgaatttatctacaatctgtttctgctttcatttgtatcatttagggactgatgatttgtatgttttccacttgtatttacatagcattccttttttcctctttaactcaggggttacacactctgaatgtctaaaatgatgagtcagtgaaatggtttgtgtgtaaggattcatagtaagagagtgggtgtcccatctacagggagcagccatgctcaacttgagcctgagatgagtgcggctcattgtggccaagatattttgatttatgggtgggtgcggtggctcacatgcctgtaatcccagcactttgggaggctgaggtgggctgatcacctgaggtcaggagtttgagaccagcctggccaacatggtgcaaccccgtctctactaaaaatacaaaaattagctgggcgtggtggcgcacatctgtaatcccagctacttgggaggctgaggcaggagaatcacttgaacctgggaggcggaggttgcagtgagctgagatcacgccattgcactccagcctgggcaacagagcaagactccatctcaaaaaacaaacaaacaaaaaaaattctgacttttccctagaatcctcaagtctgaattttcaaacattatgaattcaatcaaaaattttaaaagacactgtgcagaacaaataggtgcctcgtggcttgccagtttctttctttaatatacctcttttacatttcaaagtgtcctttctagttttctgggatttagtatatgagttcaccgtcttctgattctcctcccccaattgcatgacaacttttattattctttcagctttcctcttaacacactacagattatttgtcattattttatggttattataaagaaatagttccatatactactttatttaccttgacccaaggcccactaatgtataataagtaaaactgtaaaatcggtcctttcatctcctgttgttatcagttgttcttgagggtgagtgtcaatttcatggttggaggccaactcttcttcccttctctctgcagccgtcatttcaccaagctgataatgttcggggaacccgccatcacgggctggtggagaggccatccaggaaccgcttccaccccctccaccgaaggtctggggacaagccagggcgacaaatatccttttttactcttcaaagggagtgtgcattctgaaatgtttgaaaagttttcaggatttatcttccctgcaattctcctttggcctcagaatcttcatttatctgatgaaaggaggcaatacaaataaatgagttggaaactagaaacatctctgcagtcaacatttggaaacatcattgtaggtgtttatgaaagcatcaataaagttcagtttaatgaaataacaacaaaaacaacctgtaattcggtcccattgcagggtgttctgagcattttctccagaaattggccacgttagagttaaacctgactttgaatcaggttagagagccttagtctctttagcaaaaatggacatagagatatgtgatttatttgtacttcttttgatctgctgacctgcttttggaacttacagacaaaatttcatattattttctatttgtgatgtttcaaactcagtaagtgataactaaaataaacctagaatataggaaaatctcatgcagtgatgtacagtcacaccaaactctgctgttaagtagaaataaaggaaaggaaatggtgaattcacctgacagtttcatttaatcagtcctgtttacagggcggcagtggtgggtgcagctgtgtgaccagcattgtgccgaaggctttggggaacagaactgagctggattttttgggagaggacacagaagtgtgccaggagggcccgtgctctcacttcattcttctcagtactcgggcgcaggggtggaggaaggagaagaaaggcggggtgggtctcgctgcggagagctgaattcctggcagtgatggtagagttggcttcacaagcctagaaaccaggaagtgggggcagggcactcatgtttactgagcacctacccatgccaggcgctgtgctgggtaatttatgtgtcacttagtcctcaaaaactcactgagtcgttaatttttttaaccctcattttctgatgaggaaactgagtgtgtggtgaagtaacccaggattcagaccaggccccgctgatggcccagcctgtgctctcccctccctatgccacctgcgaccattcgcagtgatgaggaccttgtacaagggagccaggagttgtgggggcactctagggaaaccccaacttttcttgccttcaagcttcttgcagtttttagtctatttggaggcaaggataatgaccccagggaatgtttttctctcccctttctcccgcccccaggaacacaccacatttggtccacagaaggactgacttctgattttgtatattatgtggctgttatcaaggaaagtaaagatgataaatgatcttgagaatctattctggaatgtgtgataactttgacattgaatgaaaaaggcaaaaggaaatggaggcaattcatcagcaaatttgtacatgtcaggatggagtggtacatcaaaccgttgtccaaattgccaagaatattcaggcaaaagacttggagtgtttctttgattgatttaacaatgtattttttttggctgggcatggtggctcacgcctgtaatcccagcactttgggaggccgaggtgggcagatcacgaggtcaggagattgagaccatcctggctaacgtggtgaaaccccgtctctactaaaattacaaaaaattagccaggctcggtggtgggcacctatagtcccaggctgaggcaggagaatggtgtgaacccgggaggtggagcttgcggtgaaccgagatcgcgccactgcactccagcctgggcaacagagcgagactccgtctcaaaaaaaaaaaaaaaaaaccaatgtatattttttcagttctcagttccctctttttcctgtcagtgctctcatttctatatattagattaaacattatgctatatatacgtgtgtgtatgtatatgtggctatctcagatacttttgaagtacggtctaaatgtataagcatgcatatagttttactaaccaaaatagagaagggaattgaagaaaaaagaggagaatgtttattcacttataaaaattatttgttaagtatgtgctagtggtcagacaccgttttagacattttaattcactgtaacagtaaacagcatggtccctgacctcaagttgcccagggttcagtgggagaggctactcagcaaacaagcagccacggcaggtatggcgtctgcagggaggcagctcaggggctgtgggagcacgtcggaggtgcagcttgaactagtctggggaaacgaagaaggcatcctgggggaacatctgaggcttgaaggataagaagtaagaggataaagtgttcattcagcagatctttacagagccccgtctctgtgccaggcactgttctaagcactggggacccagtgatgaataagggaggcatacttcctgctttcttgagttcacagtcctgtgggagatgacagcaaacaggcaataagaaaggaaaatggttttagatggtaatgagtgagatttaagagagtaaagcagttgggaggtatgttccaggcagagggaagagaatgtggtgcaaagtcctacccagaaggggagatgacttcttgtgttcaggggaccctatctcttatgatagggtataatctggcactgtatggatcaacttgagagcataagcaaagctagtcaactcctaaaggaaggagaaacaaaaaccaagttaatatgcagagaaattaaagttattagacagtatgagtcagattcactgatcatgagccatgtctctgtggtctcctaagctcctaaattgggttcctgggactggacatcggttgatgcaaagaaagttctttagcccagtctcttttgaggaatcaagggtccgtgaaatgggatgattttattttggtgttaatctattccacttggaggaggagggctgtgattccgtctttgctttcacgacctgcattctgttggttgtgaaataatctgcttaaaattgtggccttgaacatttgtctatgactttttaaatgaagtttcttcatttgaaagtataaaacactagtttgaatctttgttagaacaaaaggaaaaaatcagaattattatagctgtttcttggcttgggtgttatttaagacacactggcttagacaagggttttaagggttcactcctatgatagggtgatctcaaataaaacgaacattgtttaacaaatactctggcctcctctcagagtgggcagccacagcacgcagagctctgccacaggagattccttctggagtgggctttgcccttggcatgggtggccacacaagaccaaggcacagctgcagctgggccctggcctagccccacacaggcggaggagaggcactgccagggcttgctcctggctgggggcctgggctcgggcacttggaagagaagctcttctgcccttctgcagatgtgcagtctgtagcagcccttcttactctcactcatcaaggttggcagacgtgccgtgtcccaaacaccattgctaaacttctgaactattaacataaatttatagcaaataaaatattttctcagccttgtggatgacacgctcagaaggaaacacgaaatgccttccttgaaaggaagtcaagagttcaccagcgtgaagggtcgtgaagagatgcctaagacctactagagttaggaatgattctcctctctgggctgggccttgctttgattcttttcatcataatgagatgaaaatgttaggacattggtttataggacactgtttctttgagatgcatggcctattacatttgagaaacaccatactctgtatcacctcttggagcctgaccgtatatatcagggctctgaaaagtcctgcagttaataaacttcttatctttaacccagaatttcaaaacttaagtgatcacaaaatccaactgttacctaacacccgtcttatcttgaaggacaaggaaacattggtctttagaattttaagggggaaatattctgacttcacaataccacatgcaacctgtttgcctctcatttgctgagggaaacaggatgttcttataaatgcaaggactcaaaaagatgccactcatatcctcccttacagtttcactttaagatgtcttctagtgggacatagttagaggtaaagggacaaaaagaagtagaatgacaataaacacatggctgagcaatcaggaaggagccaaattgtggccagttttatatattaaatctgaccctgaaacttgtcttggtaggtgggttctgttaaccagactccgagcccacttaccccaccagctacatggaaggtctcaggcctgccccacaaactgtgtccctggcagaacacagagttccagagcaggagagaaatgactggcttccaggctgccccgacaaggcagttcctgagccctgcccaggtacactgaccgcacagggacgggaagccaagagaagggaaccctgggcctgctcacccagccgcaggtcaagcagcacaaagaaagggccagggcgggtcttgttttcagcttctgtggctcagtaaccccacccactggtaaactggccaactgatgtcctctcttatcagaagaagaagagctgctccccttcctttggtgaagagtaagaactgttccctctaacactccacaggttgagaggaacagcagtccctgtgttgatggattgaggcagtaactcgaggaggaagattttcctgcacagaactgcagaggcttggggagagagagaacacactgggatgactctgagatcctaacatgagtgtcttggtggacggtggcctcactaaatgagatggactataagaagaggaacagattaaggggacagtgattggttggatttttggtagaatttgagctgtcttgggtacttttggcagagaacttgagtaggcagttggaagtatgcacttggagttcacaaaagaactgttgggagctggaggtgtcgatttatgagttactggactgtgggtgacagtggggccgagggaaggatgcgattggccaaggcgagcatggaggacaggggctctctaccaggaagacgggcactggccctgaggctcttaggaagcgcctcctaaagctcctgtgcccggaggctcccgccaccccctccacctgctcacactctgcctggtgcccagggatcctgagagcatcctttgcctctcagagcaatgcaggcaggtgtggcctgaggctgcgaggccacaggaccccagggaacatcaggacggaaggcaaaggggcggaaaggagtgcacagagggataagaaaagatccatgtgagtgtggggatttttttttttaactttaatttttgtttccatccattgcagccacctcttctttgtttatctttttcatcatccctcctccctgccttccttttttaatgtggaaatcttccttgagccaaaggcttcactaagcttaactaaggaagcaatggaggaggcgctgatgtggttgttaaaagccctgtgacctgtgctgcccttccgctggcacgctggcacctggcagggatgccagaaatgtttcttgagtaaatggtaaattcaagtttataaataagagtgtttcctttgtctcgaggttgttacttagggcatgtcagtgttgtggagtagtttaaagccacctgaatgaagttttctgaagttttccaaagaacaaataaacttcttctagattttccttgcattaagtataagtgtataacatgagtggttctcttgggttttcaaatatccactaaattagatgagagtgaaaattaagagagctcagaggtcacatctttcaacttttgatgcctcaacctaattatattaaaaatttccaggaatttactatattttcatgttgttaatatcaggaaggttaaaatgctaacttacacctcaacattgaaatcaccagcgtttgatgattacgtgactattacaccactgcattctaatttgtattatcagtactatgagatcagagatactgagtttaaagatggcagtgtactgagaaaaatggtaaacttctacttcctgaaattaagcgtttctgaacagagattcatcaaatctgcagaaaagagaaaggcagataaccgtaggttctgaggctcggtgtttcctccctaatggctttgccaacagaaatactgacaggttttgtctgtcacgggccttactatttatcaccttttcctctcctacctcctactgtggtcttgcctcatctgtacttcatgtaccttaagcctaatagtgaatgttgaagaaatgtctctctttggaaattatctgttttattttattgatttaaggtcaaattaagaaataagataatgagacttgtcaaagaaaacgaatacatagaagatgaaacttgcaatcctaatgcctctcctggcaaagaagacatttcccaccaaatcactaagaactcatgagagcctccgttttcctaattccagattctgtatttatttgagctgcccagcccaggcctgcaggatagggccccactccatcaaggctcctgtttcctcctgagcccgagcagatggtaccttctcttatagcctccatccttcccagaacactccaggtactattttctattttctgggggcatttggcatagttcactgtttcctgagaggcagcatagcttagcggagagctctcaggctttggtgtcagtgatttgtgggtctgacccctgatccaccaggcgtgctatctgatcttggatttctcagctcttctagaactgagcctcagtttcttcagctataaaatggggaaaatatctgcctctcaggattgaggttaaataaagtgtgaactcagcacaggcctggcacacagtaggtgcttagatatctgttttcaaatttctgtcttaatgtgtagtttgtatcttctttattatttccaccttaagaaataaaagtttgggatgaaaagtattattggtaactgccgaatgtatatttaatccaatcagtgatccaggagacaaaaggaatgggcttggtttgggtgagtgataaggaggcaaccttccacataggaggtgagaaaggggaaatggccttagcaaaggcagaggggcaggaaaatacaggctgtgtttgtggaactcagaaagctggagggaagacaagagcagaagagaccattgtccccaaattgtggatcaccgcaattactaagccagtaagttttgattttgccttttaggctgaacaaaatcattgaagatttcttagcagaataatatgattaacagtgtcttcagaaggctattgtgtgggaacaattaactaaacgaatgaaaacagcgcccctctgctcggtgtgtagtgcagcatcccatttgtgtctccgtgcgtccagaatatgctccaaggcatggtagacccagtgaacaacacaagactgataagacagtgcccccaacaacactggaaagtttacctttcttcacacatctaatgcgcctcttttttggttataaataccaggaaccgccgggcgcagtggctcacacctctaatcccagcaatttgggaggccgaggtgggtggatcacctgaggtcaggagttcaagaccagcctggccaacgtggagaaaccctgtctctaattaaaaaaaatacaaaattagccgggtgtggtggcgcatgcctgtaatcccagctactcgggaggctgaggcaggagaattgcttgaacctgggaggtggaggttgcagtgagccgagattgcgccattgcactccagcctgggccaaaaaaaagagtgaaactccgtctcaaaaaataaataagtaccaggaacccaccttaacttaaaaaaagaaaatgtattggcatatgtcactggaagcccaagggctagatccaaggggtcatacaatgtcattgagacctacctctgtggtaccacttctgagatgacttcaggcataacagacaggctttctccaaggtgaagacccccaggttcagacagcccttgggcttaccagccctattggggcactccttttttttccactcaaaagcactctccttggttctgtttgcgtcgtgagccgatccctgagccaaacactgtttccagggggtgaggtacctagactagaatcctgggcctgggtccctcacatgtggcacagagggaatggcagtgttaccaggtttggagcaagagtggagacagttcctgaaaacaaaagttgccggacaggcaaaaaataataaacaccccacaaaaaatcatgcaaagaaaacaccggttagaagacagcagaatagacttgtcctcaaggagggagataagagaaagcatgaaggaagagctgtcaggtacagggataaggaaccaaaaactcagttgtttaactctctgtgagtccaccttgttaattctgcttcatctttccattaatttttatttttcctttattaaaaattctactttgatggtagtgcttttggagccaattattcctcacagcctctggatgagagttggccaaggtaagcaagacatactttaaaagatatgatgggcatgtgttatttttagataatttcactttatccactttgaatgttgtttagaaatttctaatataaagcatagaatcctgttttctcttataacatttaatttcagtgggaggatcacttgagaccaggagttttgaggctgttgtgtgcgatgatggggcctgtgaatagctactgcactccagcctgggcagcatagcaagacgccatctcttaaaaacaaacaaacaaacaaaacaacaacaacaacaacaacaacaacaaaacaccttattggccgggcatggtggctcatgcctgtaatcccagcactttgggaggctgaggcgggcagatcacaaggtcaggagattgagaccatcctggccaacatcatgaaaccccgtctctactaaaaatacaaaaattagctgggcatgacagcacatgcctgtaatcccagctacttgggaggctgaagcaggagagttgcttgaaccagagagtcggaggttgcagtgagctgagatcacgccacagcactccagcctggtaacagagtgagactccatctcaaaaaacaaaaacaaacacctaagcatttccaatgataggctaatatgaaagtctaaaatgaaaagttatttaaagaaatctagatcttcatatttaaaaccaaatagaaacacttttggaatatatttaccagcagaatactcagatatggcattcttatgtttgagacttagaaaaataagcatcttggccaggcacggtggctcatgcctgtaatcccagcactttgggaggccaaggcgggcagatcacaagctcaggagatcgagaccatcctcgctaacacggtgaaaccccgtctccactaaaaatacaaaaaagtagccgggcgtggtggcaggcgcctgtagtcccagctactcgggaggctgaggcaggagaatggcgtgaacccaggaggcggagcttgcagtgagccgagatcacgccactgcactccagcctgggtgacagagcgagactccatctcaaaaaaaaaagaaagaaaaataagcatcttttctcagagtgtcttagtaagctgctgaaaaggacaaaagactcttaaaatggtaatttgcacagtgtatttgatttaaggtctctttgagtatttttgtacccaatacagagggtaacaggaaatagaattaactgagaaaaagcccctgctgcatctgttgtgtgcctagtatcattttcagatcaccaagtcagatttaggacacatttaaaatgtgtgtatcaaaaatatttagctctccggattgaagtctactctccatccattctctgggcaaatactgactgagaacttactgtgtataatgtagtctggatctgggaaaggaaataaagatgggtaacagtgggtccccacctcaggtaggttttcagctgccctcaagaatcttgggatccagggttgtagaataaatacaatattttattacatcagtaaaagtcatctccaaactgttatttttcttttatgtatccaagaaatgtcttctgcttttcagagcaccaggactggttagacttaatattttcataccctgggcaactgtaacaattctattcctcttcatggccattggtaggggaatgcaaaatttttgcatccaagattgccacggcgccccctacatgcacactgaactcctcatctgcccagctagctaatcctgtgccttatgggtttgtagtagtttttatactggaaatcagagatcacaggactggaaggatcatggagtcttacctcattttaacaatgatgagcaaaatgagcgaggtgtggggtatttttaagtaactcttgcagagcgaggtgagtagaagagccagttctcaaatgcaagtgctgaggccctcctttgctgtctgtggattgacttcttttccttttatgttgttctggtttttaaaggcagcagcctccttggaaagacgaaaagcatcctgggttcaggctgacatctgcacttaacaggtacatgggttgtttcctggtaggagtagattttaaagcaatttaactgtcctgatattttttacatagcatccagttgccagagtgtgtttatgtaagctgtgttgatatgacatgttcaaaacaaaacccaccattttttgagtgtctacaggggaaagtatagagcacacgaggtctgggatgagactcccagggtttgcatcttgctgtatgaccttgagtagatttttaaacttctgattgcctcagtttactcatttgaaaaatggagataatgctacctagatcatgggttggttgtgagggttgaataagataatacctgggaagcatatgtgctgaataaacatcagctattatcatgatcactttgggccagactccaggagtaagagttctacctcagccattttttttcaatcctgacaacaccctacaagaatgagtattattttccattctaaaaggttaagtgacttgtttaagggccttagctaataggtgaaggactaggatttgaaaaaatgcagctgagcatggtggctcacgcctatagtcccaacactttgggaggctgaggccagaggatcgtgtgagtccagcagtttgaggccagcctgggcaagatggtgagaccctgtctctatgaaaaaaaaaaaggcgtggtggcacgtgcctgtggttcgagctactcaggaggctgaggtggggaggatcacctaagcccaaggaggttgaggctgcagtgagccatgtttgcgccattgcattccagcctgggcaagagagagacgctgtctcaaaataaaaaagaaacccgatgaatggtgcaaaattttaaatatactcaaacagaagagttataaaaggcctgtggtgcccatcctcagcttcactcattatcagcattctgccagtctctccaaacctacctcccacctcagtcccgtgactggctagtatagtattgtaccttgaaatgtctccagcagtttaaggccgacgagaaccttttttaaaaaacataaccacaatgccgctattacacttaacaaaattaaaaataactccttaatataattcaatgcctggtcggtatttagattttcccagttggctctgcattcgtttgatattctcttgagtctctttgaatctgtaaaaagaggctggaatctgaacccaggtctctctgatctcagcggccacgctctttctgttgcactgtgggttctgcccttgtctgcctcttccctcctctgaagccacgtggcttcatagccacctgaggctgtcactggaatgaaccacaaagaagcactgtaggctaatgaagttgcttaccgtaaagtcctttctatggccgacagtttgaccttatgatgagataaatagataatcatctcttgcaaccaaagctgtgtagacattgaagctatctgggagaatttcagaaatttgctatacattagtggctcccacattttcttttaggactactttacagccttaaaaaacatggaggcctggcgcagtggctcatgcctgtcatcccagcattttgggaggccaaggcgggcgaatcacctgaggtcaggagttcaagaccagcctggccaacatggtgaaacaccgtctctactaaaaatacagaaattagccaggcatggtagcgggttcctgtaatcccagctacttgagaggctgaggcgagagagtcgcttgaacccgggaggcagaggttgcagtgaacaccactgtactgcagcctgggcgacaagagtgaaattccatctcaaaaagtaacactagtaaaataaaataaaataggccaggcacagtggctcatgcctgtaatcccagcactttgggaggctgaggcaggtggatcacccgaggtcgggagttcgagaccagcctggccaacatggtgaaaccccgtctctactaaaaatacaaaagttagctgggcatggtgacgcacgtctataatcccagctacacgggaggctgagggagaagaatttcttgaacacgggaggcagatgttgcagtgagccgagatcacaccactgcactccagcctgggcaacagagcgagactctgtctcagaaaaaaataataaaataaaataaaaaaaatattgaggccctcaaagagtatttgtttatgtgagaatatctattgatattagaaattaaactgagagattttttaaagatactagtgaattaaaaaaataataagcccattacatgttaacataaattatatctttttgaaaagaaacacaaaaaaagtattgaaaatagtgacaatgttcaccttttacaaatccctccaaggcagctgggtggtctgtgcctgcgctcagcggtgggggcatcacacctcacgtggccgctggggaagcccgccgtgcttgggagagagcgagagtgaaaaaacagaggacactttactatcattttgagaatagtcttgatcttaccttctccctggaagggttttgcaaaccactgctctaagtgatcctttacttagaaacagctactctcaggtggagaaaacctagtgcagccacaggctaaactggccacagccagcttccgagctgggaagaataggaagctcttagacggaagccatgaatccgaggcccaccttgttgaacttgatcgccatgccatcagcttcagcatataaggctatatgagtctaagttaaaatattctggagtgtgggcgatcctcagaggctgttaattgatataaagaacttcaggtaggtcctaaccccttatttgatggttgattataaatcagttattcttgccttctttcctgttggtaatattcaacaaagactattgcattttcactaaggaaaacggattttcagccagcctctctcctcccctccttaggaccaattctgattctgctcttcacacgagtgctctgagtaccaagccccaggacccctatggaggagggggccagtcggcctggcctgccccatacatgggtaagacacacaggccactgctgacagcagctgtgcttgctcattctgtcctaggaaccaagggagagagaagctgaagtggtgtttgcgcttcccggttcagtgatcttagagaggcagctcgtggcagggaagcgtgtgtgtccatgatgcagtcaggatggatggagctcccagcgtcccctgcctctgccctgcttcctccacagcacgctctccctcttggtgtctcttggccctcttctgggcacccgtcatcttctaataacttcctgactggtctcctgatttccagtctcacatcccttcaatccagttttatgttaagttccccaagagtcctctttccccacccaggatctgaacaaactgagaaatacaactagaagtgacagtcagagctagatatcacctttattactactaagaccaggttggaggaagtgactgtctctgtaggttggtgggcctgctgagactgaaccccagcatgaggctgactccccctgagtggctggcagcactggccagtgtggtcccctgggaggaggggtcaggcaagcctcggggagggagggtggagcagaggcctgctgccttgagatgggggaagaggaggtcgggctggaactgtgcatcacctgctcagttgccccctggccactgtgagtaaggggatggagagaggccaggagtaacccggagtggggaagaggcccactcatgccatctcacagctctgcttccagagcgaacccaaacctgatcatcttgctctcccacttaaaatcctcagtgccacccctcaccttcaggagaaagagcccagatcttctttggaatgacatgagccccaaggcctggctcctgtctgcctctctcccttttctctctgctcccccgcctcacacccaaggtagccatgcgaaccactttgggttctactggtgtttcttcctgttcctgtctcttcctctctctctcactcctggccagcaccctctccatccgtaagcctcagcttgtgtgtgtcctcatgtctgtggagccatccttgaccttccttcctctcagctcagagttatcgtgtccttctaacatcccagactgctctcttagcacctgcaatgcttggctgcttttttatgtgaacatgcatctctttctctgctcagtgtagatttcttgaaggcagcatcttaatggtcttgttctctccagcccctagcacagtgcccggcacagaggagcccgtactgatggagaagtgtgaagaatcacacactggctcacatgtgcacggcatttgccaaaacaccctctcggtgctggcacctgacctgtacatgaagtgaggctggtcattcagacacatttcaagcctacctttctggggtttataatctagaaagaacaatggtcttgaattatccattccatatgcagattgactcttgcccagaaactttcagggctgtgtatttgttcttgaaacaggaataaataaatctttagccaagaaaccagcttttctggttttctttgctttttggacaatttaaagcctaaatggcctctgttccttccaggagaacacttatgatcgtatttctttgtatatagcagggatagtactgaataataattgttgctatatttgttctattggtgcaattcagagaagactacatttgcttaaatgattgtttgcttgtaaactatgggagctttcagaattggttagggacatctacccatgcttccatacatgggaatatgaaagttggcagtgatgttgaaattgatgttggaattggatatgggtgcactgctcactgcttagaggagtggggtgtgtgggaagagggatgagtttagtttcaggataggtagagatgggaatatgtaaacaaagcctaaaaaaagcagaggctgtaatcagtgggggtgcctgtgagcacagcaggatcctaatctccatggaccgggagccagctagacagacagatttttaccctggagctcctgcatttctgcctctgccgatccttcatttacattaccctctgcaaagtttacacttctctagaaagggccaaaggcctagagaaacaaggcaatcacaggtaattcaagtgaggattttttgaggcttgcatgctaagaaaaagaaagtaactgaagaaagaaattacctgagctgaagtattcattcttagcgatgtagcctctgagagaagaggtgagaaatgtcagaaggggtaagtgaggatggaataagaaaagcaaaggaatgtaaacattggtccaggtagacagagcaatgagaaaaacaggaagaaagaaagaaatcctggatcagggttcctgcgttgacttgagaatcgtggtggtctctccttttcaaatcagcagttagaaattgttgggctacaatatctgacaaccatggagggtgggctggcctccaactcagatgtctgaactgtgtgcctgctcctgcagttgccttgcaagtatagcagaactcagaaacacatcctaatatggatgtgtttacatgggaaagccagtgtttaaaatattattcaagtctccaaggatggaaattatttctggagaattatatttgttggtgggagctattttaaatagtttcatgtattttcctcctgtgtttcattaaagtttttcattttctttccttttggattttaaaactatcaactggctttgcaaaaaggtatttcttataggaccaaccaaagaaagatttaaacagtgatgggaaaatataattgaagcccagaactgggttctatgttcgaagcaataataactcttctttccctgggaatctctcctaggcagaatgatgcagccacacttttttgttattgttgttgctgttgctgtgagcccatgaggagagcatctgctcacggcttaactacatgagcaataaactatgatacattcatgagtggagatttgtgtcacaagaagacaaagcctgatacatgttgagtaattttcataatagctattgagttccatgacaattaggcataaatgataagcagttggtataaatgacagaaataaatttttatggaaccaaacaggatttttataatttctctctttttgtttaattattcagaatctataaagagggaatgttggccatttccctggcagcatgtgcaccttaatgaccatttcacacttacatgcagatagggaagcacaggactctgtgggacacgtgccctgtcccatagcctaggactgtctcctaacacccctcctgacatcgggcatgtggaggagggactggggtggtctcttcctttcagggaacagtctagagctaaggggagcagagtgcgtaataggtgtcttctctgcatccagggctgtagatgctgaatattgccatctttggggaccacagtactcagctccttagcgtggagggggcttggcatgccttggacctggtgacctttcacctgccaataagctttgacctgcagagttaaggagaaggtttacaatgcaaagaaccttgaaagatgtaagcctgttaattgcatggattgggcgggggtacagtggcaggtacaagcatcccagatctgaagaggggcaaaaagagtgtcacccagggacaggagggcccagagtggggaggctgaaacaccagaggcctcctttaggacaatggttaaggggtcttccccttgccttcccttctacttagcaaatcaaggctgtgtagggagttattttagatttgccaggcatgggagcacacagaaggaacatggtctcggttcccttagttagaagagaccggccctcggtggctctgaggtttcctggaacacagttgcagccttggtcatcgctgtcccatccctgtgggactgataaaattagtgtcctgtttccagagagccagtcacaactcattcctttttctttttaaccctttatttgtagtgctatcttgtgggtttttaatttagcagtaaaaatccaggcttggatattttgatgatatgttagcttggtgccagtatatcagtcattgccaccaccatccttctggtcaccgcagcccagaccctgagagttgcatctgattactcccattcccatgcccctacgcccattcagtagccgagtcctgttcattttatcccagcagtatgtctcaaatctgcctctggttttctgtcctcactgccagtatcctacttggttcctgtttgccttggactattgcattggttttctagtcggcctccctgccttaaggctttctcctttcaatccacctcctactctgctgcaagagcagtctctgaagcttaactctgatcatgtcacttctccaactgaaaccttccatcccctacatcctgccaaatgaccagcagcctgcttcggtccagcccatctcccagtcctcccaccatgtgctgcagccacactcttccatcttccttctccttcttatccttccccaaccaccccccactcctcctcctcctcctcctcctcctcctccgcctccacctcctcctcctcctccgcctcctcctccgcctctgcctcctcctcacactgggcatccccttcagcttcgcttccggttgtctaaatcttccaggtactacagcaaattggttagggacatgaacattctgaagacacacgggccagagttctagtcccagaacttactagcagtgtgatcttggggatgataatagcatctacgtcgcagagttgctgtggggatcccatgagatcacctgtgtaaagcgcctggcacatagtaagtgagcagtcaggttggctgttggttatcctcttcttcaccattatccttcaatgaatggcgcctcaggtgccacctactccatgaagccttccttctgttccagtctgaggagagcatgcactaatggggctgtcacatggggtatctgccagccactcaggcagtttcacatggtagccctcagttgagtcctcatgtttcagggacaggtcaggcttaataattaaacctcgagtgactggtgtcttgatgatgaagagatgcttcagcacgccataccagattgctatataaaacctagtttttagtttttaacaggatagtcactttttagtaatcagaatgaagttccctgccctttcttaatatgagggtctcaggaaagccaaaataggaatccgcaactcctgtccttttgacgttgctggttgtagagccacagcttccacagcttttctctctctgcacctcagtgttcacctgttcacactgcctgtcttttgatgggttaaatggctgataagtaagaatgggccaaggaccttctgcaatagagtctcctgagacgacaattaaaaatgtaggctgggcgtggtggctcacacctgtaatcccagcactttgggaggctgaggcagacagattacctgaggtcaggaggttaagaccagcctggccatcatggtgaaaccccgtctctaccaaaaaatagaaaaattagccgggcctggtggcacgcgcctgtaatcccaactactggggaggctgaggcccaggaggtggaggttgcagtgagccaaggtcacgccaccgcactccagcctgggcaacaaagtgagactctgtctcgggaaaaaaaaaaaaaaaaaaaaaaaatgtagattccttggccgactctcacaccttctgaatcaaaatctttgagggttgggcccaagaatctgcattttagcaggctcacccaagggctctttatgtgctgtaaaataaagctttcagtcacttacttagagtctggttctgtgggcctgaaagaaattctgtctttgtgtgtctgcttcatttatcgacctcttcgtattcctgggcactcttcctgttgcccctgggctctgttaaaatgttatatcttctacctgtgttatagaatgtgctaccgtgttaccctgatctgtcttctcacctacactgtatcacccggccccacctagcacttaatgcagaaacttattaaatatgggttgagtgaatggttattagacatttcattcaaattgtatagactaatcaggttaacctataggttaaccttagccaaaaactcatctaaaatgtaagtaagctatacttaaaggcttagaactttataataatgtatcctgattctgtactgaaaacttatttggtatatttgattgctcttaagggaatgctaagatattacattcttggcacggttctttagttttagcttagagcaataggaaatactatgctttgtcatctgcagtataatttatggattaaaaatacttcattcagccagaatttattccaagtcaaagttttaaaactttgtgaatagctatctcatgtaccctttaaattaacttagactccagataaatcttcttcttaaaataacttcactgcataagaaatatatataatatcctacagcatgaaacttcggatttgttcctgtagacacccatggtaagtatcaaacagtgatgtaggctttttgagttacctgctcttaaccccatgatgaagcatttggaagagaatttccatctatacttctttactttgtggtttgaatagagattctcaggctttgtaaaaattgttctcctctcaggacagtgacagtaagaaaatttcagacagacaattttaaaggaaaagaaaaaggaaccaaatttagtttcaaattagctatacctatttttagtataaatgataaagcaccttaaatgaaaatcagtgtatcaaaagtgccttagaattttcaaaattctatttcaaatcataaagagttactgattcataaattcatgaaaatgaaagtaccacataaaagtgttttctttttttctttttcctttcccgctaggtttctgtgatggtgagaataatggacatggggaaggtatgaactgattttacctacctatattggagtgggatgctgattagtggacataacctttcaatacctttactaataaatattcatgttttcaggactcccccaaatgctgacaactgctgattggcttacttttcagagagcctctagaaaattaaggctagccatgttcagggccaggagaaaggaaatatgtggttgcattacaaaggttcctttttatctaggtccccacagtcacaaggttgagcaaggaaccaaaaattgtaatcacatgaaaatatgaatgaattggcctggcacagtggctcatgcctgtaatcccagcactttgggaggctgaggtaggtggatcacttgaagtcaggagttcgagaccagcctgaccaacatggtgaaaccccgtctctactaaaaatacaaaaattagccgggcgtggtggcacgtgcctgtggtcccagatactcaggaggctgaggcaggagaatcgcttgaacacgggaggcggaggttacagtgagttgagattgtgccactgcactccagtctggcgaccgagcgagactccgtctaaaaataaataaataaataaataaataaattaattaattgatcacttaaacaattagttattccagtagtctacccatttagaacgtcttcgttgacagataacaatgccaggaaaatgcaaattggttatgaaatgaaaatgcaaaccttacataagatactgagtttcgtaaagccaattaaaacattgttggagatctatggaaatgacactcaaagccattgacaaatgagggtcagacacagttcatttatttactcagtaccagggactgttttcttttctctaaatctttataatctggaatttaatttttataatctaaaaataaacaactaaattaggtttatatgtcacagaggtgagaccctaggggggacatgatgaatgaggagcatcttgcaagacgcacagctctctgtcatcatcctgcagctccttttctgggcaagcccttttaggccatgaataaaatcacaaaaaggtaaaacatcaataaacatctaatccactagaacagaaattaataaatggcttcaaggttgactgcattccttcagtgcttcgaagaattcccaacaaatcttggatatgaaaagggactaaaaacaatgaactctaagaaaacagtccccattaaggcactggagtctgccccaaccatgttcttataaccaacctcttgtgagaagtagccttgagctgtgtgtgatgacaccttactcagtccttcaaacttttcccagcatttgacagtacctttcagggcaatttttatttatttttatttatttttatttttattttttttttggagacggagtctcgctctgtcgccaggctggagtgcagtggtgtgacctcggctcactgcaaacctccgcctcctgggttcaagcgattctcctgcctcagcctcccgagtagctgggactacaggcacccaccaccacacccagctaatttttttttttgtatttttagtagagatggaattttgccgcattgtccaggctggtctcaatgattatcattatattaatgattaagtcaggtaacatttgaagaaaagagaatcaacaaggatgttgacaaaatacgctcttcaaaagagagtgatgtaaatatcaggattaagagagacacctgggaacactgacaaagcatggcctggtttagcagaaatgactgctgccctggtggtactggacaggttgcctgaagagcattgtatcctccccttaccgtgctgtcaaataagttagaccgctacccatacttaattcattctagaagtccacaactgcatttatatcatcagttttattaaatacaagataaacttattttagagtttttgtttcaaagtcttttctcaaaatttactaggaaagtttgggccctgtgtcatgtgacttctttctggggtccattattcttgggtacccggccatcttgtgtggggctaagacaggatagtcatgacagtcacactggagcttctgtggccactggaactcaacagcattcctggttctgagtagtcactggtgtccctaacttggaatccccttcctgacatcagatcacttaactcctgagggctggcccttgttttctggtctctttctgagaataaaaagtatttacttgttctgtgacccagcattcttgttttacctggcacgactgagagagttaaagcagaaagccctggaatggtccctttatacaggttgtttcatagcattaaagagccaacagccgtcccggcagctgcccagcctcagatcctcttggttgttggttcctctttgtcccccatttccatcccacaaccaaggagcttcactgccaccatgtcttccagctaatactcctcttctcaatactttccccatttcatcgttgttgcaggttctctcctcatccctcttcttccattctctcctttgccaagcctgcagagcccccctgccctggcctcaattgtctacattttacttcctaccatccccttgactcagcctacactccagttgaaaagagttgctccactcttaccttcccctctcttggaattcccttctcctgtgtctctaaagggctccccccagtgcccagctccaaagccctcctggcctcttcctcttctgcacttcatctctcagcagcatcataccctcggctctctcgggcttccactcgttttttccttcagtgatcgttatttatgtgttgcccttatccactgactagattacacattcgtgaaaggttgaatccatgtcttactcatttctgcaactcccacagtagtgcccaaagtggcttccctagtagacagtccataaatgagtcatttttgtgtgttaaataagtcaaacattttatttgttaaatcagtttttacaaagataatttgttcagccaaaggtaggtaggatggatgctttctctttttgttgttgtctttgtttttttgggacagggtcttgttctgttgcccagcctggagtgcagtggcaccgtcatgactcagtgcagcctcagcctctcaggctcaaggagacctcccacctcagcctcccaagtagttgggactacaggtgtgagccgccacacccagctaatttttaaattttttgtagagacgggggtctcactatgttgcccaggcttgtctcaaactcctgggctcaagcgatcctcctgcctcagccccataaagtgctaggattataggcgtgagccaccgtgcccggcctggattcctgccttctcatgcaatgactgtgctgctttttttttccctttagtagcatctttccctggcccattgaaagaagagaatctgttaaatgttccgaagccactgccaaaacaactgtgggagaccaaggaggtgggtgaacagtactcagctatgtttgttgtcactgaatgtttgtacttagaggtcattgaaaaatcctgcagaggtgaaagcaagaggaactgggggaaaaggagaagatttgtctgagaacagagataagaatatacaagggaaggacgtttcaagtaaaaattatcgcgcttgtgtcaatgaattagcacattgatctcttggcttactaattttcatatgaattgacttatttaaaaaaaaaaaaaaaaccctgctaagtcctccatatcttatttgttttgctaaaagctctgaaacctggttgtaagtcataggcagatttttctgtttttttagccagcactttataccagtctccagcttctgtccagaattactggtataccagatagctctttttaactcaagggcatttgacctgagtcctccaagagtcagtagacaagtcatctgttttactatgatttccatgcgcctttgagaatttgtatctaaaattgtgctagctgacctccacctcggctctctaaacctcacccactgtggaagaaaggggaggtcccacggtacttgccttggcctttcttcccagagggaagctgtgttgactttgaaagaaaacagttaatctgttccagcccttaaggatgctctattgcaattgtttgtattgcctgtgtacttaactatccccacctgtttaggatccctttggcccagttccattttcttctgccaagtctaccagagtcaccattagcattagttgtcttaaaaggctttttgtaaaagcaagatgtatttgatgtttaatcatttgggaagtaaaaaagagatatgatttaaaatttacatatttaaacacaggagaagcaaccacactgtcttttggctgtgagaggcacatgtggttgtggaggcttttatcagaggataactatgtcttctccaccaaagagggcagtggtgtgccctcctccctgagtaccagggactggtctctggaaagagatgttcatctcccttggttcttgtggatttgtaatactcattcctgtccgtctggagcttatattctagttgaaatagcttagtttcttctgacattcatttcttttttcaccctgcttttttcttttatttatttcatttcctctcaagccaattggaaaagaaatgtttatttaaaagctctatgtcgtccagacccagtggctcatgcctgtaatcccagcactttgggaggccgaggcgggtggatcacctgaggtcgggagtttgagaccagcctggccaacatggtgaaaccccgtctctactaaaaatacaaaaattagccgagtgtggtggtgcatgcctgtgatcccagctactcgggaggctgaggcaggagaatcgcttgaacccaggaagcggaggttgctgtgagctgagatgtgccactgccactccagcctggatgacaagagtgaaactccgtaaaaagctctatgtgtaaaacattggtcttttaatgttaatccagaaggtaaattgataaggcatcaaattaggaaaatgtattaatattatgcctcccttaggcctggaagtttgagtttaaaaaagtcatgccaaaacctaaaaggctgctgtgtgaggactctgtcgacacgcaagctctcacttgcgcccactagagcctcaaggtccttacgaagacacttttcaaaaacttgaatttggctttacagcgagtaagcccagctttcattgtctcttctcagattcagtccctgtcaggacgccctcgatcctgtgatgttggaggtggcaagtaagtaatattctttctgttcgtgtttcagggactatcctgaaggtttttcccaaaagtctcgctgctttgttacagaactctcagaaacgtaacttgctatgcataaattgaaagtcaactgcattttcataaaaacagccactctcttttgatactcatatttcatctgtttaaactaattaaattacatgactataataacaaacaaaacttacataagtatgtttgagaatcacacaactgactcttggtaaatacacaactctccgggtagaagcagtgtcagaagcagaaacgtgcaggaatcgagaggagcctaccagccccgagctgtggcaggctgtgggcatcggtgacatcctggccaggggaaaagggaagcatcagttcacctggcagcttaatggcacagaagttaattaagagagtttctgtgaatgtacttaatgtcactgaactgtacacacagaaatggttaaaatggtaaattttatggtatatttattttacaacaatttaaaaacataaatggaagataaatatattttccatttgcaatacaaaaaagtttctatgaaaccattaatttgttagtggatttaatagtatgcaacttcactccctaaaaggtttgagacaacttacaaaaatatagtacaagcaaatgaaaaaggaagttcatgaggaagttgagtctaagagagaacgaggagatgagagagataatgaggcccttgccttaacagaaactgccttgggagggccggctggtgtgctgcgtgggacggtacagacagctgctggggaggttcacagagaggaccccttggaactcgatgggctgtgtcctgagagagccccaaggaggcttcctggggctgtttatcatagtgtccgtgagagcagtcccaccacttggaactgaagccaattcagaaacagcaaggctgcagggccaaaataatgtggtttggaaatgggattcttgcatgatctgacttagtacatacaatcaccagtgggtcagtgggtgaactaaatccacttcaagcagtcattgaatgtgatttcccccaacagagcttcctgtgagtatctcacagcagcgcagtcaaggcactctctactgagtacctggagctcagacattctttctggcaggttaaacgtaaactcaggtgatttgctgagctgcgccacgggttgatgtttgcttcagaaagtgggcaagcctgccaggacgcatgcccaacaaaagacaggccgccgagaggtgcaggacattcccatggaaggggcaagcttttcctcaagggagtctccctcaacctagtctggttcaggggcttcctggtaaaatggaaatttggaaacaaaaacaaaaacaaaaacaaacattttcctcaagaatcaattttggcttaaccatcagataaccttcaggctctgaaagcctaacattatagaattgggctgcagtactttagccctcaagaggtttttgttgttgttgtttagttagtttgtttgtatttatttatttatttgagatggagtatcgctctgtcgctcaggctggagtgcagtggcatgctcttggctcacagcaacctctgcctcccaggttcaagcgattctcctacctcagcctcccaagtagctggaattacagacgtgcaccaccatacctggctaatttttttatttatagaaaagatagggtttcaccatattggccaggctggtcttgaactcctgacctcaggtgatccacccactttggcctcccaaagtgctaggattacaggcatgagccaccatgcccagcctgttttgtttttaaagatagatagggccttgctatgttggccaggttggtcttgaactcctagtctcaagtgatcctcccaaagcactgggattacaggtgtgagccaccatgcctggccaacctggagagttttaaagcaggtgtttcttaggtagagaaagttgctttcttgctcttactttacagatagaattccattcagtgacttctagtcatgcagatatttattgaccccctaattcttggcactgggttaaacaatgaacaaaacagatcaagttcctgctttcgaggagctaataatctagtagagcaagatgggcagaaacaaataagcaaagcacagcaaaagtcatgtgtgggtaaatgcactgaaggagacgcaactgtggcaggtggacaggcagccaccagcgggcgttgaggaaacctttctgatagtgtgaagcgacgcagagagggctccaggcagcaggaacagcaagtgcaaagaccccaaggcaggagtgggcctggagttcaaggaggcttgtattgcttggatctgacgcagagaagatgggagtcgttagagggtcttgaaccggggggcgcattactttccttagatcagtggtgactccgttaggtagtaactatatttggaaaggaaccacctgtatttctcccagctgcagaggaattgtgtgaacgttactaatgacctgtttcacagtggtcacattttttccatccttgctctgtgctgttggacgcttctccctgccgcgcccctgctctctctgccttcactcccacctgatcacccatggatctttcttctcagtcagaaagcccatctgctgtcacgttgagggctctgaggtctcaattttatttttctagtccttgatctttaaccctataaacagttccatacttccagccatctaagacaaaattcaggctgggcgcagtggctcatgcctgtaatcgcagcactttgggaggctgaggcaggccgatcacttgaggtcaggagttcaagaccagcctggccaacatggcgaaaccctgtctctactaaaaatacaaaaatttgctgggtatggtagtacatgcctgtaatcccagctactcgggaggctgaggcaggagaattgtttgaacccgggaggcagaggttgcagtgagccaagatcgcaccactgcactccagcctgggcgacagagcaagactctgtctcaaaaaaacacaaaataaaataaaaagacaaaatttatattcagtttttctacaaccaaaatgagccttcttcctcaccctccggttggacacctctcctgctgcctcatttctttccaaaactccacagttcgcccagtcctacttttaccaagaaaagtgaggcgaggctggcaggagtgagtgctcagctctcttctgccactgattcccccgtcaccacccttctctggtcctagggacaccgaggtccctcctagtcaggccggccactttaccactccctggccctcctcccgctggatttgtggaggcctttctctgctagttaactgtccctcatctccagaattctccgccatgctttctgaaagcatatttactctcaggtgttccttcctgcttacccatcatcagcccaccatgccctggctgccacctctgctgttcagtggaaccttgagaatgtcggttgcctcctgtacgtaactgagagagaaatatccctgctgcatgtcttcctagtgagcagaaactcaaagccaaaatagaattcgtgatctcatccatacccctgccctcattcccaatctgctcacatcttcagtgtcccctgtctcagtgaggggctccaccagtccccaggctaaaggccccagagttgttcttgagtcctacttccctgtctctagagtctagcctgcctctccctccctgcgctcgtggcctcctgctggagcgttcagcagagtcatagcggcctctccacctccaggcctgctccgtgcaccccaagaccccttccccaagtctgttagccacgctgtcctaagaaaagctgatacctctcccccaccacactgcccaccccgcgtccagccttccactggcgtcgtgtcagcctctcatcagtcccagcctcgggtgctctctacctgcttttccacttccatctcccaccactaaccagccctcctaaactcaacctcccgtggtctgaatcctcacagttctgagggcacaccatgtggtctcacacctccctgcttttgcgcatgctgtgagctttgcctgaaatctttttcctgactagatcacctgagttctttagcctttaaactaagctcagatgtcctccaaggaagcctccccaggtcagctgggcttccctccacatggcctccctccaggctctatcactgcactactgaattgtattatgttgccggttatgctccttatggctcagtctcttgaagccctgatgccagtggctggcccctgggaggtgctctgctgatgtgtgcaggagggaatgaagtgtcctcaggattcgtgacttccctctgctcctggctggtggcaccttctcccgcattctcctccgcgtcaccctcactgctcttttcctatatcacccctggaccactgcaggtggtccttctaattggttctccctgcctctccttctgcctgctgaggccatcctccacactggaaccacagtgacatttctgaaacgccattctccagcttaacctggcctccctctttccacagtccctgatccagactcctgagaacagcacattctctcccgcctgcctctccctccccatgtgccaccctccctcctcaccctctgccctgacacctgacacctcagccatgcccagctactcttaattccacgcacacactgtgtcacatccatggcaaacccgtcccctccacagcccatcctgacatggacaactcctgcttttttgctcccggtgtcacttatatgcactggttacacacaccccttctcaaacccagcatagcgcgcttcctgccacgttgcagttacttgctttcccaggctgtctctcctgcccatctgtgaattccaaaacaaggtcctctcagacctggctagcaggcccctccctggggccccgcccttgagagggcttcattcccaaagggaacgtaccaccagtgtatacgcactaggcctggggggtggctagagagtcagcagggtgtggacagagtttggctgcataggctgggatagctatgtgcgtactgcagtacagaacagaactagggggaagagaaggggacgtggactgagggccaggctgtctccctgtgcattctggcacagaactccaagaagtctgagaattctacatgtaaatctggcttcacaggctattatgaaggtataatatgtcaggatagacacatagaacaaagttcatgtaagggtttgttcatttgatttataacttttaaaaatggaaacagatggtatgcgggccttcttttatactcttgctccaggcctgtacatttcaggagtaggcctgaccccggcggacacactcgccctgcttgttcatcatggtgccgccaacatgcggcccgctgcctggcacacagtgcctagcccatagattgtgatgaatgaatggcaacatctctttgtcactttaaagtttatgaagactgtaattttaaaaatatatcttggaaggtatattggaaggtagctagttactcagagatactttttctggtagcaaagataacttaaaaatctagcaaaaagaactacataaatagcagtgcctcacattttatagagtggtttataattttcagaatacttttgcatccataatctaatctggtcttgattattctagaccctaatctagtattcctgtaatgtgggcacaggtagtgggtgaggatatgtgtttcggagaggttaagccgagcaccagtgttctcagaatcagagaggccgcaccaggacctcggtcttttgtagccactgctcttatttgacaaggaaaaggtttcagccatgtttggtttcccaacagccaaatacattgtagaaagtcattcttaatctttcttttttcagtgcttttccacataatggtcaaaacctaggcctctcacccttcttggggaccttgaacactggagggtcattgccagatctaaccaacctccactactcgacacccctgccagcctccctggacaccaccgaccaccactttggcagtatgagtgtggggaatagtgtgaacaacatcccagctgctatgacccacctgggtataagaagctcctctggtgagtatctcctgcttagcagtgacctggtggcttaatcataggtggtccccacccatgtggcctgttcagtgaatcattgaatgagaatgactgcatcccagttagagatgataatgtaccttcttgtatctcctgaccctgcggacatttttcttggatgtttctgtttctcctgggttgatgaatttggggcagctctgctgaacctcattccttatcatcctcactcgctgctctatccagggacttggggaataagatatgggagccaagaaataagcatccactccgtgttggctgaacagtattagtggctgtcatcaacatatgataatttataatttaggccatctctctggattcctttcattttccattagatttctaaaggcaatattctgcattttagaaaatttacagtggatatgatgaaaatatttatacttaatatctgtgtgtgaagtagaaatcccccacagttccagttaaagatgtagcattagctatataaagatgctacccataatgggacttgggtgttactctctgggtttgattgtccacagctcagaccccatattgaaattatgactacatttgtttgaagcctgacacttttttttttttttttttgagatggggtcttactctgtcacctaggctagagtgcagtggcacgatctcagctcgctgcaacctctgcttcccaggttcaagcaattcttctgcctcagcctccagggtagctgggattacaggcatgtgccacgatgccgagctaatcgtttttgtatttttagtagagacagggtttcaccatgttggccaggctggtctcgaactcctgacctcaagtgatccacccgccttggcctcccaaagtgctgggattacaggcgtgagccaccactgacatacccttgtcaatgtctagggcaggtgataatcctcttactcccagtggtgcagtacagcccctggccgtaacagtcctacccagaattgtgttgtggagcatttcatttggaagggatgctcagtgatggtctccaggtgaaagcagtgtttgctgcctttcactctgagactcatccatgcaaatcagaactcaccacccaaatgagagtggtccccttcagggggggtcacctggaagtttttctaatgattgcagtgatgctgcctggtgcaacacaatcttaggtttgaagaattgatttcagagaacacctttatttttgttttttgggtcattttagtatccttaatagtagcaggtttttcatcgactgagtctcagttttgatatttatacatttgcttcataggagaaatttgatatttgcttcacaggagaaactctcgaaacctttatgcccagattcagagtctgggcaattcaccttttgggtgaatcctcaatgtatgaagatatctagggtcccagaagtaaagcagcatcagcacatagctcctttgggtctcagggaagctggcattttccagtacagcctttgacactttgcttcaagctgaagatcttatgtttagtcactggttgtcttctcaaaaaagcactattttatccagaacatgtcagaaccaatgtcagtttctgtattttcttttttttttttctttttgagacagactcttgctgtgtcgcccaggctggagtgcagtggcgccatctcggctcactgcaagctctgcctcctaggttcacgccattctcctgcctcagcctccccagtagctgggactacaggcacctgccaccacgcccggctaatttttttagtagagacggggtttcaccttgttagccaggatggtcttgatctcctgacctcatgatccacccgcctcggcctcccaaagtgccgggattacaggcgtgagccacgcccagccggcaaaattatttttaagaattttaggctgggtgcggtggctcactcctgtaatcccggcactttgggaggccgaggcgagtggatcacgaggtcaggagatcgagaccatcctggctaacacggtgaaaccccatctctactaaaattacaaaaaattaaccaggcgtggcggcacatgcctgtagtcccagctacttgggaggctgaggcaggagaatggcgtgaacccgggagacggagcttgcagtgagctgagatcatgtcactgcactccagcctgggtgacagagcgagactctgtctcaaaaaaaataataataataatagtgataataataattttgccagctgctggatttttgtcatttcttccttttcgtaacttttatcaaacacttaaattttttgtcaacacgaaacaacacatagttctgcttaccccacctgctggtacaagaaagatgggctgaaggttaaaacgtaggtattgccagttgagatacacacagcagcagcagccgaataattgattcactgggcgaacctgctccatgccaggccctgtgccaggtgctgaggatccagcagggcataggacaggatccccagtttctgggagctcatgccctagcagcctatgctgcaaagatctctctcccaaatttccttgctcatgatcaaattcacccctgtcccccaaataaagcaccagcaaaaacttccttttccctgagttggtatagactgtgatgaacaatttcctgggaaccagaaaatcaaagagggaccctggggtgggagatacagggaagtgtcccttcctgtgactccctagtgtgctaagggtaattaaagaccaccaagacagctccccaagggccatgactcgccgtggaaggatgttctccaaaggtagcaggggatgcaggcagtgtgcttgggacagagaccttccggggctctaaacagaatttgttgtacagccctagggtcctttccctgggtctgggccgagcacctggaatatttgcctctgttaccccggtttacctagttttgctcacctaggggttgttgacgtgatctccctcctcatgggaaaacatcgttgtcatctttgtggccccatctctgttagtgcaggggcatcttttccttgccattggtgcatcggatgcagtccctgtaggagagctgtccaggagctcctttacctacagaatcatcatcgcatgtgacagtagacagttttctttcatttttggaatacaaaagatttggtctgaaattataagtaacttgtgaatttgttgtcttccaggtctccagagttctcggagtaacccctccatccaagccacgctcaataagactgtgctttcctcttccttaaataaccacccacagacatctgttcccaacgcatctgctcttcacccttcgctccgtctgttttcccttagcaacccatctctttccaccacaaacctgagcggcccgtctcggcgtcggcagcctcccgtcagccctctcacgctttctcctggccctgaagcacatcaaggtttcagcagacagctgtcttcaaccagcccactggccccatatcctacctcccaggtaaacacacacagacagaccaaccactacagtgaaacagactgcaagatataggaagtgcattcctcctctttactattttgggttacactcattattacaccaagcacccatgaggtctcaagtgcagtctgttcgctcttatatgtgaaatcagagcagaagtgtcaataatgcagaatgaattcatgattttcttttctttttttgagaaagggtctcactctgttgcccaggctggagtgcagtggcacaatcgcggctcactgcagcctcacctcccgggctcaagcgatcttctcaccttagtcttcggagtagctgggaccacaggcatgcaccaccatacctgactaattttttgatttttttgtagagacaagttctcgatatgttgcccaagctggtctcaaatgcctggactcaagccatcctcccagcgtggcctcccaaagtgctgggattacaggcatgagccactgcacccagcctaattaatgattttttattataataatagcagatttgctgtgttgattactctttaagcaaatgttgaacaatctgtagtcactaactcacaaacttggggttgagaggaacggtaggatatagagaatgccatccaggtaagtctaaggcaactgagggaaaccaggttaggatttcaaagttggcatggaaaatcagtcattgactctctaagtacattaagccataggggaaagccaaagaaaacatttaataccttcctgaagctttgataatgaattagacctcttccctaattgtctacagatttgagaaacaatacttttattgttcatgaaatgctaagtatgttgaggattatatctcttataaggatgaaaagaagtctgttgagaaagaggcacatttaaaagtcacccacccatacaaaaaatggaaaaattagctgggtgtggtggcacacgcctgtagtcccagctactccagagcggaggtgggaggctcacttgagcccaggaggtcgaggctgcagtgagccaagatagcctcactgcactgtagcctggcaacagagtgagaccctgtctcaaaagaaaagaaaagcccattatagaaacacaggggttgaaacatcctataaattctaaactcagaggtggttctccttataccataatcatcgaggaatgtgttttcaaccttttgtcacatcctctgtctattacagcatcattttttttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgtgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctattacagcatcattaactactcaccacctcgccataaattaatgatttagaaggaagagttgacagaacacaacggagagttagaggatcttgttattggtcactctttaccaattactagccgtggcgtgttgatcgtatgagtgatctcttttgggcgagggtgagaggacatttcataatttttaagtctcactctgtcgcccaagctggagcacaatggcacgatcgcggctcccttgccttgaattcctgggcccaagtgatcctcctgcctcagctgggattcttcaagtaaatgtgactacaggcccatgtcaccacacccagctaatttttttaatttttttgtagaaacagggtctccctgggctgggtgtgtgcctcacacctgtaatccagcactttgggagtccaaggcagacggatcacttgagggtaggagtttgagtccagcctggttaacatgacgaaaccccatctctactaaaaatacaaaaattaaccgggcatggtggcacacgcctgtaatcccacctactcaggatgctgcgacgtgagaattgcttgcaccctggaggtggaagtttgcagtgagccaggattgcaccactgcactccagcctgggtgacagagttactctgtctcaaaaaaaaaaaaaaattagaattaaaaaaagaaaagaaagaaatagggtctccctatgttttccaggctggtcttaaactcctgagctcaagtgatcctcgcacctcagcctcccaaagggctggaattagccagtgtgccttgtgccaggcatgagccactgtgccctgccataatttttatttttttttagagacagcgtttcactctgtcacccaggctcgagtgcagtggcgcgatcacagctcactgcagccttgaactccctgagctcaggtgatcctcccaccttaacctcccaagcacataggactacaggtgtataccatcacacccgactaatttttgtatttttttttttttgtagagatggggtttcaccatattgcccaggctagtccataattattgttttcgtggttcttatgttattgaattacctttaattttattttgcaagattattttataagatctaaaagtattcttgctttttagctacattttaaggagactgtatggccagagtgtcccctttcagatgtgtttttaatttgtttaatatttagattttttttaaatgaatgttgctggacacagttgttctgactgtaatcccagctactcaggaggcagagactggaggattgcttaaggcccggagttcaagaccagccttggcaacatagtgacaccctatctatctcttaaaaaaaggaaattttaaaaagtgaatgttattcatgcacatagtttaaaaagtaaaatagttctaaagggcttgttatagaaaaacagctgtctttccctctcgttaggcatattcctcactgcctagagatggctgtcaaccattttaactaatctctttggtataaccatgttattattattttgagacagagtcttgctctgtcacccaggctggggtgtagtggtgcgatctcaactcactgaaacctccacctcccaggttcaagcgattttcctgcctcagcttcctaagtagctgggactacaggcatgtgccacgacgcctggctactttttgtatttttagtagatacagggttttaccatgttagccaggctggtttcgaactcctgacctcaggcagtctgcccgcctcggcgtcccaaagtgctggattacaggcatgagccacctcacccagcctaaccatgttgttttatgctttttttgttctacatttttggtgttaggcattatctaatgacatcctaccaatgaagattagaatttaattctctttccactctcccacagactccaccacacacatatgtgcgcacatgtgcacacacaatttcctacccaccctcctcatttattataattttggttagagcaatactcaatatttagtgtttttatagttacaatgtagtcagagttgacatatagtatactatgaaacaagaaaatgagaattttttttcctcttgggagttaataaatgtctgactttttttattagcctggttatctatatgtatctatgtgtatgactaattcagtccccaactcttggagttgggcagatctcctctcgacacattcaaaactaaattctctagtagctctatagcaaagagtgcctgtgactttgtatgacttaaaatgtctttatttgatctgccatttaattattatttggctgaatatagaattctaaatttgaaataattttcccttggcatctattgcctattcatttgtaagttgcattgagaaatccagtgccattcggactcttaacactttgcatggaatccccctgctccaccccaggcttgtgagatctttttgtccccagtgttctgaaacttcaagatgatgtggcttggcgtgagtctgcatatttggtgggttccttcaatctggaaactcacagccttcatttctgggaaatgttctttatttcttcaatgatttcttcccttcagttttctctgttctttctctctggaactctacgaatgttgactatcctggacttttcctctattatccttatcttctctctctcctcttttgcttctctgtggttgcttccttgtttgtttgttttgctttgctttctggaagattgtctcagctttatcttccaacacttctgttgagttttccatttctgctctcatttttaaattgctatgagttcttttttgttctctgagtgttcttttttaatagcatcatacttattccacagatgcaatatcatcttttatctctcaggtttttagtggtctttttttttcgaatttatctttattttctataatagaattttcctaaattgcataaaagtagagaacataatacaataagtcctcctatacccatcatttaccctcaacaattaattttttttttttgagacagggtcttgctctgttgcccaggctggagtgcagtggtgtgatctcggctcattgtaacctccgccatccaggttcaaaccattctcctggcctcagcctcccgaatagctgggactacaggtgcacaccaccacacctggctaatttttgtaatttttagtagagacgggatttcaccatgttggccaggctggtttcaaactcctgacctcaggtgatccacccacctcagcctcccaaagtctgagattacaggcgtgagccagcacgccagccttgttatcttgtttcatccataccctgcttttaaaaattgcagatattttaatatgtatctctaatagataaggattttcttagtagcctaaatattgtcatgctgattttggtttttcacaactacttcttcctgcacacatctttccaagattgtgtgtgtctgctctggcctctgactttcacggcagatggtttcctcagggcctggtgatcctcagtgctctgctcatgtttaagaacaggacactgaggggctgtctccttgcggctctacactagagcggagtatgagactgaggcgaagggagtcatggcaggacaagcgtgtagaaagttttttccactctctgactgagtattggttggaaggagcgctgctaaaactgtaaccaaaggaggcattttgcttccagaaaaatctcaaggaaaagtattgcaagcaacagtagtcactgttggatcgggttctaaaggtaaggctggagagattcaaccagttagcgtgaaagttggagataaagttcttctcccagaatatggaggcaccaaagtagttctagatgacaaggattatttcctatttagagatggtgacattcttggaaagtacatagactgaaataagtcactactgaaatggcatcagtgtgaagctgcccattccactgaagttctgaaatctttcatcatgtaaataatttccatatttcttataataaactaatgataactaatgacatccagtgtctccaaaattgtttccttgtactgatataaacatttccaaataaaaatatgtaaatgagaaaaaaaaaaggacactgagaagctggctggcagctctgtgtatgtgggcaggcctgctgagtgtggtcttcattgtagaatgatctagcttggtcatttccttgggaaactcctggtgtcataagttttacattcttctctggccaggcgtggtggctcacacctgtaatctcagcactttgggaggccgaggcgggtggatcacctgaggtcaggagttcgagaccagcctggccaacatggtgaaaccccgtctctactaaaaatacaaaaattagccaggcgtgttagcatgctcctgtaatctcagctactcgggagactgaggcaggagaattgcttgaacccaggaggtggaggttgcagtgagccaaggtcatgccactgcactccagcttgggtgacagagcaagactctgtctccagaaaaactctgtctccagaaaaaaagattttctctcttcaggccttgtcaggttccctaaaggacactcttccaatgtcgcacctcggcatatcaggattccggcatcctgtgagccgggttgggaaagaaaggtggagatcttaagattcgatcgtgaaatttcttctaaagaataaaatacctaggaatccaacttataagggatgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatccccatcaagctaccaatgactttcttcacagaattggaaaaaactactttaaagttcatatggaaccgaaaaagagcccacattgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagatataatgccacatatctacaaccatctgatctttgacaaacctgacaaaaacaagaaatggggaaaggattccctatttaataaatggtgctgggaaaactggctagccatacgtagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattaacaaatgggatctaattaaactaaagagcttctgcacagcaaaagaaactaccatcagagtgaacaggcaaactacagaatgggagaaaatttttgcaatctactcatctgacaaagggctaatatccagaatctacaaagaactcaaatttacaagaaaaaaacaaacaaccccatcaaaaagtgggcgaaggatatgaacagacactcttcaaaagaagacatttatgcagctaaaagacacatgaaaaaatgctcatcatcactggccatcagagaaatgcaaatcaaaaccacaatgaggtaccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattccttagggatcttgaactagaaataccatttgacccagccatcccattactgggtatatacccaaaggattataaatcatgctgctataaaaacacatgcacacatatgtttattgcagcactattcacaatagcaaagacttggaaccaagccagatgtccaacaacgatagactggattaagaaaatgtggcacatatacaccatggaatactatgcagccataaaaaatgatgagttcatgtcctttgtagggacatggatgaagctggaaaccatcattctcagcaaactgtcgcaaggacaaaaaaccaaacaccacatattctcactcataggtgggaattgaacaatgagaacacatggacacaggaaggggaacatcacacaccggggcctgttgtgggatgcggggaagggggagggatagcattgggagatatacctaacgtaaatgacgagttaatgggtgtagcacaccaacatggcacgtgtatacatatgtaacaaacctgcatgttgtgcacatgtaccctagaacttaaaaaaataaaatattaaagaaaaagaaatttcttctaaaccctgtgttttcagtaaagtgcctcaccttctaatatccagagacccttagttttattatctcgaaagtagaaccttccagtctcctggcaggtggcaggatggtgggggccagtgcgcagaagcacactcaaggcaagggctctgcaggtccaactgccccttacacaaactgtgaccagaatctcctggttttagcttcaccgcctgctccctgctgtccccagtcccagagccctgtggggactgagtgctgtcagtgagattgcctcctggtttttcctcactgccagcctagcatcgggttttctcagctctgctaagccagctgccaccgggccatctgctgctcattttccagcttttgttgccattttcttctctcccgttatctttgtcctcgtgttgtttgttatcatttagtgttctgtgctgttgtttagtgttttttattaatgcttattgcttgttaatgttgtagtgtcttgttttaacaggatttggggatgacagagctaagggcctttttcaattttccacttttaaccagaagacacggctataaaacaaaacaaaacatgattttcacggagaaaactgaaaggaaattggttaaattggctgttttcttgtttagttcttttaagacaatagaacttgtcattgaatggaacatgctttgtggggaagtaaaatttgagatatactttgaaggatgagaaacgggcttctcacagcattgcacagaacaccgcggtgaggaaaatctcaggcttcctctcactctgacatttcctaatcctaaaggacttaacgccagaaacgcagaagctcattagtggctttgtgtgtttgttttgcagatggtgtcctcagaccgaagccaactttcctttctgcccacagaagctcaagcccaggtgtcgccgccacccccttaccctgcaccccaggagctcacccagcccctcctgcagcagccccgcgcccctgaggcccctgcccagcagccccaggcagcctcctcactgccacagtcagactttcagcttctcccggcccaggtgagttctggcaggagcgttggtgcagagggaatgcttgttttgctctgagttccaagctaaatgatcatctccttattccctgaagggctcatctttgaccaacttcttcccagatgtgggttttgaccagcagtccatgaggccaggccctgcctttcctcaacaggtgggtgatcgcccctgccttctcctcccttggtgcataaactgtaccatttaggttgttcattctgtagaattcagaactgagcagaccagacatgccactttcctggttctggttgtgttctgtggctagaagagcctttcatcttctttggccctaaaatgctttctctggctgccttatttagtatcaggcttcagcagaggaactattggaacaatcggcaggagacttttgatgacactctcgttgtagaactgtaaaatcatgaacactggaagggacacagcacctgcctcctcagcgccctcatgttgaaactgaggcatagggagagtggcgcctgctcccaccgcagagtcagaaggtggcgccgcatttggcctgcacccaggctggtgcacccagcacagcgtggggcctcctggggagagctcagtcctggggagtgaggggagtgcgttccgtaaggtattttcaactcggccactttcttttacagtttagttttttcctaacattgactatttttaatattctagattttatagtattcaatagtattcaataagtatggactgggccctccgatggattaaggagtggaagaagggttgaacaggttccagaacttttttttttttttttttttgagacagaatcttaatctgtcgcctaggctggagtgcagtggcgtgatctcggcttactgcaacctccacctcctgggttcaagtgattctcatgtctcagactcctgagtaattggggttacaggcatgtacccctacacctggctaaattttatatttttagtagagatggggtttcactttgttgaccaggctaatcttgaactccggacctcaagtgatccacccgccttggcctcccaaagtgctgggattacaggtgcgagccactgtgcccagccaagaacttaataaaatagctgggcatagtggctcacgcctgtaatcccagcagtttgggaggccgaggcgggcggatcatgaggtcaggagatcgagaccatcctggctaacacggtgaaaccttgtctctactaaaaaatacaaaaaaattagctgggcgtggtggcaggcacctgtagtcccagctactcgggaggctgaggcaggagaatggcgtgaagccgggaggcggagcttgcagtgagctgagatcgcaccactgcacttcagtctggacaacaaagcaagactctgtctcaaaataagtaaataaaataataataataaaataaattaagatagctgtttcctaagcaggccacagatgaagctttgtggcaagaaccaatcctccttgcctccctgtttcccaaagagccattttagtctaggtgggaatcaccgtctccctgaaaaatgatagacacttcttttgagactttttttaaaatggcttagaaaattaatttcaggaaaggaacctaaaattggcactggttataaccagtcctcatagaggctttctcatagggaggagcttgcctgagtttcctccttctgagtgtgaaaaggaaagccttcccctttctcagttttctagaaaccagggaagaggccaggtgcagtggctcacacccataatcccagcactttgggaggccaaggccagtggcttacttgaactcaggagtttgagaccagcctgggtaaaatacagcaagaccctgtctctaaaaaaaatacaaaaattagccaggcatggtggcatgtggtcccagctatttgggaggctaaggtggacggattgcttgagcctgggagctggaggtttcagtgagccgagatggcgccattgcactccagcctgggcaacagagaccctatctttaaaaaaaaaaagaagaaagaaaccaaggaagaagagtccatacttccttggttatagacagagcctttgaagggttcccacagaaggcagtttgcaaaggccttggtgaggctgaggacagatgtctgaggggccacagaaaccatgagcattggtgtctcttgggatggtgtagtgggctggggaaaagtcaccacgctgtggacctcagggacccctcctccaccccagcgtctgcctgcctgacaagaatattgtgcatgcattaccataagagcaaagcactctgggatcctggaaagaagggaatatggattagtttgcaagtcaggttttgctctgggagcacattgcaatactcacttcctccttggaaacagaggtgtggccttcctcacatgaccttcgatgcttccaggtgcctctggtgcaacaaggttcccgagaactgcaggactcttttcatttgagaccaagcccgtattccaactgcgggagtctcccgaacaccatcctgccaggtgagcgagctatccctcagcttctttactgcttttatgttgttgtgtgttcaggaaccttcataagagagtttaaacaacataatattatataaagcaaaaagttaacgttccctgggtcgacttgactttttgagatgcaggtgtccagcctcagagaccgtgacacagggcggtgggcctggtagtcaaagccttttctgaaagatttcatctggcccagtgcggtggctcacgcctgtaatcccagcactttgggaggccgaggtgggcggatcatcaggtcaggagatcgagaccattctggctaacacagcgaaaccccgtctctactaaaaaatacaaaaaaaattagctgggcatggcggcgggcgcctgtggtctcagctactcgggaggctgaggcagaatggcaccaacccaggaggtggagcttgcagtgagccgagattgtgccactgtactccagcctgggcaacagtctccaaaaaaaaaaaaagatttcatcttaggtgactgatgactgttcaaaaggaaaaaacctgcaaaaattgggagttgtgcaactgactgacaagaatgtagattccagggcaagaactgtgggcctgggggtggtcaggatgtgtgggatagcagtttaggggactgtcatcagctgggtttgcttagtagcctggagccttcgcgcctcctaaccgcactgttttcccctctggccactcctttcagaagactccagcaccagcctgttcaaagacctcaacagtgcgctggcaggcctgcctgaggtcagcctgaacgtggacactccatttccactggaagaggagctgcagattgaacccctgagcctggacggactcaacatgttaagtgactccagcatgggcctgctggacccctctgttgaagagacgtttcgagctgacagactgtgaacagaaggcagtggaacagaagaatgtttttctgcaacagccaaaatagaatggaatagaatgaagccagctgataccacgggctttcgttatcttgacatagaaggaagcaatgccacggctccagggtttcagatgagatcccatctcagacactgtggcttcctccagatcacacagctttgtactgcctctcccgcctgtggccaaagtcgtgttgcagcaggcaggctgcttggagcttcccatgaactggaaagctcacctccactgcatctttttactggccatccagtcagccgatgtgtaagagtaggaaatactgtgtcactggaggcctccgtagcattgtgtagtgtgctcagaaccactgatctccgtccgcaccgaaggcgggcccggagtgggaggctcggcctggggcggcggcaccggagagggcacctcgatgcctgctctgacctgacccagagggcgaggccctccagcgggggacattcccaggctgagtggaccccacggctctctcccacgcctggattacgacatgaagtttttaccacaagcccgagggcaggcttgagttaggcagactgaaggctaattttcattttctcccagctggtttctgctgcttcagaaaagtacaccttttccttatggaccagaggaagaggaagaccattttatcagtcactgaaaagagtcccctggcactgatgagcctgaagagaactgtgctcctcctcgggggctggggaaggaagacagggactgcaggtgtctcatactcagtggcctccagacaaactccagacaagcacagacctccccactaagagcagccagagggagctggtgaggccctaaccccacccaccgagcaactgagcttccccatccctccccagagctgtgtctctgtgggctgggagtctaatgtcacccccctagaccgtaagctccttgagggcagggacagtgccttatcattgttgaacccgtagcacctaacacgtgcgtggcagcacagtcgtgtgctggagtgagtgctgcagaaccgtgcgtgcagcgcatgatgaatgagtgcgtccgccatgccgtaaggcaggctcacctgtagctatccccttccctgccagatcttctcagagctttagcttttctagcactcgtgcctatggtgaagcatgcactttaatatgcttttaacactaggtgaccaaatcacagtgaagccgggcactgcattctccttgggctgtgctccacgcgggtgggtgggagctgtcttctgagtacatccggaagggctgagcaggtgagtgccctgagcatcctggctgggccccacccaggaagatcttccttctcagatccacgtttggctctaaattgcttcaagtagagattcattctttgaggttgaaaaaatagtttatagtaaaacgaaggcctaattcatggaagcatcattagtcatcaataccttctcataaaatagatgggccagatttccaccaccgcctgcctcctctaacttgggtgatgccagtaggtttgaagggggcagagcactgcagggggaggggggggtctaggctgtgagaggacagggtggagaggaggagaaccctgaaggagagacggaagatgccaggacctttgcttggacagccattgcccttccaggagaccctggagtgtactgagggttgctggactgttccacccagaggagcaaggctgtacaatgagggtctgaatctggcacacctgtcccttatgtaaaaggagtcgtggtcacaagaccctgggctggttagcctctcccgacctcattccatttctatcttctgaccttgcctctcatctttaaaataaccctcatggggtgcccctccaccttcctctggaatccaagtattcctgtttcacatttgccccaaatctttgctgtggaattgggaaatcaaaccagagtcctcctcgcctgatttccagctcaggaagggcctgctggcctgccctgttcccagttacactttcagatccctttgtgctcaagatctcagagggggtggctttttgttaaagagccttcagtcgcaatgctacccagcaccccatgtgccaaaagaaaccagctcctgtgtcaaagggcttccaaacctgatctcactctcaacaggcgatggtgctgatgtttcaagaattgtgtttttataaaacagaggtctcagcatagtcactcttcacatagtgccttacccatgggtatcgtcatatccgggtcccagttcagtttgtctgcacagcagccaccctgcctggcaacagagaccccaagacctacacagtgaaccctactgccccaaaggcgttctccaggtgacttgtgaaaacagacctccggggaagtgatttattgggggtgtacactgggggcaatatggtttagcactgaattcaatttgtccttaggtctatgagtgagtccgatcttttcttgtgaaaggttttgggcatcgtacaacccactctgcctagaaggtgtggaggactcaccacgggcagggtcgccctggcccacagcacgtgagcctgcactcactgcggcctttgtaacaaaaccagttgtggtcctcagcatttgaagcagctgcatacttcagagtaaactatttttcattatttagttttgtcacaagaaatcgaccattgtactactctcacttacagcagttaaacagcatagaactaaaaacctgtctgcatttccattttttctttctgtatggttgtgggttttaggacatagggggttaggagaaggggtttcttgatcatgtcatgaattctcctttgtcctgtttctcctgtttcatttctcctccgcctgctgtatattacctgagctggtgttgtatcttcaagtccatatgcgtatttgcagacctttcctgttcccactcttgttggctcttctgatttatgcacagatggttcccagcatgtgtccagtgcttcatggatgggaccatcccagcaactaatcagacttcctgccagtgtcctaacccccagggcaccctgttcaaccatatttaaaaattggaatttgtataaagttgcttccaagttttataatgcatcattttacatcttttgtaattaaaagcatcacaatg

SEQ ID NO: 38416 - DNA, 22622 bp, Homo sapiens
gcagtcgctgccgaccggctggctgggccttgcggcgtgaggaccccggcggcgccgcagtcccgcgagccatggcccagtccggcggggaggctcggcccgggcccaagacggcggtgcagatccgcgtcgccatccaggaggccgaggacgtggacgagttggaggacgaggaggagggggcggagactcggggcgccggggacccggcccggtacctcagccccggctggggcagcgcgagcgaggaggagccgagccgcgggcacaggtaggcgcggcggctggcccgggaggtgggccccgagggggcgccgggccgcgcgcgagttcggggcgctgactgcgcgcgacaactcctcgggcagagggggttgagtcagccccgccgccggggaagcagctccgggccgagcccctgagtcagaaccggcccgtggaggcagccggtgccccagcccgcagcttcgtcgcccaaccgaggctcccagggctggcggccgggatctgaggggcctggacgtggggatgttcagggatccaggaggaggactttcacgggccatccaagccaccccctcctctggaggaggcctcttctctgtgggctccctcaagacaccacctccccatcgccgcaaagtccatccctacccgccttcccctccccttgcgagtggtcccgcttacccttcactgccatcatcgccctgcctttcccagtcctgctggctgcgctcagtctttaggtggtagcaggccaggtacagcggacacttgctgatgggggattccaggaggtgggatttcaaggtaatttgagacggatagaggacttgctgctttacttcctccgccctgggggattcccattttcacacagcctttcccaccagacctttatgtttgcatcatcttgctgccttgcggggggcggggggggggtgttcctgggttttgggtagtttggagctgctatggcacttgtttaaccttgtcccgggtcccgagctttgtcctcaggcaccttggctcctgtccactaatgcccaggcccttaaggactggtgttttgttcctgctgttgaaaggagataaaacatagacatagacatgagagtggggaaatgacagaacttgcacattctggtggatgccaacaggcacttattaggagctctctttcttctaggaccctgtcccaggcgtttagctgttaaggttctgcaggattgtcctggcaagcgtatatctacttcactgggagaatactcaactcaagggtggaagaatactgggcccagagccattctctattactggctcacccttccccaggttaaagggtcagacttctggacccagagattcggggcagaccagtagagacagttgttaggggagaaaagtcagcccaccagggtagggcaggaaagctggaccatagtgtatgacaaagtagatagatcagtgctttataatgcaaggcctgattcgtttagctctgtgccaagtaccgagagcataaaaatgatgaacccttagtcactgacagctcacagtctcgagaaggcagtcccctagtcagacaatatcagagtatgtaaaatagccccaagtggtttatccttataactttattttcctgtggcagtggcaaatagccatccctatcctgagggctaaatttgtgagattgtatcattagccaggattaaagctctacttatgtttaaggcctggaaagatcccctatggaggtctaggagaaaccaagcctcagtatgggtaggcctcttgcctgaacccctcttgctcttcctccagaactgcccagctcccgtggcttgagtctcagcaagtgttcagtctgaagcccttcctgctgcccactggcatagagttgaccccagaaaatccctggggttcttcggtgagctgacagagcccagtgggcaggcacccagagcaggaggagatgtagccaagaacaggatccacactatcccctgtttggacccaggctcgcatggcagcagccatcacccgatgtgaatgttctcagctcctggagcctacaggagaaaacccagattcctcaatctgctcattaagatgtgacacccactcacatcatctcctcagcccattgcctcaacagttcacgctgtcaacagttcacgctcccgtgattccagctagttccctgagcatagggggctattttgtgtctacatgcctctgcacccccacctctaggtcctctgattgactgatttctagtcagcctttaaaacttcgctgcctcttctccaccacccccaatccccaccccagagctggctgtgtttcctttcttctctgttgctgtagtactctgtacattttatgcctagcaccttccacaattgtgattctatcattgtgtctccctcacaggaataggagctcggtgaattcaaggaccatgcttgcttcgttcattgtatcttcagcacctagcacagcacccagcacataggacatgtttgttgactgaatgcgtatctctatcatcacactcactcaatggtgttgagatatttgtgtttccccttccctagacagtgagatccttgaaggcagctgccttatcttattcctttttgtatttccatacctagcctaatacctagcttatataagggaacagaataaatgaacaataaagaaaagtctttacagcctctaaaatgttattgatcatctccccacatctccttcattaaaaagatgcctttccttttattctcacctttttaacataaaaattttcaaacataaagaaaatatgaaaaaatagtactatgagcattcatatacccatcatctagatttaacacaacattttgccatatttggtgaatggatatacaatgtatgtgttttccccgaaccatttgaggtatgttttacacaagattataccttaaatacttcattttgtaactcctaatgacattccctataaagccctaacactattattgcaactgagaaaattaactatcattccctaatataatcctgaagataagctaatagccaagttccacattcaagattccccaaattgtgccacaattgtcttttacagctgtttcttttttcccctcaaaccagaatatggtctgggttgaggcatttgcttcttatgtctctagactctattaatctagaaatttccaccattttttttccctaatgctttgctattttggacagaagaggtcagacatcttgttgaatgtctcacattttggattagtctggtaatgttctcatgatcttattttacttgctcctttgtaccatgtgcttcttataaactgaaagatagggctaaggttttgatttgattctgtttaaaccttttgtcaagaatgcctcatactctgtgcctggaacttgatgttccatcacttcaggagccatcccacccttagtgatgctaaatttgaccattcgattaaggagatttctccatcgtacaggttgtctttccctttgcagttaacaagttatttgtgggcttctcatcctgggttctgttgatgtatcacacttattgatttgcatatgtagatccatgcatgcatcccagggataaatctcacttgatcttggtgaatgatcctttcaagatgctgtcgaattcagtttgctaatattttgctgaggatttttgcatctatgttcatcagggatattggcccatagttttccttgtttggctttagtatcagggttatgctggccttgtgaaatgagtttggaagcattccctcctcttcaaagttttagaagagtttgagaagtattggtattagttgttctttaaatgtttagtagaattcagcaatgaagccatcaggccttgagcttttctttgataggagatttttgattcctgattcaatctccttacttgttattggtctgttcagattttctgtctcttcataattcagtcttggtaggtttcatgtttctaggaatgtatgcatttcttccaagttttccattcctcttgcaatattctttccccaatgacttttcacctaattattttagcatctattgatgatccttacctaagttggttatttcactggggactggaaattgaggattttctaattttcacattttttgtacacttattagccagcattgctctatttttttttaaaaaaagctttgtctcatcatctggattgaacaaaagtttctcctaaagaggcaaaaaaatgcttaattatttccctttaattacagttttcaaagagataatttgatataatagtcacactaaataatttaaatgagggctcttcctcaagcttatactcttcctctctctccaattcatagatttgtatttattcactttttaataattcatcacagtcatttttggtgctcaaaatgtctatattgcagccagcagacccccttgaagctggcctccttgtgtctttttgtaacatgcccattagtctttaagcacttctttgctttctggtactagtattccaggcataatttgtacttttcctactccagtcatggaattcagccatttccacagtaatctctgcttttttcaaataccagtaagaaagtatttagaaactaagacctggaattaggaaagctaacttctgccagggtattgttgctttcagagcctttcagtggacagaactaagaaatatatatatatttttttgtttgtttgtttgtttgtttgttttgtttttgagacagggtcttgctcttgtcgcccaggctggagtgcaatgacctgatcttggctcactgcaacctccacctcccaggttcaagcgattctcctgcttcagcctcctgagtagctgggattacaggcgcctgccactatgcccagctaatttttgtatttttaatagagacgggatttcaccatgttggccaggctggtctcaaactcctgacctcgtgatccacctgccttggcctcccaaagtgctgggattacaggcgtcagccaccatgcccggccaagaaatatgttttttaaaaaacacttatatcaataattccaattcaaatttacattacaggatttttgctgtttacttcttttatttattatactgaaaatcttggttcctaataacattaacataattacttattttctttgtattacaatgtgtaaaaatgattcaaagttataatattaaatattaatatgaacaataaaaaccattgagccacctgcttttaatttaacaacacaatcttctaggtttctctttttttccatgatgtttttgggacattgtacaggctgtcttttccctgctttggatggtgataatgaaagcctctactttttttttttgagacagagtcctgctctgtcacccagggtggagggcagtggcaccatcttggctcactgcaacctccgcctcccaggttcaagtgattcttatgcctcagcctcccgagtagctgggattgcaggcacctgccaccatgcccggctaatttttgtatttttagtagagacagggtttcaccatgttggccaggctagtctcgaactcctgacctcaagtaatctggccaccttggcctcccaaagtgctgggattacaggcgtgagccaccacgcctggcctctgcttttttattaatgtcaatttttttgtcagatgtagaactaagtgcctgatatacgtagtctctactccaaactacgaatcattatttagacccatggagacatccactagttgtatatccctttcccaggctcaaaggcttatgccagaacagcatggcagaagacagggtcagagaggaagttcatgtctctgtaataaatatataagaacccatgggccacgcaagcataacatgtgccccctgctagcaccatccaaaatatggtttgtaaaagggtgatgcctttaacaaagttgagaacatacctgtatatgttttcaatctgtctcagtgaaaaatccttatcttttgaatctgccctggtgtttttatattgcattatcaatttgccctttttgaaccatttcacattcattatcttgttctagaggtgagtcaaaagaaatctcacacagacaggacctggaccctagtgtttttcataaatgatgtttttgtgtttggtaccttccttattggtgtccaccattttcttggtcttggtggtcaaaataccatattccaccatctgcaatgatagacaatgagtctgaaaaatcattcctggattgaaagctgtagtgagggtctcattattccaccatcttagtttggatattctcctcctatagggtatcattcgattaactgcgcaatcagtgtaaccagattcgatattttatgaaaaaagtagccttggatgttttatgctacaaatccttttgtttctctaaatcatttacaaatatgacacacctgtaatcccagcactttgggaggccaaggtgggcagatcacaaagttaggagtttgagactagcctggccaatacgatgaaacactgtctctactaaaaaatacaaaaattagccaggcatggtggtgcgcacctgtagtcccagctactcaggaggctgaggcgggagaatcgcttgaacccaggaggcagaggttgcagtgagccaagatagtgccactgcactccagcctaggcgatagagtgagacaacatatttaaaaaaaaaaaaaaattcagcactgattcatggaacccaattacctgttttaaaatgtacccctttatttctacccatttctcacaggtttatagctataacaaaagacctcatcactcccagtttacaatgttttgttaaaaaacaaaacaaagcaaaaccttaagtgtaaaactttttcaagcctccttgaaaggccactaagagcatattcatcagaaaccatacttcctccctcaaaggatcctgataggtatgatttgccctcaaaactatttgctttacattggtgatactttttaaattcccattacatgcaaggctctggggtaatactataatgaaagaaaccagcttgagttctactctcaactcagtgttcgggctgctaataaaatgtgcacacaagtagctataatacaaatatagataagtgttgggagaagtagaaatgattttttcttcctaggagaattgcatttaagatggaccttaatgtgtgactagaatttagacccgagagagaggagcaaggcattcagagacaggaacagcaagctcaaaggcacagagtccagaaagcttgtgacacttacagataactatgtctttctgtttgtttggagcaaaggatctgaaaggaaaccgatggaaataagttttgatgctggttacagccagattctaaatgagtctgaataaggagctgaagactttgttggttttttttttattatgtatgtatgtatgtatgtatgtatgtatttatttattttttgagacagggtctcactctgtcactcaggctagagtgcagtggcgcagtcatggcttactgtagcctcgacctcctgggctcaagcaatcctcccacctcagcctcccaaatagcctagactacaggtgtgcacggccatacctggctaatttttaaattttttgtagagacagggtcttgctacgttgcccaagctagtctcgaactcctggcctcaaatgaccctccggccttggcctcccaaagtgctgggattacaggcgtgagccaccgtgcctggttgggagccgaagagtttgaattttatttaacaggaaatagaaaagcttttattattattattaaagtaaatcagtgacatcaagtaaagcagtgacatactctagctgttcttcaaaacatgtaatatggcacagagtggaggaggctgtagcctaaaatataacatgggaggtggcaggaggtgggaagacagaaccctagaaagactctggttgggaaatataccaaagatgcaggagtaaaaagggctacaaatatctgaaaggtaatttaaattcttcctttagaacaatttcctagcctttctgtctgccagtggaaagtagcaggtattttatttttaagggggaaaaaaaagagacaagattattttctaaaggaattgaatgagctcactacggagatctagggatgcgaaagcagagctggcagccgcagagtaaagcctttgccatttgggtagagcccccagcttaatcattccctgcctgctcaccctcatgtgaagcctgccacttggcatgccccacctgtgtacatagagccatctaggaagaaaaccagtgggagtgtgcaactgcagagggaacccatacaacccactaagaaaaagcagcatgtaccttttgtcttcacagtgaatagctgtggagtataactccccacaccctaagtgtgggctgtgtacagtggccttcttccaaagagcacagtatgggagtggggataaagggagtggttttacaggggagaaacccgacaaacactacctcagataggtgatcaaggttagcatccacagtgatcattcatgttgatagcatctaccctgataggatgtgctgagaatggaaatttacctctgtggtcctcccgccaaaaacccataatcccagtctaatcatgacagagaacatcagaaaaatcccagttgagggacattccacaaaatacctaaccagtacttcttaacactgtcaaggtcatcaaaaacaaggaaaactgtcacagccaagaggagcctcaggagacatgacagcttaatgtgttaatgtattgtggtgtcctggatgggatcctggaacggaaaaagggacaataggcaaaactaaggaaatctgaataaaatatggactttaggtaataataatatataatgaactaatgaactaattgtaattagttcattggttgtaacacatgtaccatactaatgcaagatatttataacagagcaagcctgggtgtatatatatgggaactctctgtacaattttcacaacttttctgtaaatctaaaactattctaaaataagtttattaaaccctttaataaagaaaaaatgaattatttcttagtcacttgaagaaaatcagtggcatgaaagttaaatggaagaactgaccccaaaggatacagaggtgatgatgttgaaacaaaagactcaaaaatgtatactccaactagcaccctgagagtgaacttaagatactgcatccacaaaacaagagtaggaagctcttagaagggaattatctaggatcaaaaacagttcttagaaactaaataaataactactaaaatttaaaaattctgtaggaaaggttagaatataatgtcaaagaaatctcttagtgtgtaaattacaaagacaaagacagagcatatgaaagaaaaaataaacatagaggaccaatccaggtggtcagtcaactaataggactttgagacaagaaatgtaatcttagcaaatgacttagccctgtagggaacagtgtttacatagtcataataataaaatacaactgattgactttcaactttcagtatgtatctatagataaaatatagaatattagttaccgaatggaatgaaatattatgaaccatggcaaaatgaaataaaagtacatctgatgcaatatggaaggttggaaataggtgagatggaagagagagtaggacaatagtgtgtattaatatatcacgtagcaaggaattgaaaaatactttttaatgtttatggaataagaaaccacttaaagtatattattttaaaacacaaatagggccgggcatggtggctcacacctgtaatcccagcacattgggaggctgaggcaggcagatcacatgaggtcaggagtttgagaccagcctggccaacatggtgaaactctgtctctactaaaaatacaaaaattagctgggtggggtggtgtgtgcctgtagtcccagctacttgagaggttgaggtgggagaattgcttgaacctgggaggcagaggtcgcagtgagccgagatcgcaccactgcactccagcctgggcgacagagtgagactgtcttaaaaaaaaaaaaagaaaaaaaggtcgggcgcggttgctcacgcctgtaatcctagcactttgggaggccgaggtgggcagattgcctgagctcaggagtttgaggccagcctgggcaacacggtgaaaccctgtctctactaaaatacaaaaaattagccgggcgtggcagcgtgcgcctgtaatcccagctactcaggaggctgagacagaagaatcatttaaacccaggaggcagaggttgcagtgagccaagatcatgccactgcactccagcctgggcgacagagtgagactccgtctcaaaaaaaaaaaaaaaaaaaaaaaagacaccaaaaccataaataaaaggctaatagaagaaccaaaactaaaagaaaatttgaagaaggggttatttagggacataagtcataagtgaccccaaatactcattttatgtagtaagacatgaatagagaatgactacggttggcaagtgagaaatagagctataagcatattttatagagctatgagataactctcctaagaattaaatggctgaagagaagttacctctagggaggaaaggtggaatggggaattgttgatttctttataagttccctactattttattctagtttttgctatgtttatctattactttaattttttggaaaaatgttttgatgagctattaataagtatccaagggagaaataatgaggatggttggaatggcaaagagagaacagatgggagaccctgcaaaatgaaataagcactttataattgactaaatgtgggggcaaaagagagagtgaaaggacacatcctaggtcttgagcttaagtacatagaagagtgaatagggaaagtagttggggggtgggttggaagggaagataaatgattgtcacaggatggttgtaatcggcaataagttgacaatattcaggtttaaaggatataaaattaatattcataaaagatatggtatcttttcccatttgaaggctatttcacaaacaggaaacaatgcagcctgctcctggatataacataggcttttcaactcccccaagatccccctttggagatgcatagttgctgctgacagcactcatgcagagggtggagtcctccaagcacaagaagctcacctctgcactcgtataggggtttatatcacctccacagtatcatccacctgttctggaatctctggctatctgcctgtctgctcagtgggtgcaaataattgatgcagagtcacccccaatacattatggatagtctactgtgagactgtgtgaaaggaaggtcagcttcccagatagaatgcctattgatgggcccaggcttcagtcctgcctgaggtcaggttctgcagaaggtgagaagttagattgtggacatatttaatctgatgctacatcagattgtcctagtggaaatgtctggcatgcagttaggaattgaggactgcagctcaggaaggagaggaaggtgtggggcggtggacaggctggggggtagatttgaatttgatgagcttataggagctgaagtgtagaggttgctaggggataaagtgtcagggatagattattgggtaacacctacacttagaaatgaggagagaggccaggcatggtggctcatacctgtaatcccaacagtttgggaggctgacgtgggtggatcacttgagcccagggtttcaagaccagtctgagcaacaaggcaaaaccccatctctacaaaaaaaacagaaaaattagccaggcatgatggcacattcctatagccccagctacttgggaggctgagatgggaggattgcttgagcttgggaggctgaggctgcagtgagctgtgttcatgccactgcattccaacttgaggcaacagagcaagatccagtctcaaaaagagaaaagaaaagaaatggagagagaaagaggagacataaaatggggagaagaatcagaaaagagtaagtcacataagcccaggggggagagtatcaagaagaaggtggtcaatagtgtcagatcctgcatcaggggcaagaagactgtgtgaggccattcttgcattgctgtaaagaaatatctgagactgggtaatttataagaaaagaggcttgattggctcttggctctgcaggctgtataggaagcatggcactagcatccacttctggggaggcctcaggaagcttacaattgtggtggaaggtgaagggagaacagacacatcacatcacagaaacaggagcaagagagagagttggtgatggtgggggtgggagggagtaccacatacttttaaatgaccaggtcttatgagaactcactatcaagagggcagcaccaagggagtggtgctataccattcatgagaaacgaccccatgattcaatcacctcccaccaggccccacctccaacactggggattacaattcaacgtgagatctgcctaagacatacattcaaactatatcaaggaccaagatggagaagagacacctggatatggctacaagttctttgatggatgtctagagacacagaacaagctggagcgaaggttaggaaaagggagaaggagttgcccaacggaggtctagagaagcttgattggatgaactctatcctctccatccagtctgagatagaatcatctgcaggcagtaaagcagacatggccgaccttgggaagattgggaagctctggaataagcattagagagattgagaaattatactgcccggccgggcgcggtggctcacgcctgtaatcccagcactttgggaggccgaggtgggcggatcacgaggtcaggagatcgagaccatcttggctaacacggtgaaaccctgtatctactaaaaatacaaaaaattagccgggcgcggtggcgggcgcctgtaatcccagctactcgggaggctgaggcaggagaatggcatgaacccaggaggcggagcttgcagtgagccgagacagtgccactgcagaccagcctgggcgaaagagcgagactctgtctcttaaaaaaaaaaaaaaaaagagagaaaagagaaattatactgccttccttctattatgctttatttgtttatgagtttaccttttgtaatagcatctattgctctagtttgggagtaggactaacttgtcctgggagtaggaccccacaggggtccctttcgtagtgcagtcacttctgagatactagctatttgtagtaagttagaccatttgccaatacccctgagtctgctcaaaactcttcaccggccattagcacacacccggccccatcccctgtgatttactgacatctttgttagctgggccgggaattccctttgcatttgtagttattttgtctgttatatccaacccatctgttttttgtttgtttgtttgtttttgtttgagacggagtttcgctcttgtcacccaggctggagtgcagtggcgcgatcccggctcactgcaacctccgcccgccgggttcaagcgattctcttgcctcagcctcctgagtagctgggattacaggctaccaccaccacacccagctaatttttatatttttggtagagatggggtttcaccatgttggccaggctggtctcaaactcctaacctcaagtgatccccctgcctcagcctcccaaagtgctgggattacaggcgtgagccaccgcgcccggcctcaacccatctgttttaactactatttaggcgataaactttccctaataaagtgaaatttgttctgtccatcttgcatctcctttttcatcctattggttgtcccactgatgttttcccttcggcatgttttgaggacctcttttctccatgtagtgttgctgcggttactattgtatttggctgtttaagtaacagaaaacccaacaagtgaattaaacaaataggatttgatctttctcatgtaataataaaaaatctgcaggtagatagttataagagctggcccaacaactcaatcatgtcagggccaataatgccaacaaatcaggccaagccaattctcttggccttttccttatggtagtaaaatggctgctgcagattcaaccatcacatccacattcaaagcagacaaaaggggaagggacagggccaagagattttcacttaagtgttagtggccataacattaagtttttatagcctctagagtaaagacggcaattaaagccgggcgtggtggtgggcgcctgtagtcccatctactcgggaggctgaggcaggagaatggcgtgaacccgggaggcagagcttgcagtgagctgagattgcgccactgcactccagcctgggcgacagagcgagactctgtctcaaaaaaaacaaaaggaaaggcaattgagaaagtgtttgttattggatgttgggtgagtcagcttaatgtctgacttttatcatcccattttaacaagacttaaaaaactttaaaattgagtctccctattattttcttcactatacattttttttttttttttgagacagtctcactctgtcacccagactggagggcagtggtgcgatctccgctcactgtaacctccacctcccaagttcaagggattctcctgcctcagccttccaagtagctgggattacaggcatgtgccaccacacccggctaattttttgtatttttagtagagatggggtttcaccatgttggccaggctggtctcgatcttctgacatcaagtcgtccgcccacctcagcctcccaaagtgctgggttataggtgtgagccaccgtgccaggcttcttcactctacatttaccttgagacatcagtaaggtattttaaaaagccattccaggctgcctacaggcaaatagctaaaactctttatttttaatcaaccaatgcctatattttatactaattataatttctgaatttgaaaaatttttaaatagatttatttgcttttttctctcttgccagaatattttttccctcattttgagtattccacagttgcttcttttctttttttttttttttgtgaggctgagagccagtgaaaattttgttgaaggacatatatgtatgtgtcttttccagctttaagcgatcacagtaataggccttgttaagattactggtcctgacattgagttgctaaaccaactcttataactacctacctgcaactttctgctaacttctaataatggcatccgttatgatgcggataatcagtattctctaaatgtttattggtttgaaattgttataatccccttatgaaagattagccctcctaaggaagctctgtccaggattgctttggcttgttctcatcacctaatgatcttagggagagggagaggaggaagtctacccaggtggtgctgctggtgatagtgggctttattaagaagagaccccgtgatgggattgtttccagagtccattacagggtcctagcaaaacatataaggtattatgtatactggctttggagacagaggatttgagtttaaatcctagatctgcctcttatgaattagcgaaggaatttgtctgtgcctactgagctttaacggtacgctaggcactcctctggatattttcatgtattaattcattgaattgtcacaacactcacatgagggtagggactatcatgattcccaatttacaggtaatagaactgaagtgagatgcagtggagttccttgcctaaatttacttaactaataaacaatggtacaggttgaacatccttaatcaaaaaattcaaaatctgaaatgctctaaaatcagaaacattttgagcgccaccatgacactacagatttaacatgggttaaaaactgagatagcgacacctttgctttctgatggttcagaaactttgtttcatgcacaaaattattaaaaatattgcatgagattaccccaggttatctgtataaggtgtatatgaaacataaatgaatttgcgtttagactcgggtcccatccttgagatatctcattacgtatatgcacatattccaaaatctggaaaaattggaaatctgaaacacttctggtcccaggcattttggataagggatactcagtctgaaccaagcatttggacccaggcaatcttaactctaaagccaggactcctagagctggcagccctaggaaattacactcccatctgtaattccagcactttgggaggccaaggcagatggcttgagagtcagtgatcatgtatccacatggagattgcaccactgcagtgactcctgagaggcagtggtcatgtatccacatggagatcgcaccactgcactccagatcttgtcctgaaccagctaagaaatcaagcttttattctttaataaatatggatgatcttaccgaaaggtcaagtaactctgctatactgtcttctagaaaccaggatttgaggggatggagtagagaaggaagaataagagagtatatgtgaaaagcattttgcccgtggcagagcgccacatatatgtcagcagagggtgttattataataattattattattattattttgagacagggtctcactgtgtctcccagtctggggtacagtggtgcaatcttggctcactgtgacctagacctcccgggttcaagctctcctcccacctcagcctcccaagtagctgggactattggcatgcaccaccacacctggctaatttttgttgttgttgttgttgttttgtagcaacaggggtcccactctgttgcccaggctggtctcaaattcctgggctcaggccacctacctcagcctcccaaagtgctggtattacagatgggagccacgatgcctggccagttattatttttatgatcctccatgcttgttaaaaatgaaagattgacttcttagctgtttgggggcaaacctctccttctgtggccatgtgacccagtgtcaattcctagggctgctgtaacaaaataccatgagctggatggtttagaacaacagaaatatattgttttatggttctggaggcctgaagcccgaaatcaaggtgtgaatagggccatgcgccctctgaaagtactagaaatggatccattctaagcatctttcctcgcttctggtggcagtctttggcattccttgagttttgctacatcaccccagtctctcccttcgccttcacatgatgttctctctgtgtgcatgtctgtgttcaaatttacccctttggtaaggaccctagttgtgttggattagggggtccaccctactccagtaagacctcatcttaattaattgcatctgcagtgacccccatttccaaataacatcatactccaaggtattgggggtcaggacttcagcatatgaatttttgggggacacagttcaacgttgaccctaacacccggtgtctccttctggtctcagtggcaccactgcaagtggaggtgagaacgagcgtgaggacctggagcaggagtggaagcccccggatgaggagttgatcaagaaactggtggatcagatcgaattctacttttctgatgaaaacctggagaaggacgcctttttgctaaaacacgtgaggaggaacaagctgggatatgtgagcgttaagctactcacatccttcaaaaaggtgaggcttggttctcagaagctgcttcaaggatttcaagtttgttttgggttgtggttttaaacattttttttaactcccttgaaacctgatgacgaacaatttttaaaattaagtctgtgcctgaaaaagagaaaaatggctaggagaagggatttagtattgttaggaatatactcccacactattaaaagggtcctgggcattgggacaaatctcagctggcagcagttatgaaacaatgttacttgttcttagtaaagttcaggcacttttgccaggcaagtgggtggccaggaggatgtgataccaggacagacggactcgaaggccttgagagatacctgccaggcctaaaattatatgaaattcaagcttttcatttgtcaagttgaataagcaaagggagagaatgagcacccagaactctcagaaatgagccttctctaagacacacatgctctgcctgtgtgacgccatcatccttatctatacaatagggagatgagatttgtaattattgctgccatctgggcagcagactgcttgtccctgccatatatagatccagtgtttgggctgtgtactgtctacttctcagagagttgacagactagttggagtaagaactctgtgtctcccttaggggaagtgcatttactagaatggaaaagcactacgcggcctgttgcataacgggatgcgtaacaagtgggtcccggccaagttgtctgtgtactttgtcagagtgcactggaggagagcttttctccttggacctcttccctgcctcacccactggtgtactctgcctggccctgtcgctctttttcctttattcattcatcaaatatgctcattgtctctgctgagtgctgtgctaggcgcaggatgtacagagtgaagatcgtactccccctgtccttgacaagctcacagtccaataaaggagagagatctgaaagattacaatgtgaccacatatagtaggacaaaagagagaacacagtattattgggaactagttgatcagagcaactaaccctgcctggagaactgagaagtcttcccagagaaggtgacattgaaataggattttggaggatgagtaggagttttctaggtacaggggaatggaagggatattttaatggtcagagaacagtgagcaaaccttcatatgaaaagtgtttgtgggggatcccaaaatgaagcagccagtggaatcatccagcacgtctctttattcctccccagggaccccaagagtcagcctgttttgctttcctctttaagctgccacttatggtcctatttaggaatgttcttctctgttgaaacctggctgcagagtacagacagactccctaacacctccaaaatcagagcaaagatccttttcattctgaaggatttcctattaatcacaaaaggggaacatacatgacaaaggtaaaaagcacagggaaaccttagagttcttctagcaattgcacaaggatgaacgctccctggtcccttttctcaggtgctacctggaccttccttatgaatggtcatggacccaggcttaggatgctcagactgtaaccgagatttcccagtggaccttgcttctggctcaggagggatattcagtcctagccagagcctgcttctcttgcagtgagatgtggtcccccacagacttctgtagccctctgagtaaggcagtgctgtgctttcccaggtgctcctagctcaagcttcaggcttaggaaattgtctctttttatctcccaagtgctccctccctagctgttttcggagaaggcttcaccatgtttcaccccacagtgagccactgcctggctttcccacagcctcacacgcacccgcagtcatcagcttcaccctttctggattcctcatggactctgtccacctgaaatccgaccctttgcctgggcctgcttctctgtgcccttggacccgtgttcttctagtagcctaagtctgagccatttctcccagagaccacaggctacagtggacagtgctctctctctaggagcctgtgtatagtaatgggtctgccaaggtttccccatcttgcccagtgagtgagcctttccttcttgagtttcatgaagttcctgttttatgctcagaggcacctggagttcccagttcttttgcagagcagcttgttggcctgttctcagaggactcagggggatctcgccattacgggctcaggttacccaccccacccaccttcactatttgtttgggatgactcattccccctggcattcccttcaccggaagtgggcctctagaaaattactgttttacagtataaatatagcttccatatactgcaacattgatacaatttccaccaacaaaggaggagggagggattatttcaccattcttagtgaggcccaagttggatttaatttcaagttgaagtagtccatgtcattctcaggagatattgcagtgaaatgcgaaagatcttttggaaacttctctgtatcaaatgcagaaatgcagaaatactgctttagagaagcatttgaatgttaaaatctccaaatcctatcaaaataatagcatgtaatattggaagtaatgatagcacatgattacttagtactcactgtgagctagacactattctgttttatgtgtaaatgagtttgtatgtgtctgtacatacatatgtacatgtatatattgattcgtttaatcctcaggacagctctttgagatggcactattaacatctccattttccagggcaagtcgaggcactaagaggttgaataactttccaagtcttacttcaagctagaggtgggcctttgatttgtgtatacagcagccttgttccagagcctgcaaatttaacctctaaacttgcacagaatggaatatttccattttcatggacagttctgttggacaacactgctgtggtgcccttgtttgaaatggtagaacttgttttcattcacttattcattcactagatttttgagtgtttacacataccacgtatgattctagacactagaatacagggattctagtgttacagggataaggaagtgagggagggagcttatagcatacacaaggatggacaaggacattagatactatttcagatttgctttatgttctgcaggtgaaacatcttacacgggactggagaaccacagcacatgctttgaagtattcagtggtccttgagttgaatgaggaccaccggaaggtgaggaggaccacccccgtcccactgttccccaacgagaacctccccagcaagatgctcctggtctatgatctctacttgtctcctaagctgtgggctctggccaccccccagaagaatggaagggtgcaagagaaggtgatggaacacctgctcaagctttttgggacttttggagtcatctcatcagtgcggatcctcaaacctgggagagagctgccccctgacatccggaggatcagcagccgctacagccaagtggggacccaggagtgcgccatcgtggagttcgaggaggtggaagcagccatcaaagcccatgagttcatgatcacagaatctcagggcaaagagaacatgaaagctgtcctgattggtatgaagccacccaaaaagaaacctgccaaagacaaaaatcatgacgaggagcccactgcgagcatccacctgaacaagtccctgaacaagagagtcgaggagcttcagtacatgggtgatgagtcttctgccaacagctcctctgaccccgagagcaaccccacatcccctatggcgggccgacggcacgcggccaccaacaagctcagcccgtctggccaccagaatctctttctgagtccaaatgcctccccgtgcacaagtccttggagcagccccttggcccaacgcaaaggcgtttccagaaagtccccactggcggaggaaggtagactgaactgcagcaccagccctgagatcttccgcaagtgtatggattattcctctgacagcagcgtcactccctctggcagcccctgggtccggaggcgtcgccaagccgagatggggacccaggagaaaagccccggtacgagtcccctgctctcccggaagatgcagactgcagatgggctacccgtaggggtgctgaggttgcccaggggtcctgacaacaccagaggatttcatggccatgagaggagcagggcctgtgtataaataccttctatttttaatacaagctccactgaaaaccaccttcgttttcaaggttctgacaaacacctggcatgacagaatggaattcgttcccctttgagagattttttattcatgtagacctcttaatttatctatctgtaatatacataaatcggtacgccatggtttgaagaccaccttctagttcaggactcctgttcttcccagcatggccactattttgatgatggctgatgtgtgtgagtgtgatggccctgaagggctgtaggacggaggttccctgggggaagtctgttctttggtatggaatttttctctcttctttggtatggaatttttcccttcagtgactgagctgtcctcgataggccatgcaagggcttcctgagagttcaggaaagttctcttgtgcaacagcaagtagctaagcctatagcatggtgtcttgtaggaccaaatcgatgttacctgtcaagtaaataaataataaaacacccaactgggagtgctg

SEQ ID NO: 38417 - DNA, 40308 bp, Homo sapiens
gacgataaggcctggcgttattgcttagaggcggctacctggagccggaagcgcggctgcagcagggcgaggctccaggtggggtcggttccgcatccagcctagcgtgtccacgatgcggctgggctccgggactttcgctacctgttgcgtagcgatcgaggtgctagggatcgcggtcttccttcggggattcttcccggctcccgttcgttcctctgccagagcggaacacggagcggagcccccagcgcccgaaccctcggctggtacggacccctccccggcgtctccgctcccctgaccccacatcccctagaagaccttttttctgagcctcgctgctcggatttcttctcggcgctccccggtggtctcttccattatggtccccacctcagaaattttttttaaccgctccagcgtctcttttctgtattcttacaactttgtggcaaccacctctactggccccacttcgaccttccttcctgatcaccacaaagtaagctgtgtccatacctgggatccagcctctccacttctactcgtccagagctcccgcccctttcctgagcagcctttgggtcactccccgttataggcgccctttttgccccctagcacacaacagataagacccctgccgatcccctcgcgttttggtctcttatattcctccaagatgttttccctgcctaggggctaaggcctctctgcgttaggcctcttcctaggcttcacctacccagccatatacagcaagtaaaggcgccctggttctggaccacttgcacacatcgccagccgctgaccatgtaaacgcagtatgtaaacgcccagccatcccgtagctgcagctctgcgttttaggtcaagctccctaaatgtcccattccaggacccttacgtagggattctcctaccccagtactcttcaccatactgaggataattcactgcttgctactgtgggtccctaagattactcctgttaacccccgtcctttccccccagcactacctaccaagtacaagtcgcctccttttgggttgggttatgtagatatcgcagggtatgtgctggagaagtaggtagaagctagattgtgaaggtgcttgatgctaaggaaagtttagagttcaatttccttttttttctttcaaacacttaggagccagttctaactggaccacgctgccaccacctctcttcagtaaagttgttattgttctgatagatgccttgagagatgattttgtgtttgggtcaaagggtgtgaaatttatgccctacacaacttaccttgtggaaaaaggagcatctcacagttttgtggctgaagcaaagccacctacagttactatgcctcgaatcaaggtaagtttgccttaatgttttatgaatcatggtttggctgttttgaagatttagagggggtctctgtagtctttcgcttggagttgcaattttaagaaagtggaaattttgtgctgtcagttggctggggcaatagaatgttgaaggagcctcacacgggatggaactgagacccatcatttgtgccccatgtcaagtagccaaagctcatgcttcatggcaaatataaaagatttagagcaagatcatccaggctaacctaccccaagatatgccattcttggtgacctgctttcttctttaatcgtcactgggtcatttacaatcttagaaggagcctttagagttaatctagttcagtctctagactttatagataggaaagcaaactcagataagttaaatgtgacttctccaaaattatccaccagtatacataatgatcaaatcagtatgttccggcctcaacaattaccactgtttccaccatatccttcaggtgtccagcctactgacagcagctttgaagtacatagtgcatttcccaagaaccgtgggtaaagaaaaaagtaagcctttattgattggctcaaaacttttgagcaacgactatgtggtgatacttcaatgggtatgcaattggggaaaaaatagtatctctgccttcatgtagcttttagtctttagatatacagccactcaacaaaggagcatatgaaaacatgcagttgtaaagtgtggttaatgcatgatgagaaagaacaggatgtgatgattagtgggtgagaaagcctggctgaggaaattgcatttaaactgagactggaaggatgaataaaggtggggacagaaaggagcagaggggttgaagtgtgtgagtgtatcgcatgtgagcgtggcataaagtctctgacggagccttagctgtgttgttgatcatgtgaaacattatttggtgagaaggagctacttattgatttaaggcttgggggcagccccatttgcagatgcttggcagatgttcactggatgaaagcagtctgagactgaaggaagcacagtgccatatcactcactgactttttccttgaatttcttactctctctgccgcatttcaatgtgatgtgacttccttcagcaatatttattgagcatctactgtgtgccacactgttccagacaggagggaggcagtgaagaacaagacagcattgtcctcatggagcttactttctaattggagggatagaaaatcggtaaaatatgaatcaatgaagatggtttcagacagtgacaactgctctggaaggaatggagagggaggtgagagagaatgaaggggagaggggcatgcccggcacctttgaacacagcactcagagtttttgccgtcctgctgaaactagctgtgggaatctggaagaaagacatccagcccctgattttcaggaacaccggtttctttatctgctctatcagaagtgtggaaggaacccttttctccttttcttttaagatttaacaggcagatttgagaaaatgtataagtgattgtgcaggttctaggttctattcagaccagtccgttggcactgtggttcttggggcctctgtctccagcttattggttttatttcacctttgctggggagcctcaccccagagctagtgttttgtttcattttcagtcctttgaggattcttgctccttatttccccatcagggaggagctagaacagaaagcccatactggagttaggattgtacagctctggagtttggtaggttggggttgggcagtgttggttgaggaaagtgtcccctgccctgcctccagtctgagaaagggctcagagcatctcctggtgttgatacatttgtaaccagacgccaaccctgacatgtccagtgtgctttcacttgctaagaccctgcagcagctttgttttaaagtcatgtaactcatttttgaatgccttttctttcttaaagaactttctggtcataataatagctggcattgattgacagacctgagctttcccttagatttcttaggactgtaaatgcagcccactcgctgtctgcacgctttctgggatgaggggatgccaagtagtccctaccctctttaaaaatatcggtgggaacccaagctagtgtgaggatgagggaggtgccttgtaaaagccacaaaagaagggatgaaaacagaaaacttttatattgtcaaatgttgtaaacaaagtcaacaacatgataaactgaagaaattattgacagtggacatggcatacaagatgttaagtccatgatgtataaagaggttcggatcaaggagggacagtcctatggaaactgggccgagtatataacggaatccaccaaggaagaaagcggaatggccaataagcatatgcagagattcttgactagtaatcagagcagggcaaacaaaacaacccatatgccagtttttgtttatcatattgtaaaaatttaaagattgatgatctctaccccgcacaagaaacgaggtgaacaggtgctcttgaaatactgtggatgtgaatacaggttgactgagctggtatctccactgccaccaccgtcgtccaggctgctgtgggctccagcctgaactgttataaatgccctagcaccttttcttggcccaaatcacttctggacacaaatcagaccctgctacactactctttaaaacccttcagtagtttacgctctgcccagtttgaacactgaaccccatcacccgtccctcaaggctctgcgtggcctcactcccgtttacctcttcatcctcatataggcccccttccgtgttcccttgcccttcatccacacaggtcacacgcagctcatttcctcccgggtgctgctgtcttttctgcctggagcctttgcagtttgcaggtgttttactctggaaagtcccacctcacctccacaacttttcaaccttcaggtctcagctcaagtggcacttccataggaagctgtttaaaataaatgcccagtaaaatggtcttggttaaatacgttattgtacagctacacactggaatgctctgtagctgtttggaaaaaagataaaatgcttgtgttttccctaggtaaagatgttcatgatgtgttattaattgaagaagtttgagagtaatttgtatagtttgctaccattttggtaaaaaatgtgtaccttcatatatttgtgattttatacacacacacacacacacacacacacacacacacacacacagaaaagagtccaaaaggatactcaccaagagtaattggctgccttttaaggagtacaattttggggtgaggttcacattttaaaaaataactattgaaatataatttttatacaattacatttttgcatgtacagcatttaacaaatgtgtgtatccaggcaaaccccacctcagctcaattctggccccaccctaggaatgttggtggctgttagggttattttggttgtttgtatagtgagttcctgcagtctgtctccccgggagcgtgcggcaactgatgttttgacttaggtcttttggttcttttggtttttaagttcttgtttttatctttaagcctgtcttcctgagtgctggccctggctccgcatagcttagtggtcagccactgattggtcagaggttgtgcttcagcacccctgatgtgttttcataacctccctgggtgtggggcttctcagtggctgctgcagcgtggagctggaaaggagggaagtgggagccgccctgtgtagaaacaccatgggcacttgctgttcttactgagattccgtgttttttcttaaataagcacttctcaatctgttctataattttggtgaatttccaaagtactaaaatggttgcttttgacagtttcatccagttttattattgctcctgggagagagattttgccgagctcctccctgtggcattccagaagtctggataattcatacttgcatttatttatcgttaaagatgtctcggtaaaattatttcacctgctgatgttacccaggttcccgtttattttcattgcacaggttccaggatgccagtgctggctggggtggctgtataactctaaatcacagagatctgttacccattaccatggcctcttaggttctatgctaaactcagggaaattcttgactcaattctattatcagaagggtataagggcaagtcacctcccacccctcccagaaaatatggggcaacattgagggtgggagcagaagagactatcccagtggcctccctggcccccagttcactttgcaaattgctgaaagttcacgctttaggactgctttcatcctggttttccactcaaaggtagacattggaattgctggattgttaggagtcgtatggactttgcttgtcacgtggagatttgaatcttaattgggacctggcagaggctttgaatacacaggttaatgtttctaatgtatacctcactttgccgtttgcttcagctacatcgcaaacccatagctgcttctctggctgttgccgtcgtctcgctatccctagccgcctcctttaacctcttgtcagctggaaagattattaggagccatgaatgtcctttaatatggttatctttgttactattgagtttacagtttttcaccagaatctatgtgcctctttctcttctttaccctaattactgtcctaacattgacccagccaccagtactagggatgccctagctttatgctcacctattttatccataaaaaatcttcagaccagcctgggcaacatagcgggaccctgtatctaccaaaaaaaaaaaaaaaaaaaaaaaaaaagctgggtgtggtgccacacacctgtagttccagctacttgggaggccaaggtgggaggatcgcttgggcccaggagttcaaagctgcagtgatccctgattgcatgactgcactccatcctgagcaacagagagggaccctgtctcaaaaaaaaaaaaaaaaatcttcagtgcccttttcatgctccggttttggattcagtggcctaattcttgcattttctgactgcaggcattgatgacggggagccttcctggctttgtcgacgtcatcaggaacctcaattctcctgcactgctggaagacagtgtgataagacaagcaaaagcagctggaaaaagaatagtcttttatggagatgaaacctgggttaaattattcccaaagcattttgtggaatatgatggaacaacctcatttttcgtgtcagattacacagaggtcagtttttaaaataagaaaatatatcatactagaatatcatactagatagagcctggcatcccattacttagtgagagatgataccattttatatttggttttattaatttatagggagtactatggacaggtgtaaaaattattcactcacataatcagttaacaacccagaaatacaaacctgaagcaggtgtgagcagagttttatggaacccaaagcttagaacagctgagtgccattgaggggcagagaggatcaggaagggtgacacagccaagggactgtctgagccgagatatgatgggtgagtggggactccccaggtgggcagaacaggctggtagcttctgcacatggcagagctgtaggactccacagcctgttggttctgctgcaagcggagcctcatcgtgccctgagggcaggtggccgactgggtggggcctggtcctgagggggttttcctggagcttttccaacaaaaattagacctgcatgttagaaagcagacctggggctgaggtaggagcacaccagcacacctgcctggcctggggtttagccagcttcacctcctagatggctgggccttatggagcatctgtagtcctatcctgttccaaagtggggcgcttttcaacagttacttttcagtaatgactgagttttcctgactatatatggcatcactgagaaacacttctcttcataggagatttttttagtgggagggagatgagctagctgaggggtcagggctcaccaggctgacagctctattgggggctgatcaactgctcatctctcctccgtgatgtgtttatttcagaaatcaatgtgatcattgagtgctgtgtctttttcagaacagccttcttgtaggacacatgtagatgccctcagcttcatcatcctgctggttactttaacgctgggtactgtcctgtctttaattaactgccctttgcccttagttacctcatgacaacttgggatctatttaacttgcccatttgctcaccttcagttatgcccattaagcccagcagtgatcccacagaaaaatatttttgtcagaagaacccttgctcatttaaattatctgtagaatatattcgatccatagcccagaaacataaaaacaatattagcaaaagtttaatccaatgctaatgttcatttatttattatagacgtggggtcttgctatgttgcccaggtgggtcctgaactcttggcctcaagcagtcttcccgcttcagcctcctcaagtgttgagatgaaaggcatgagctgctgtgtccagcctatttatttatttttaatgacatagattttgttgtgtttcaactcccccaaatcctgtaacctgaataaacccctagattttaagatgactgttgcgttttccccggggagtgaagatccagggaaattaggtgagttgtttatacgtgtgtttccccttcaaaggtggataataatgtcacgaggcatttggataaagtattaaaaagaggagattgggacatattaatcctccactacctggggctggaccacattggccacatttcagggcccaacagccccctgattgggcagaagctgagcgagatggacagcgtgctgatgaagatccacacctcactgcagtcgaaggtgaggctcgccgtcgctcactgtctgctgatgtggtttcacgtggatgttccctagaataaatgcaaccgcctgagttattcagggtgcctgtgtgaatgtccaccatcagtctgctagccaggggccgcatgccacacgggcagcactgtctcagtgtccactgcactgactccgtcttccagcagccctgcagaacagcagctctcactcctacccgtgtatgcattcattcaactaatacctcctgaagaccttttgtgccactctctctgttctgtatcactctctctgttctgtgccactctgttctgtgtcactttctgttctgtgtcactctctgttctgtgtcactctctcttctgtgtcactctctgttctgtgtcactctctctgctctgtgccactgtctctgttctgtgtcactctgtctgttctgtgtctctgtttctgttctatgtcactttttgtccatgcatttgggtgcatcagtgaaacagtcgataatccctcgtgaagctcacgctctagccaggagagatgagaaagatgagtaaataagtatgtgaggaggtgatgggtgctgcagaaactcagagggcaggaggaggggctttcaacagcgtgttgagagaagccttccctgaagacgtgtgcagggtgagcagagacttgaagggagggaggggcagaccatgtggtctgtgcacgagtgttccaggaggaccagcagcgagggtcaggcacagcctgcctggcttgtcccggagcagcaaaggatgtgtggctgcaaccccaggggcagagaagcctggtgggtgcccccacatggctcagagctcttgccttttgctgtgtgttgtgttctcaccagagtcctgtgaaagattccatttgacagatgaggcgaccaaggcacagagtagaatgcgtccagagtctcacagcttggcagtggcaaagacagaaaccagatacaaaccgtctgccatcagagggcagaaatgcagcctgctgtgctccatgagctgtgtacaattctgtgaacttcatttatggcattatttgactgtgaccctgtgatctggctatgagctcataggaaaaaaaaatctaattcattgagaaagagctacaactctataaagtaaagctaaaaccgaaaattgtcttcttaagatgatgtgctctcttcagtctgaacgcagttgaaatgtttttcctttgccttaaaggagagagagacgcctttacccaatttgctggttctttgtggtgaccatggcatgtctgaaacaggaagtcacggggcctcctccaccgaggaggtgaatacacctctgattttaatcagttctgcgtttgaaaggaaacccggtgagaatttaggaatgttaacagttggaaattgtattacatttgttttctatagtctggttttaattttgaaaacctattttttagaagctccataaggttgaagtccccaagcaatgtgagcatgaaaagtaattgggcaaaaggcttttgggatctgaagttacgttccttcccgaatccttaaaatacagttattctttgtcagaattttgttgtatgaatgttgctgcctggatatctggaactgttgagaaaaattgccagtagctcagagacatctggacagcatgtgtgaactgaaggaaacgtgaatacctcggcttttttaaaagtttgcattattgtaaaccatctattgaatagcagtgtcaacaagagtcatgggacccggccagagcaggacagacagaggccccgtctgtcagtattcagacacgccccaaacacacacacaccccactctgacctgtgcccagactcagccgccagcctatgcactctgccctcgcggccgccggccttgctgtcctgtcggcggctgccttccacttgcgcctggcttctgctgccacactcgctgcctcactcttggtgagctcagcggtaatttctgccgtcaggcacagcagacgctttcgggcgctgctctcactgacccttcagcacccttagtgctgctggtcccgtagcttctgggacctcacatctttctggttttcctccttttctctcctttgccagcctagtttcctttccctggtcttttttactggactgccttcttgtttcgttctgcattagccctggagatacggtctcatctgcctctgtggttgtaaatgccgtggataggccccacaccggtcagattgatctctctaagtgtccccattcatcattcttggcataatttgtcattgcagacttattgatggattttgtttatttatgggattcatgtaacatctgcctccacattacactttaagccagatgaggacaggaccatgtctcttttgcccaccatgatctccacctgacctcttatatctttttatgaagcttcttggccgagaccagctcggtccgggagactttgacccagcagcgctagaggaattaaagacacacacacagaaatacagaggtgtgaagtgggaaatcaggggtctcacagccttcagagctgacagccctgaagagagatttagccacgtatttattaacggcaaaccagtcattagcattggttctactgattctaaattaactaaaagtatcccttatgggaaacgaagggatgggctgaattaaaggaatagatggggctagttaaccgcagcaggagcatgtccttaaggcacggttctctcatgctattgtttgtggcttaagaatgcctttaagcggttttccaccctgggcgggccaggtgttccttaccctcattcccgtaaacccacagccttccagcgtgggcgtcatggccatcatgaacatgtcacagtgctgcagagattttgtttatggccagttttagggccagtttatggccagattttgggaggcttgttcccaacacttcttcatcttgaatgtctgacctgagcagagctaggaatggtgggggcagctgcatgcgtgcaggctgcctgcaagtgccggactcatcaccagcttcagtcctgagagttggttctgttttgttttctttattctcatcatacctgtttcgtgagccaggactgtactctggtgtactcacagcattgggccaccatcatcacagtcaattttacatcattttcctcacctcagaaagaaaccccatactcttctgcagccaccttcctcttccccagcccagtcttctctccctcccccaaccctaggtaatcagcgtcattgtctgtagatttgcctcttctgcatgttttgtgtaaatgaaaccatatggtctcgtgtgcctggcttctttcatgtaggatagtgtttttccaggttcatagttatagcatgtatcaagacttcatttctaggccaggcactgtggctctcacctgtaatcccagcactttgggagactgaggtgggtggatcacctgagatcgggagttcgagaccagcctgaccaacatggagaaaccccgtctctactaaaaatacaaaattggctgggtgtggtggcgcatgcctgtaaccccagctacttgggaggctgaggcaggagaatcacttgagcccaggaggcggaggttgcagtgagccgagatcgtgccattgcactccagcctgggcaacaggagtgaaactccccatctttaaaaaaaaaaaaaaaaaaaaagaagacttcatttcttttgttattaaatagtcttccattgcatggatttaacacattcattgaccattcttgagctgatggacatttgggttgtttccactttctggctgtgatgaataatgacgctgtgatcatctgtgtgtagctttttgtgtggatgtatatttcctatgttgtcattttcttacccagtatagctgtgcccccacccgccacctctgtgctgttattgtcaaatatgttgcttttctgtatgttataaactgatggcatagtgatatagacatggttttatataattgcttttaaatcaggagaggaaagaagaaaatgcttttatagtgtctttcataattatatgattacctttactgatgctctttgcttttttatgtacctgaaatttgatctagagtcactggctttcagcctgaagaacttcttttagtatttcttgtaaggcagatttgctagcaaagaattttttgttttagaaaatatccgggatgtctattttgtcttctttttggaaggagttttgctgactgtaagactgggttggctgttttttctttcagcactttgaatgtgctgtctcaccgccttctggcctccatggtttctgatgaaaagtcaattcttaatctaattgggtttcccatttctttgtcttttaccatttttgctataatgtatctgtattttatgtttactcaacttggagttcattgagcttcttgcatgtgtaggttgatgtgtttcatcaaatttggaaaattttcagttgtttaaattgcataatctctattgatctatctttaaattgctggttctttcttctgccagttcaagtctattgttaaacccctttagtgaattttctgtttcagttatcatactttttttttttttttttttttgagatggagtcttgctctgtcacccaggctggagtgcagtgacacgatctcggctcactgccacctccgcctcccgggttcaagctattctcctgcctcagcctcccgagtagctgggattacaggcacccaccaccaccggttaatttttgtatttttagtagagacagggtttcacattattggccaggccgatctcaaactcctgaccttgtgatctgcccacctcggcctcccaaccattatcatatttttttaacaccagagtttcatttgatgctttttaaaaaataatttctggcctggcacggtggctcatttgtaatcccagcactttgggaggccaaggcgggtggatcacaagggcagaagttcgagaccagcctgaccaacacggtgaaaccccgtctctactaaaagtacaaaaattagccagatgtggtggtgggcgcctgtaatcccagctactcaggacgctgaggcaggagaatcacttgaacccgggaggcagaggttgcagtgagccgagatcgcaccactgcactccagcttggcgacggagtgagactccatctaaaaatagtaataataataataataatttttatctctttattgatattctctatttgatgaggaaaagaagagcatggggagatgggaaggagatcgcataatcctctatcgggagctgggggaatgagagggagatcgtataaccaaccctccttctggagctgggggaaagggagctctgtgttctgggctgcacccaccacaggagagtttctgccccactgggctaggagggggagggagggagcaggccacggttcaagggctgcagactcttaggcttcttaccaaggcctagtggattttcttgaataaagatttctttgtttgttctgtatccctagacaatttccagagactgtgaatggtggtagtggtggtttttaaaatgtttaccacttatgcttgttttattgataagcaagtttatggagctactcttaacactattccctatagttctgaaggatttttatcttaaaaatgcacggaaatttttgttttgttatgttaataaaaataaatgttaaaatgcttattattttgaaaataagcggttttggattgtgtagtgagtgacttcagagaccttcagcccaccaccgcccacccctagagtgctgacctccctgtgtgggcagtacaggtctggccactccagagtcaaggggtgtgggaaggagagcatgcctgtacctggacttccacagagggcagagcaggtctgttttattttcggcctcttgctactagaatgtttgaccctgtttgttgttctgttcccctggtacctggcacctagtggatgttttatcatttgtggattgaatgttgaagactcagcaggcgagccagtggaggtagagaccggcggtgaaaggatgctgctgggctgtgggaatggttttctgaagtgctggaacttctttcatggccccttatcgtcagtggggcgcaatccacaggcctaccctgtgtttgtatttcagaattacagttattaaaatagtttgtgcaggcaagaactggtcacaaaccaatcaaaggtgcaaaatcaagaggccagaaatagacctcagtgtatctggggacttggtgacaaaggtggcatctcagattagtgcagagaagacatggtgctcaataaatgatgctggtacccctggctgaccttttggaaaaaggtaatgcagactctctgccttattctttacaacaatatcaatccaggtcaaagcatgttaacgtctttaaaagactacagtatggaaaattctggatgtagaacggtagtcacagtcgtataataaacccccaagtccagcttcaccagttactggccaattacagccaatcttctttcatccgtgcccacactcatttcccttctcctttattatttggaagcagacctctaaaaggtacgtgctctttacccccataatcttgatacccttatcacatttaaaaaatagtgttaattccttaatatcactgagtagtgttcatatctctaatatctgtttctctctctttaggtgtttcagcttgtttgaatcaggctacaaataagaccatacactgtgatttgtttatgtgtctcttaagtctctgtaaatctgtaggtccccagccccaaaactctttgctttactacagtttactcgtgcacatttccttcttgagacctacagtcagcgatttctccaggatgccctgcttctttttagtggaaggtggtatttcaagatcactgtctcagagctaccagtgctagctctgagtggttggtcattgtttctagacagaaagaagaaattgttttaagataaaatgatcttgtgtttgtatcgattcaccttcaaaactgtaaaatgacttcttaggtcttacatctgtactttcttcttcctaagtttagaatcttggttgtcagcaactccagatatgatagaattagcatatcacataatgactcattggctttatcccgcaatagacacgcaacagtctcagaataacaatgccagtgctgccactaccagtatgagggtcaaaagcaatttaaggtgggtttgtttttgtctttgtgttttattttttgtgtcagctcaaagcacttaatgtaagaaaatactagaagaaagaagtactggaagaaaacggccacactggagtggaaggttctttctaagcatgacctagaagccgtcattagagagttggccaagacctgattaataaatttgaccaaattaaaaactcgctacaaaaaacttaccacaatcaaagtaaaacctccccagactcacacctgagtatctaaagacacctcacgcaccacctatcctgagtagccgtccctgtggcctcttggcgccctgccggtgtacgttgaattccagggtgtggagctgtttgctgtctttacagatgaaaacacttcgaccaagttgagtttctgctccgaaatcatagtggatggtggcagagcagtggcctaggcccatggtgctgacatcacagccattcttgcaaggagatggtaggatagccactcactgttcaggcttgagctttagccagcaggcagatgtccagcttgtccaagttgattagagcacccggcccagctgaacctgcctcattctgcgctcccctatagaagcacccacagctgcccaggagccgtgaagggtttattttctccatgagcaacagcatgtgtgctcgtagagggcagagcatgggatgctccaaatccagaggggccgggctgtcagcgatcccagcctcacttcattctccggttggctgttgaccttgccaaagtgacagtccctccgtgtctgcgggaccacctgcttcctctgtgttcagcccatgctccgtagcccttactgtatggaattcctcacatgagcctctctcgcagcctgttgcaggctactgaaggaaagacaccgtccctggcatagaatgggttcggtaactatcaacacagcaagcacaggaggtgattcctgtacgattctgtgttgagtggtgtgaagagacggatcatttggctcatgttagttgtagaaggtctaattcaagaatgagtaccatcttacactttctagaagtctgttacttaaaatgttttctttcttctaggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaaggtcagtcaactcaccgtttcgagctctgtcagagctgtgtgtttccactgagctcgggtttctccgatgtgtttctgtggtatgcagtttgtcacaggagtattttttcatcactactctttgatgatacagattgtgtttctgttttcttagaactttgaactatcaccattggcagcaccctcagatgcagttatctaaagttctttcataaatttattcattcaacaactatttaccaggatcttgttatgaatgagaggctgttaacaggcactggagacagagcaggtacgaggctctgccctcatggaaccttccagagggaggagagaaaaggaagtgatcgatggccgatggtgacgagtaccttaggaaaagaataaacagggctgggtgcggtggctcacgcctgtaatcccagcactttgggaggccaaggcaggcggatcatgaagtcaggaattgaagaccagcctgactaacacagtgaaaccccgtctctactaaaaatacaaaaattagccaggcatggtggcgggcacctgtaatcccagctactcaggaggctgaggcaggagaatcgcttgaaccctggaggtggaggttgcagtgaactgagatcgcgctactgcactccagcctggcaacagagcaagactctgcctcaaaaaaaaaaaaaaaaaaaaaaaagaaggaataaacaggcgtggggtgggaagtgaagcgggtgggggagccactggggcaggctggccgctggccatctgggagggcacattacaggctgtgggggcagcagacagggtcctccatggggcgcacattcaggggatggtcagagcaggggccagagtggcaagggcagggcagaggagatggcattaaggggtgagggccactgggcgctggaagggctttcacttgtattctgagttaaatggggagctgctgcagggtttggtgagagccagagtctcccacttgcattttcgaaggctgtctcaggcgccctcgtggaggattctgctttgtgctgtaggaggagaccagtcaggaggcagtggctgtacttctgtgagaggtgagggtggccagggcccaggcaagggtggtgaagaagtggttgcattctggaaagattctgaaggtcatgaagacaggatttgctcacgtgctgcgatattgggtacgagcagaccagaggcgttaggtacgactccggggctttcagctgaaagcaaagagagtaataatttcctcaggagggcacgacttaggaggaacagttctgcaaggcaggtgcttgtgggtgggggtgttggtgtccaggaagccatgtaaagaagtaatttcaggaagcatggagtgggcagctgcgtcaaaggttggtattgaataaaatcaggaattgagaactgagctttggatctggccatggagggtgatgagtggcttcgtcagatggagagtgggggaaggcctggctggtactaggcaggcgagagccctaggcagcagacactgcgactctaatgggagtaggaggtggagttgcctgaggcaggtgtggggccaagggaggtgccaggagacagctacaggaagggtccaggagaggaacgtttgtctccctgggatgtcttcagacaatcgactctgacgcagccgcgttcatcaagaatcatgtttgatactgggactcctttgagagcccggaggaagtcgactcctatttgggggcagcagttaatgtggtgttggcagatttccctacttgaagtagagggatactattactaccaaatagagtgaacgtccacaagcttgcgctgagatgtaaaccggcctcctagagtcacgtgtggaagacaaacctggccagccaaggagtgcttgggaaccggatgtgatgagtgtctggaggccccaccgagcaccagctctcaccctgtgaggtggaggactttggccatggagccattttagtcaagaccagggacaacagtgacttgtgcttttcgttttttaaaaaatagtatgagtttggtagcttttgcatattgcttgttttgttactgtgtccttttttctacgctaagagtgataaaaacaccaacaaaattggccaggtgtggtggctcacgcctgtcatcccagcactttgggaggctgaggcggggggatcacaaggtcaggagatcaagaccgtcctggctaacacagtgaaaccccatctctactaaaaatacaaaaaattagttgggcatggtggcaggcgcctgtaggcccagctactcgggaggctgaggcaggagaatggtgtgaacccgggaggcggagcttgcagtgagccgagatggcgacactgcactccagcctgggtgacagagcgagactccatctcaaaaaacaaaacaaaaaagataccaacaaaatcaaaacaacaatggaagggttatttgcctgttccagaagtagtggctgggggaagatgggaaccacagtggatatgagaggaaaccagcctgttaaaggaatgcaggagcctcccttgactgaaaacacagccacagcgtctggaaccccccctggcggcccattgtctacaccgtcggggatcctttttcctaaaacaaaatggggtatgtgttctgacactgaaatacgttttagaacccacagccaggcccgtgcagtccctcggtggcgtccagtctgttggaggctttgtgcccacccggctctctcagtgtagtgggaccggctttttctcacctctggacttttgcacatgctgttcccatcagcttgatgctcttcctgcagttttttgcctggcgaattcctgggtaccgtttacatttcagcgtaaacatcagaccttcctggtccagcgcccactcccaatccaaaatcagttcctccccattaccaaaaatccctcattgataccctctacttttccttcctgggaaacttgtaattacagctgtaatgcagtcacagtttgtaattacgcttgtgtgcgtgcgtgcgtgtctgtgagccctactggatccaagccccagcaggcaaggattgcacctgcttgctcgccatgctgtgtctcccctggcacagcgcctggcacagtgcctggcacgtcgtccacgctccatggatatttgtttcgatgcatgcacaggtgcacccccatagctttgtgactctctgataggcggtggggtgtggacacaggcgtccccccatccagggtggtaggtgtagcaatgaaggatgccagccctggaaccagactgcctgagtttcatttgcagcttttacccactggcactgtggcccaggtgcgtgactcaccctctgtgtctcagttgcctcctctggataacagttctgatgctcatccctgcctcatagggtcattagggaggtgaaacgagcgagccgcctagtgttgctggctactggcacttagtgcagagcacctggtgccggcagcagtggggtgggcctgcaggcgtgtgggttcatgcttagggacttggtgcctgcagcagtggggtgggcctgcaggcgtgtgggttcacgctcagggacctggtgccggcagcagtggggtgggcctgcaggcgtgtgggttcatgcttagggacttggtgcctgcagcagtggggtgggcctgcaggcgtgtgggttcacgctcagggacctggtgccggcagcagtggggtgggcctgcaggcgtgtgggttcatgcttagggacttggtgcctgcagcagtcgggtgtgcttgcaggcgtgtgggttcacgctcagggacctggtgccggcagcagtggggcgggcctgcaggcgtatgagttcatgctcagggacttgtgccacagcaccctggacctcagtggcttgagcgcctgtggcagctctttcactgctgtgatagcaggcctggggcatgcagagccacagggtggggcgagcctgccaagaggcacagctgagacccttcttggcatggctcttctggagtaggaagctcatgtcaaataccgagggggtctcaggaaggaagttgttgctttgcagaccagtctaatcacaagtgagtgtggtcccggcagaggctcacgcatcagccagctcgggaaagaaagaacatcagctgtgccgtgagcagcatggcactgtggtttaaaagaggttgccatagcagaggggcagggctccatccagaggcagggcatccatgcgcccagcagagctcacccttgtgagcagagagggctggaagctctctttccaaagaggttgtaaggaagtaacccaggctgcagaacgggggacgttagaggtcgggaagggccagtctgcactggggaagtgggtgtggcagagaagggtcaggccgctgcctgcccagtccccatacagtgctgtaagggttagaaagactctaaaacctgactgttgacataatgcatttcaggattgtttttatattgcacgttgacaagaaggagagagtggaaagagacagaacagggagaaggaagtaagagcgatgagggaggcagagaaggaggccaggcagcacaggggtcagtcactgccatccgcgggtgtatgccaaggaccaaggcctgcatcgccagagggcagatggatgcacattggcagctttcccagctttacagaaggcgttgcagaccccccacccaaaggaatgattgatcttcattaagcgtcagttgtgaaaagtgaaggctttgccgtgtgccatgcataaccgaatactttgagattatgtatataaatgtatgttcacggtgtgtgtgcgcgcctgtaacctttctgtcttcttaatagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggtggggactgtcgtggttttggaggtacagatgctcacacagtcatggctcaggtgttgcattgatttgataactcagccaaatatttatagttttaaatatatatataggtgttattaaaaatgggaaaatattaattttcttgtttaactctttcgtggtgtgtcctgatttgtgacaagacccagagtattgtcagtgtcaattggcctcactcagtattgctgcaggtgataaaaaaaaatcatgccatgcattttggggcagttaattaggaatcatcttttcctgagcttgcttttctgtttttactgtgtggacagctgacacgagagcgggagctgggcttatttttaagtgggtttctccaagcccagcagtctgtggatgctgctgtttctctgttccaggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaaggtacgtacggctggttcctgggagtgtgacgtagtccttctgctcaggttgttcttgttatttcaggctgcctttcgtttaccagactctggttgaacacctggtgtgtgccacgtgctggcagtgccctggacagggggcctcagggaaggacgtggagcagccttatcccaggcctctgggtgtcccgacacaggtgttcacatctgtgctgtcaggtcagatgcctcagttcttggaaagctaggttcctgcgactgttaccaaggtgattgtaaagagctggcggtcacagaggaacaagcccccccgctgagggggtgtgtgaatcggacagcctcccagcagaggtgtgggagctgcagctgagggaagaagagacaatcggcctggacactcaggagggtcaaaaggagacttggtcgcaccactcatcctgccacccccagaatgcatcctgcctcatcaggtccagatttctttccaaggcggacgttttctgttggaattcttagtccttggcctcggacaccttcattcgttagctggggagtggtggtgaggcagtgaggaagaggcggatggtcacactcagatccacagagcccaggatcaagggacccactgcagtggcagcaggactgttgggcccccaccccaaccctgcgcagccctcatcccctcttggcttgagccgtcagaggccctgtgctgagtgtctgaccgagacactcacagctttgtcatcagggcacaggcttcctcggagccaggatgatctgtgccacgcttgcacctcgggcccatctgggctcatgctctctctcctgctattgaattagtacctagctgcacgcagtatgtagttaccaaaagaataaacggcaataattgagtcctcatctttacttttgactgctttaagttagtatatttaagagacagtactgtgatgccaactttgtcatttcaacagaattaaccattttagtggaaacgttctggatttctagaatattcctggagaaatttgaggtctggtttggtgggatgtattgttgaggttctttggtttcaagaagcaggcactggcgacgtgcatctgaagacctaagctcttccagagcctggaagcgggagcgtggagggccgggtccaggagcctttgggcaagctctctgggctgcaccactgcccagagggttctgaccattttcagtctttgtcactcaccttgggacttggagtccagtgtgagaacagctggctggccgtgcagtgtccggctcccctgcctgggctgagggcgtctccactcctgcaggctgcgtcccaagaggaaggttcctgccgttggagcagaagggggctgttccagagtaggggcccaggtgctgggtgtgaggaacaatggtgtgtgtccagggcattctctgctgtgagcaaggacttgacatgcagcaagatgtgtgtcgttatcagaccgtctcttacaaagtgcactttccttttcacagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccaggtgagagcgtaggcccgtggccacaggccagactttctacggccgattggtcacctgccaagctcttctttttctaaattgagaccatttttcatattaagaatgggatagtatttgagatctgaagaattgggaaaatacactaaaaccagtgttttactggatactagaatcaatgttgagaagtgaatttatttgggggctagcctaacaggtttcatttattagtgctgaaccactgtaactgttcatgattgaaaacttgtgtttcagtgatcattatatagtaaagatgctatgtgggggtcaagcttgctagtggcttgttctggacgcctcgtccatgcctgggctgtgtgccccccgcccatcactcagtgtctgcctgtgtcaggccattcgtgtgttgctataaagaaacacctgaggccgggtcacatgtaaggaaagaggttcatcttggctctcagctctgcgggctgcacaggaggcatggtgtcggcatctgctcctggagaggcctcaggaaactggcggtcatggcgagggcaaagcaggagccagcacttcacgtggcgagagcaggagaaagagagggatgaggagggtgtccggcacttttaaacatcagctctcttgtgaacagccacagcgagaatgcgctcattactgcgaagatggcaccaagccattcgtgaggaatctgcccccatgacccagacgtctcccacaaggctcacttccaacactggaggttcagtgtcttttttttttttctgaaacggagtttcactctgtcacccatgctggagtgcagtggcacgatcttggcttactgcaatcaagagattctcctgtctcagccccctgagtagctgggattacaggcgcccgctaccatgcctggctaatttttgtgtttttagtggagatggggtgtcaccatgttggctgggctggccttgaactcctgacctcaagtgatccacccacctcggcctcccaaagtgctgggattacaggcgtgagccactgtgcccagcctgaaggtccaagttcaatatgagatttgcagtggacaaacatctaagccatgtcattcccccagacccctatcctgctgctgatgatccccagggcagcaagaaggacggggtcagccaggcaaggcaggcgcagcctctgtgggccagctttgcccttagcaaagctcctttctcctccccatcctcccttttctctctcctcatcctgaagggacagagccgtgtgggggaattcagccacctcctgagcctttcattggcgactggaaaaccacctagaaagtatagcaaatcatttcaagcaaggctcgaaataagtagaagaaaccaggacagaaaaataactaagatttgccgagacttaaattttaattgtctggcagtgaagacttaggaaactaaagcaaaagaagcagcacaatgagagcatctgcggcgagagtaacagcaagggttgcggtcccgtcactgcagagaactcctgtaagaaatggcagcagaaggaaaagggaaatgcctagtcctagtaatgagggcacttccagttaaatgacagggtgtgacttcatacctgctgaggcagagaagcagaattgaatgacgagactcagtcttggtgagcacgtgaggattcctggggccacgttagtggcacagttcttttggaagatacttgtaagtttacatcagaagctgcgaaattacagattcttctgattaagtaattcttgtgggaggctaagcattaactaaattacgaaaacctcggttagccaagtcatcgcagatgggtccttctatctgcctgctgtgtgcctgcacgtttcctttccagagaagccccggagaggggactttggttggtccccactccagaggtgaggaagcggaggggggacgggctgctgggaggttgtgcggggcacgccagcatcggggtgggatcccaggcatgtagagcagccgggtgtgtcagggagctccgtgtcccggaatagcactttgacaccttgtttcttactttcctggaaaattaaagcattaggaaagaattggctggctttccgccccacatgcaagagccacccccaaccgcattatccgcggttttccttacgcgaggtcaaccatagtctgaaaatatgacagttattttgaggcagcccacattcatataatttctatgacagtaacaattatattgttataaatgttctattttattattataacaatcctgaagattgtgtaaaaacgcgtgccatttaaaaagcaacaatacacagacacccaggtaccccttcccggggtgaggcccaggcccccgtgtggccccagtctccccgtcatcctgggaggctttgaagcgggagctgcagtgaaagaaacagaagggagcccggccttccccaccctcacacaggccaggactggctggtgctgcaccaccgcatcgcggtcgggactccgggctctgccctctgacaggccgtcaacctctgcaccatctcctcacccaggagcgggtgacagcagaccctgtgaggccatgtgggtctagggacgtatcatgcgttactgagttaatgggaggaggcaggagaggggaggtgagctggtaggtgcagggctgaccccgagagggtaccagggaacaagaggacggtttctatttgtcaccgcctggcctctgggcatccacatctgatggtgggagacccgtttgtgaatgagaagtgagagttcaagttaactgtcttttttttttttttttaatgagttctcaccatgtggcccagactggtctcaaattcctggcctcaagcgatccttccgcattggcatcctaaagtgctgggattgctggtgtgagccaccacaccccactgaggttgaccatcttttatttgttacactttaagaacctttgtttgaaaataaaaatcaacaatttcatgtaatctttggtttttgggaaaatcagctattttttaataccgttctttgaaagccacttggtgtagattgatcttgtcgctgtttgtttacgtaatgctggcattttccatctcatttcagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagtaagtgcgtggcggacacggggtgcatagagccactttactgtttgaagaactggcggacacggggcgcgtggaaccacttcactgtttgatgaactgagaagaccaagccagtcttcagagcattggagtttggtgtttgtgaattgtgattgtgtcaacagctactggagtgtaactaagaaaacctcaaccagctgcgttgttagcactttttatgttttatgtgttacttttaggagacaaatcacttggaagtaagattttttaaatttaaaataaaaccttcagggtgtgtgatgggacagacagatgagcgtgaatcggtttctaagttagtggcagcacgtgatggccagggttctgttttcctggtcagggtgtaattggtgatgaggatgatgagtggatgtttcccagcagctgggaaatgaagcttgctggaaaatcagaccgtccttgtaatttataacgagcccccgtaaggggccaggagctcctgttgattggcgggagggctcagtcaggaggaccattttattttctttgtgtcaaagcaactgtgtttctgattttaattgtgttgtggtggtgaacacaggagtgggatgagcagaggccgttctggagggcagcttgtaacatgtgggtgaccctctatttaaatttaaatagctgtttccatttatctcaagaatataagcagaggcaggagcctgggatgggacagaggcatgtccactgaagtgtccttcacaaagtgtccttgcaaaaaggaacaaccagggtaattatccagcagcaatacagtgatcctcccagtgaggtcggtgctctgacagtgaccgtcccagtgaggtcggtgctctgatagtgaccctctcagtgaggtcggtgctctgcagaggggtcttctggctgttaggcagcctattttcacagaacagagaagcatgttgtggaacaggtatgaccccagcttactaattgtgtacctgttttttttttcatacttatatgaaagactacatacttaaaatactggtgattatatttaggacctgaaatcataagattgtggtcttgctttttacttatttttgtatcttagcgatgtctagagttaataagtgttgcttttctaatcacagcaagtcaaggtgactgctgagggctgtggccagcctgaggggtggccgtggggctccgggggcacccctggaagtacttcctggctgagtggggagtaaggggtgggagttagggtgacctgaggcctggctgaggcagtgagagtgtagcaggccgtcatacggggccggggcctggggcagagaggatgctgacgtgcaggtaccagcggtgttctgtggagatgtctcaaaggctgttgactttggaatctgagacttagggctcatccaaatggatgttacatttgcgggtgtgtgtttaaggtgcagcgtatgaataaattcatttcctcacagatctatacactgaatttcagcatcactcatctcaagaccttggccctcttccctttcctggcctgcttcctgcagcatgtaatttgctagtgtccagaactagccagtgtgccttttctttccacacgcactgcctggttcaccttcttcctgtaaagtgcctccgtcctttgtccccatctgtcccgatcgtaaataggtcctggctacagaggcatcctggctctagatcattgtaacagctgccgctctcctgtcagtcccccgggccctgccatccactgagagtctgaaatcctttgcactcagttcctgactgtcctccactcagaagcccagggatggctggagtggaggtggaagcggggtgggcctggttgagcaggatcagactctgcccggccaggggaggaggaggaggacccaccaaaggccctggatgatgcccctcctgctcatcaccctgcctgccctagcatcctctcgacacagaaaccagtcccttttcttctatgaaacttctccagtgattgtgacctttgctgatttctcccttctttgaatgcagatgggcctataattcactcttaacttagcacacaccttggcctgtgggggttgccaggtacctgaccccagctcctcagccaggatgtgggcccctcctggcagccacactgccaggcacatggtatacagtgctcaggctgtttgaactaaactgatcaaagtttactttcttaatgtaaaagctttctaagaaaatctaatataggaaaattcagttttcacaatattatgatattaaaaattacgattattttaaatgatcagatttgtaggctgtgtgaagcatttcatttacaaaatttatttaaaatattatgttttaggaacatacgtgttttgtaagatgaaattttttggtaattgtatcctttacagataactatcataagagtacttaattttactgagcttactgtgtgccaagcactccctgcattcccttgcttaattcctaggatgactttgtgaagtgtagaaccattttctctccatttcacaaatagcaaagctgagggtcagaagtcttgattgacacgcccgagtaggagagctagtgagcagagcagcagggctcggactgagcagagctctgccttttctcagagcccgcgggttggatgactgcaccactgcacgcgtgtgtgcctgtgaatgtgcaggtgcttatttacctataactgcatgtatgtgtacctgtaaatgtgcaaatccttctttaaatctgctcagttgtgcaatgaacatttatgaacttacagcagtttcttagagttgactcttatactagtgcgttgggttttttttaattaactgcaaagcaggcgggccacgagggcaccgcttgggtcgtgccaccagatgagccaaatgagcaagatctccccgaagccagccccagcggaagagtctgcacgaggacacacctgtgggcctgtggcggcggctcctcagggctgctgtgcggaggagacatgcccactgccatgacaggacctggggggtagggagggtgccgcggctcctttagtcagcagtgctggacatttactggttccctgggtagataggtgtgtttttcatgggaaaatgtttttgaatttttctcactggtgctaatgaatctaacttgttttgctcttttttaggggtattattgaagctcgttttgtttatgtctttgtccttggcattctgttcacgggcaccaaagacttacttaaatctcaagtcattgctgcagacttcaaactcaagactgtaggtttatgggagatatatagtggattagttcttctggcagccttgctctttagaccacataatcttccggtcttagcatttagcctcttgattcagactctaatgactaaattcatctggaagcccctgagacacgatgcagctgagattactgtgatgcattattggtttggtcaagcattcttctattttcaggtaggttttcattattatcatgggtagtagacttcatgttttacatatttattttaaatttttctttgagaaaatgttcccataagttggaaagtgactgtcagtgtggcatggtgaattacgctgaactctcgtgtattttataagacaaagtacagccggttgtttaagacacgcgtcccaggtgtggatgtgtgggtgcttaagacagcagactgctgctttgctgggccaggcctgggtttatttattacaagcagttcaggaagcacagacatcacgttgttcacttgcttcactgatgaatgtaataattgttctcgttcatgccctttgcccctggtgtcggggctgtccacactggggaccattggtgcccccatgattattagctccctgaagcctggtgggtcgtcagggcttctgtccggtgtttaaagacccatcccagacaagcccaaaccacctcagtttgaagagacatagagggacaggcagacggggcctcagagggatccagcctcatccagcctcccggcaacctcaggagagcaggccagatggggcctcagagggatccagcctcatccagcctcccggcaacctcaggagagcaggcacagccctgctggttcccttccagtgccgactcccaggctgagtcgctttgcagcagctgaacgtcgtggttgcattttggtctctaccgtgaggtctgtattttcttggtgtgcaccggtgtctgcctgtccgctgtctcgtacccaggaggcatgtgcagttctttgtgtccctacagggcctctcttccatcctcttctcctttcctggtgctcccagcctttcccatggaacagcccacagttgcaggattttctgtctttatgtctgtccccctgatcctgaagcccaaaggtggtaggcgtgaagttacagaagtctgtgtcttcaggtacaatgagtaggtggccaatggccagcttcttagccccgtcctggtgcttccccgacccttctgatccgctcaggcccctgtcctcctcgtacacagctgcagctctccctgccatgtccacgcaaggcacaagggtgtccccagcagaactgcaggcctggatgctggtatccagcacgttcaagccaggtggcctccggcaggctcttgccacaccttcgtttccttatctgtaaaccagggatagtggtctcccggcctccccaggacccagccctccctggtctccccacctccccgtggcccctgttttgaggctgagtccgctgcccctcagtgttagatctcctctgagaggaacctgtggctttgctgcccatccctacttcctgccctcgactgggcagttccttaacagatcagggatcaggaacatgactgcccttgctcatctgctggccctccacatttgcccagtccctgggtctctctgcctccgtttcctccctgtttgatgaggataatcacgaagcacatcaggactgttgggttagatgaagtcatgcaggtaaagctgctgtgcagctgcagacatgtcagcatggctggcagtctctgtgcttggctgagcctgctcagagccacagtgacctcctaggtgtcctcctcccctgctcccatcgtggcatctgggactctgtccccctgccaccctccagggtctcctactgcttctgcctgtttgctctctcctcagtctccctgcagaagagcttccaagtggaggagacacatgactggggtggcaccgtccaagagaggcagtagctgcgagtccagtgggtctcagggcaagccaagtcaaagggctggggcctaagacaacagggataggagtcaatgcacatctgtgagataatggggaagcagcatcaacatgacttggggaccccctgggcccacagctctctgcatggaaagggaggaaggagccaagctggtgagcacccagccagtgttttgtggacatgaacagttctggttctggagagggatcttcgttgagcttgatagagacatgtgctgtcggactgtagatgtcatgagtttctgaggaaaggtcagcatgacaggcaagtgacagacatcagagtcagtaaagatggagcgtggggaggcggggcctgggagcagagaggaggggcctaggaatggagaggtggggcctaggagtggaagggtgtggtcttggagtggagaggcggggcctgggagcagagaggaggggcctaggaatggagaggtagggcctaggagtggaaaggtgtggtcttggagtggagaggcggggcctgcgcagagaggcagggtctctcagaagacccctttttgggatccagaatcactaggagcagggtaagctgtgtggcatcagcgcttgcatcctgcagggagttacctaccagggctgggccgggactggccagaaccttgacagatgaagtttgaccagaccaagtgagtcctcatggtctgatacgtaagccagatgtgagttaccaatttgcaccaggggctgtgctcccccagtggctggcctgccctccaccatataacccactggcagcacctcaccgtagatgggacctggctgggtgcccgttctagtcttcagcccagctccccgcttggctgggcccagcagctggcctctcagggccctatgcgcccctcggatgggggtccttgaggggagcttcatgtgcttgtcttaagtcgatgggtctggacaagggtcttagatgtggcacagtcagccagccggtctgtgtgtgcgtccctcttcagagggggccccagcttctgcacggtccgctcacgtgcccttccgcagcctgggcactgcaggcagggggagggggtgccacctaggcaaggccagctcggcagtctgaaggaacggctgggcagccacctctgaccacacgtgtgtccgtgccggcgtggttatctgggctgcctacacagttcacgctaacatcgtggctcacgctaacatcgtggctgttgatgccacgtgttgtgaggcctttgtcagctcttctcctgtattccagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagaaacacgcaggtgaggcgcctctctgccgtcagcacagttctgggggccggctgcctggttttaagggtcgtactttgttccagatgcaagggggtctaagctccatgggtccaacagtcttttcaacagttttcttttccttaaatagggaacggtccaaagctcaagggccagaagccggcctgaggtgtccgtgtagggccagggtcgggtctgacggggcctcgccgggctccccagggttgggtctgacggggcctcgctgggctgcccaggtcacaccagcacatggtttctagacacaggaaggaaaattccttttcccgccactccaggtttttctgtttgctggtggccagatggagggcgggtcgtccttcccctttggggacatgaagataaaagacggctctcggcccccagagaccctgctggagcgcgcaggaccctggagaaggctcctggccagggccgtggctcttctgagtcgtccttgagtagctaggggcatgtcccttccacacataagctgatttgggttggaaaaacagggtggggggcacagggaagttcagagacgtgagccccgtcccctgtcgctgagaagtcccttcaagctgcgtctggcctgccctccatgctctcctgcctggtccacctcgttccctccagtgagcctgaggtctcctctccaacacccacccgtctcctggcagcttcgtgcagaagttccaccggggggaccccagatcaagggtgcagtgcagcccctcatccacatccccatctcctggcagctttgtgcagatgtccccgggggatcccagatcaagggtgcagccccccatccacacacccgtttcctggcggttttgtgcagaagttccccccgggggaccccagatcaagggcgcagccccccatccacatgcccgtctcctggcggttttgtgcagaagttctcccggggaaacccagatcaagggtgcagctccccatccacacgcccgtcttctctgcagcgttcccaccgccgcacactctctgcttcctcatcgtatgtttcttgctcccccaagaaaggaggctttgtgaggcaggggcttcacccgctctgttcaccatagcagcctcagtgcctggcctggcggagtcaggtgctgagtggagtgtggcgggggtgggtgattctgtacctcccaacttggtctggcagagaccccagggcctgcaaagttattcgactcacatgtgcctggttttcccatctgtaaaacgggagttgctgggagctcaatgggggacacttggaagcgttcacagcctttggaggggctagtggcccctgcggcatctactagagtgccccgtgctccacgcttgtccctgctgccagccacagtcacgaatccccgcagcgcctatgcatttctgcgtgtgctgaaaccgcgcaccgcggcccggcctcctcccgggcaggcgagcgtctgggacactgactggaccagcctcccgcactttctgggtggctttgggcaggtcagccagagctttgcgtgtgtcctgtggtgaccggaggccccagtcctgccgggagccccagggagcgcgctgtggcctctccgctgagcagtgaggctggagggctcctacgtcctcccatgactgaaccgtcgctctcgcggtgctgactgctgagcccccgtgccagccctcccaggacacttggaggcttctcctgccgagctgccggcgactccacagagcatctgcacgtttctgtggtcccgctccgccctctggcttctgctccacagcctccttcaccaggtcatcctctcagctccacgcaggtcctctccccgcctcactcccctccccagaccagctcctgagacccaggccacagggacccttggccttgcctccagacccagatgcccagccccctgtcgacattccgcagaggtgtcctcgggctgacaggactgaggagccctttacaggacatgcgggcagggcccacgcacccaggcacgcacacccgtgcctgcctttgagcttttcccaccctgaaaggagcccctcgccgctcacgtcctgtgttgaggctctcacagcatgagtgcttcggagccagaggaaccgtccaccatggtggaagtgttcgtgccccgcagactcggcgggcccgggctggacccctcagtcgctcacaggtttccgtaaggggtcgggggagcattggccttgcttcagcagtgataggcgcgtgccttcccacagcggacatggagcctttccaaggggagaatcgctccctggccagactgcaagcttcccggggacaggaatgcctgagatccacctgccttttcttcaggtgcctgtggacgcttgacacgcccactttggggcagtctgtggacagacccccgtaatttacagtcaccgctgagcttgtcatcacagcagaaagctgaggctctgcgggcggaagccaccaacagaccagcttgggagacacccactgtggcggcgctgtgtggagacgtccttccagacttcgattctgcataaaaacaaacatctgccacgagacccctgctcggcgtccgcctgtctcagcagctgccctgggacgtctttctctgacttggttttgaggccagccgcgtgctcacactggccttacagaaacaggagacgccgtcctcggccgtctggggtgggctgtcagcacgtcgtgtggtcaggtgtcaggacaagcgggcgtgagcgcgtggaggtgcatctgcctctgccctggagaacggatgtgctacagctgtgcgcggcgtgatcaagcacctgttgggtggacggcacacctcccagtggccagctggagacggagggctggaagtacttgcccggctcctctctctgtaggtttggtcttcggccttgcagctgccctggtgcttgcagattgcggtttgatggaccaggcacttttcatctcttacacagccaggcacgtttgtgtttgggagggaaaaagacaaatattaagtgaggtgaaagcattttgatcaactggagagtatcatgatatttttcctagtcaagaagcatttctccttcattttatagggttttcttcttcccttttaaaagtttaaagcatcaagttttactcatggtttctattttgtttcagtagagtaggaaaactataaccaggtctaaattgtagacagagaaaatatgtttccaaaaggtcaaaaacgtggccttgagtggttggcgaccctctgttccaggggctggcaccccgggctgcctgctcccctgcagcgcaaatggctctttgctaaagtggtgggaacagcaagccgccatcttctaggtgggtaacgctataaagtgttaaactgaagtcaaggtggtgccatgtctaagccacagcttccccatgcgctgtctgggtaggatggggccacggcccacttagccacgaatcttcctgcccagtatgttcaccttttcctgggtgttgctgtcaccaggaggtgtattgaggataccttggggtccacctccctgtggggtccccggcctgtggggctggataccaagtggtgaccagcggtacgggtttgggggacccgcctaaggagccagggcctggcaaggaaagcagtgaaaggaccagaggcaccggccacccaccgggagatcccagggtctgagtattttactggagcacatggcgggctgaggtgaaggagtgtttggagaagccaagaggaggatgggcccctccaaggcctgagatggggagccggtggggggctgaggtgaggctgtggaggggccagagacagccccgtccttggcccttcgtggctgttgacaccctttcctgagcagtgagcactgaagcaggagccacttacaggacaccctcaagtaatacctggtggagctgctgggctgacaggactgaggagccctttacaggacatgcatgtggggcccagacacacatacgtgccgacaggactgaggagccctttacaggacatgcagcgggacccacacacccacacacacgtgctgacaggaccgaggggccctttacaggacatgcagcgggacccacacacccagacacacacacgtgccgacaggactgaggatctgggggctgcctccgggccctttctaacagaacttgatcagaggtcatggatgaggcatggaaagtgcccaaataatgtaatttatcatttttcaataatcacagactcagggaagttgctttgaggaagagatttatgtagtgtgttggtggtttcaaaactagggggtacattaacatacttcgaggggtggctcttattccgagaatttgctcagcaaaccccgctgggccagtgtccccagaccagacagtcctccacaccacagcagggagaaaagctcagaacttgtatttatgtttatttgtatctcacccttttgtgattttctattcatcgtttgtattttataatgcatgtgatatagtagcacatgcatatataatttttaaataactgcaaagtctggggggtgcgtttttcagagctgttttacagatgacggtggcagacagtggctgagcagttggggctgcagctcatgtcccctcgggcacctccgtgccttctggagactcagacctctgcccaccccagaccaaccacatccagatttctgtagggggggctccagagtggcacttccagcacatactgtaggtgatttttacatacagtcaagtttcagaagcatttctggagagctcaaggtgtgtgtggggggggacatggtggccctcacccatccttctgtttgcttcatttttcttcatgaatttgtctcttcctgacatgttacatatctggtttctcctgcctccttcactagaacacagcctccaagggggcaggttgggttttcccgtctccagcgcatctggagaggcacctgtcccagcaccatagtgactggatgtgtgtgcagaagaaggaacgcggtgccctctactccaagggcaagagctactggagtctttttgaaaataaaagtgttgttacatgtgtgatatgtaagtggcatgtgctaatacacattttctttcttattaacagtggttcagcactgagtcatgcttgcttctgctacgcactgatttgttctattccagttttcacgtacatcgttttggtgacatctctgcgttatcatttatttatatggagtgtattttctccaaaacttctctacgagggaatgcacctgctcattacagctgctgtctgtgtattcttcacggcaatggatcaaaccagactcacacagtcttagactaagctgaacactggaaaaataatacatgcttaaagtctgctgttattctaaaatgaaagatatgaattcaacaaagttgatggataactttctttgactgctctacctgaatttagactaagcagtaaatagtttaataaaagatcactttaatat

SEQ ID NO: 38418 - DNA, 22852 bp, Homo sapiens
gccccagccggcgacccggagccgagagcgggcggcggagcctgagctggacgcggccacgccggcgcggcggtgagcgcagcccggtctggcgcctgcagctgcggggagcgcgccaggcagagggagcggggagcggggcgcggggcgggcctcggtgtgcgggcggcgtgaccttcccgagcggcgggggaagcggccagcgtcgcagcgcacgtgccgcgggactcggagaatctcggggttgtcggcctccttcctgcagtgcccacctggtgggaacttttgtccttgtttgcccccaagtcctgtcatttggctgcggggctccgcgcctcaggggcgccagtgctgggcagcatggagccgcttgtgaatggagacttgctggctgcccaggagtgggcggctgggcaggggcggtgaacgtttagggtccggccaagaaagttggaagtcgtctccctgacctgttccttgcgaggcccgggaggagacgcgcctggccggtccttggcggcgaaactgatttgcatctccacgctttacctaaagcccgggctctggggactggatggcgagctggcctgcggctcctttagccagaagctgggatcttcccgcagcagttcgtgttccctggtggaaaatgcagcctcatctactgactctcccttccaaaaaaaagttattttccccaagggtcgagaaaagtgggtggtcggcactgttgttcctcagttgcaccctggtgtaatttgagagaggggtcaaaggcgctgaaaagattcttttttctattccaagtgctacagcaagctcataaatcaattttaattcatgctgaacagtcttgcctcctccaagccctgtgtcttctccaagccagagctacacataatgtgaattagctgcccactccttctgagtgaatctgttagtacccatcatcgttttctatcctaataattctaatggctatttgtagaatttatttgtttgtttatttttttgagacggagtttcgctcttgttgcccaggctggagtgcaatggggcgatctcggctcaccgcaacctccgcctcctgggttcaagctattctcctccctcagcctcccgagtagctgggattacaagcatggcccaccacgccaggctaattttgtatttttaatagagacgggggtttctcatgttggtcaggctggtctcgaactcccgacctcaggtgatccgcccgccttggcctcccaaagtgctgggattacaggcgtgagccactgtgcctggcctatttgtagaatttaatgtgtttaagtttggctcacctaacagggtttaattcttagggacagatagaatgtaatgtgatgtgactttccttcaaaattaagaaggaagtgtctgtgccaaaagaaataagcgcattgaggtttatctaggaggccacattgtacttgcctctgtctgtctgctcagttgcccccgtttttttctttcccaaaaatatagggttgggtgttttgtgttgcctttggccaggttgaaatactcagattaacggttggtttgtaggcacaggcctgaaaagacaggactttgaactgaatcctctgtcactgacagttgtgtggccttggagaagaccttgtcttgctccaggctttagtttgccttctgggaaaggattaggaccctgataaactttttatttatttatttatttatttatttatttattttattttttattttctattattattattatttttttttttgagacagagtctcactttgttgcccaggctggagtccagtggcacaatctcggctcactgcaacctccacctcccgggttcaagtgaatcttctgcctcagcctcctgagtagctgggactacaggtgtgcatcaccacgctggggtcatttttgtattttaagtagagacagggttacaccatattcgtcaagctggtctcaaactcctgacctcgtgatcctcccacctcagccggcccaaagtgctgggattacaggcgtgagccaccgcgcctggccaggaccctgataaacttttttaggaagataccagatggccaccaccttttcagcctagtgaatggtcctgtctctccagacctatcaacagcatataaatcagtgtcttgcacttctaacttagttgctttattaagtaatgtgccgttgttgccactggttttaaattttttgtgaataaaggaggattattgaagtctcgtcgttggcaagatgcttcaagaggtttaaacaacttctccacggccaatgtttcctgttgacgttcagggtgacattggtgttaggagcgtgcttggtgttcatctctgatccagcacgatgggtcacacggctcctcagtgtgatgaggaataagttgttccttattatttgcaaataagttactaacaccgtttgaaaactgtacaggattggtcgttgagttggatattttagtcaacatttattaagcccatgcctcaacagtagttgacttttgtctaaagagagagaaagaaattctagttttcccaaatgcccaaggctccaaccaaaacatactgaatccagatttccagaggaaagtcctggcaatttggatatttaataagtgctccaggttatcaagtggatttggacacaacggcccaggtgttgtatctcaaagtgtgagtctgtggactggcactgtccgcctcacttgggaactcatcagaacaggcagaacctctggtcctgtccaaggctactgaatcagaggccgcattttatttagcaaggcccccaggctactcctgcacacgtttacatttgaagggctggtggtctgtggtgacgggaagatgtgtgtgacaggaagatgcttgcgcagggccttgttctaagaacacatgatgcttgtgcacggtgtggcgtcccatcagtctgatgtggctatttgtgactgtgtttgttttataatatttttattattcaccttgtacagatgaggactcccagctgtagaggctgaaggagccacactgcaggtagagcaggcattcaccaaggcgtgtgtgatcccagggtgcagctcccacccttggctgcctgggtgctcttttccagacctactgtcttgtgagatccccttaggcacccagcacaggctgctgtctgaatttagaactgagcctgttcaattgatggctcaacataggcctctaaaaaaacaagtctgatgcggtttggtacacctgtggttggcttacttatttggtgttcgttttttcagttttcagaaaggtcagttgaagtgctgctggtggctgtagcattgatacacaggggaggtttttgatctgtgagctttctaggaggcagttgctaagctgcactgataccttgagcccctttcctttggaacagtgtggaccccaggtcatggctcccagaagtttaggttctgtaatttggctgcaggcctagagaacaggatgctgcagacttggactaatggtgaactcttgcctccccccagggatatgtggtgcctgtcataagctccagagagctgccttccacaagaccagcagaagagtgggcaaacatgaaatccaatcctgctatccaggctgccattgacctcacagcgggggctgcaggtacagtcatgtgcctcatcaccatgtttctgtcgttgatggatggtgtatctgatggtggtcccatgagattatactaccatatttttactgtaccttttctgtgtttagatacatttagatacataaataccactgtgttatagttgcctgcaacatccagtacagtaacatcctgtacaggtgtatagcctaggagcaataggccataccgaatagcctaggtgtggagtaggctacgccatctagggtcaggtgtgtatgctctatgatagcacaatgacgaaattgtgtaatgacatgtatttcagaacatgtcccagtcattaagcaatgcctaactataatcccagagaaaacccagttctctctattcctcaactactctctaaatgagatcaaatgaaagtggtatgaaaatactacctttctccctccagtactttacctttgggattaatccatttgatggaagtttagtattgttcagagagtagcagaagctagaggagtgtccgttattgttaacaccttgtcagtcagggtgatgggtggaaggtgcccagtacagctggaaaacagctcagaggtgaagccacgtgtccattgtcacctggctgggatatgcaggtgatgtggttcttcacttcaagcctggcagtcttcagagcccttgttgtgcaaaaataacaccatagcatctcctgggaaacaccacttactgtccctgctagtgttgggaaagaaaggaggacactcttagaaatgtctttaaaaggctgggcgcagtggctcacgcctgtaatcccagcactttaggaggccaaggcgggcagatcacctgaggtgaggagttcaagaccagcttgaccaacatggagaaaccccgtctcttctaaaaatacaaaattatccaggcgtggtggtgcatgcctgtaatcttagctacttgggaggctgaggcaggagaatcgcttgaaccccggaggcggaggttgtggtgagccaagatcgcgccattgcactccagcctgggcaacaacagtgaaactctgtctcaaaaaaaaaaaaaaaagacatgtctctgaaaatgagactgataatggactgtgtcttagagccgtgaaagttgtaggatttgctgggaatgtcagctaacctgagcctaggggcctgagcccaagagcctgaggctcccccagcacagggaggtgctacctgtgataaggggtagtgctggcaccatgcaggctactccttagaaagatcagcttgaacatgcaggaagagcaggaccctcaggctgggaaacagggcggaatgggaagtgcatggtggtaatttggttctccagagtccagaagtaggaggagtggctggaatactgattgcccaaaggaaaaccctggactaccctgggctcccgcaggattctcatagtagttgcagctccctggagtggggaggccagcgggggtgttgcccagtgctgtccttatccagcacaccccccacccccaccaccagcagatgagtatggtcatgaatatggtcacctcatcagtcatttgctcaattgtgaaaaagaaattgttcagagaagagcaaagtgtttttccatgagccaaaggtcagccagggtatgctaatgaggaagactggagagagcgcgtcaccgtcaccgagcctaatgaggagcactgggcaagggcacttctcccagggcagaacccacaaggagcgtcccagccccagatgcccagggaacggaaggccagtgggggtctgcccagtagtctcttgcccactgcgtgcctttaggctacagcctcccaagcccctttccccctcccctcccccatgccacactggggaggacgctgaccctgagaatggtgcaaacatctgcctgccccaggccgcctctcaccagcgagtgaatgctcttgggctcagttctgtttctgcagaaggagggtgtttagccacatatagtctcagcttttgacattttatgtctttcagtcaatctgtcaaagatctagaacctatggtgatagaatttaaaagtttaccttttcctatttatgtgcatacaggtatttgggtaccacatttataatttacaagttagtttgaaagatagaaattgcaacagtatggttgggagcctggtatgtaaggcatttgctggtgggcatgttttgaacatgtattgatcccttatgtatactgacacactgtccccatcactgttggacaggtatttccccctgtgctggcgacacagggacgcccctcaccgaggtagagatgctgtgggtagtcttaacttctgaggacaacgaagcccattcctggggggacaggatagggagggggagcgagacatggtctataggttgggggctgggcagaggaggtgcctagcagtgacacagaaacctctgttctgctgtgaggcctatggaatgcaaatggaacccacttttgaggatcttggagtcttggagtgctggagctagagagacctttagacattgttggctccaatgctcgttggatatgtagaaaaaggcccacagaggagcagtagatttgttcaaggttacacagcaagatggtgtgaagacagggcaggactgtgatccctgggtcccttgtctggtgtcgttgctgtctctgctttagtactccgtaatgcatctgcagcacactggaggggagggttagtttggagcctttgggccctgcctttctggatgtggaacttgctgggctttgggaattttctgccagccattgataggagcagaggacctgttgtgttttgtggcagaggtcacccacggaagcgatccatctgtaagcacagagccagctgcagcccgaggtgatgtggatggagcttaaatgtggtgttgtgtgtgtctcttcttttcctttaaacaacgttttccccaccacacaggtttttagccagcttatctactctaaagtgctgggaagttcccatttccctatctgcaatggctgtaagacatctagatccctaaacagctaggataaaggaggatttcaagaacttaggtgattaggtaattattgaaatgggggtgcgtggatcccaaaagttaaatagccttaaagagaaacttggtaccactttaatagtcattcagcaactctaaaacaatgcagtcactactttgactactgttgcagtttaccttgtttagcatagttggagaatgtggcatttcagatcattgaagtttatcttctcaaatgccaaaattaaaaacaaccccaaaccttttttgattggagtttcttgaaaatgatattcttccctgccctgttaaacctttacgatggcctccagaggggtttgagggtctcacctctgcttggtgggcctggtcctgtggtgtgagtctgcttctctctcctcacctctctgccttcttcagagctgtcccttccctgagacactgtccctgccctgatagatttcctctgtatctcgtgatttactgactctatgtcaaggactgaaaatccaaaccaccacccttagtaaagtgttaggtatgacataatctgagtgcctttcctgcggaataagatgcttggctggccaccatatcgccgaaagaatgttgttatttgtcttttaaggagaataagatcagaagtctgatttctaggcaagtggagaaatataatatttattcatggctttatggacttgatcgatctttgagaacctactaggtgtcagtctctgtggttggtactggtgttcagaacagtcttctctcacttgagggcacagtgagcgccgtgaccatatcatttgtggtaaattacacgggaagttagcttacccttgcagaggacgggagacagttgttgctagcatttgtacattcattagcctcccccttctccctgttggaaatgtaactgtcccagctacacagcaaatgtgtattctagtaacctgtgatgcctgaactgttcaagatgatcaagttaaaatatgaatgtgctgaattaaatgctttattcagcttatctgcatctaggctctctgaattacgcacccacttaaaacattctgtcaccttttctcttggaataattaaattattttaatgtaattcagatttctttttatcctagcccagcattacctgggagagaatgactcaggattaatcataataaaatcatattaaattatattccactaattcagaattggggataatttggcaattaaaggcggaagtgtgtcattcctctcctgtaagaaatgaacagtaatgatgggctcacagagatcatattgcttgttgcttaaaaaagagatcaagcagttttcagactctggaattgttggcttatttgccaataaataattgagaattattcttaatgtcccttcccccaactccactttccagagtttagatggaataactgtgtataacatcaaattcaggaagttgcatttcttaaatattttctgtaagccttcttttgcattttgatgaagctttaagagctcctctcaggtccagaaggagacggtaaacactaaccactggcagttcccacgacgccaaccctactacagggtgtggggatgttgtagggtggttacagttcattcttctcttctgtttagaatttttactaaaatgatttcacgtggctgggcatggtggcttatgcctcccagcattttgggaggccaaggcaggaggatcatttgaggccaggagttagagaccaccctggccaacatggtgaaaccccatctctatgaaaagtacaaaaattagccaggcgtggtggtgggtgcctgtaatcccagctacttgggaagctgaggcacaggaattccttgaacctgggaggtggagtttgcagtgagctgagattgcaccactgcactccagcctgggtgacagagcaagacaccatctcaaaaaaaaaaaaaaaattattttgtgcaatgtagactctgctgtatttaatcttatagaagtatataaataaaggatttaagcataaataaatttcagttcattctctatttacatacacgttattaatcggtagagctcaaattaaagaggtttttctatagaatgaaatatttagctctttggggattaattagccagactccttgtttcctttccgtggtgccgggtctgatcagtcccactgggcattaggcaaagtgagcgatgaagtcttcccaggtctcccctccctttctgtggtttccgtttcttgtgcacacagtagctgctgtttactgattacgtagccggtgctgtgccaagcctgtctcctccatttttatttaatcctcacgctaaccctgtgaggtggcatggatgaggagctgaggctcagaagttacatggcttgtccaggatctcacagcaaagccatagtccctctgaccctattgcccaggctcctacatattcactgcactgtttgccgctgttgaacacatgtctgtctctctcccctgcctggcatgagctccttcagggtgggacttagatgccaggcacatcaaggacctgctctaaattgtttactggacatggctggaaggttttggaggaaaagaggttgaaatgaaccgaagcaggggtaagttctggggtaggctgcctgtgccttccttccatggataatggaactgtagcctcgtactagagcagtcatctgtcctgattgcaggaggtacagcatgtgtactgaccgggcagccctttgacacaatgaaagtgaagatgcagacgttccctgacctgtaccggggcctcaccgactgctgcctgaagacttactcccaggtgggcttccgtggcttctacaagggtaccagtccagcactaatcgccaacatcgctgagaactcagtcctcttcatgtgctacggcttctgccagcaggtggtgcggaaagtggctggattggacaagcaggcaaagctgaggtgagtcaaggacacacactttttttatttgtttaaaaaaaccccacaaaactggcaagacatggtggctcatgcctgtaatcccagcactttgggaggcaaaggcaggaaaatggcttgaggctgagagttcaaaaccagcctgggcaacacagcaagatcctcatctctacaaaaaaataaaaattaaaaaaaatctactgttgtatggtcacaattttactggtgccttatgtggaagaacatttccttttttaaaaataactgctttccttttatttatgaagttatacattgtcatcatataaaacttagaaaccacatatgcacaccacagaggagacctgctcatcatccaccactgagaatgaaccgcccttctgtttcagttttctccaggagaatgctgttcagatgcagctggcagtgctacctctcgtcagcagacatgctgcactgaaactgtagatgctgcttatgatccaagatttagcttttctttcattagcaaaaagcagagtattggaagaggttgtctgagccagatgaacttgaggagttttaggaagggtcggaaatgtctgcgaagatgcaagggaacccacctttctctgtccaaatcttcccaaaacatcagactttgcctctttgttggtcttgccttgggtatttattatatagagactaaacagaatttggaaaccactgggatgtttagctatccctgctttgaatgttgatttattttataccacttaaaattattatataagcttcaagattgcaaagggcagtcttagttatttcagtaggagtttgaaacctgattgcagctgcaggtcccacacaactgaattcggtttcttgtgcacagcactgttctctggaggtgcctggaggtctgaaggtgtgcccttttatagacaggaattccaccatgatgggtagagcttgttttttaaaaaggcttgggactagatacgattgcccaagaagacagtgtagacagcgaggagggctgagcatgaatgggatgagcctccagcacagaaagggcaggcaggaaggcagtaaagaaacaagcagggcacaaaccaggagagtatggcatgccatgatggagactgaacagaagcaaaaactacaggcaactgtagttttgttccctgttgaaggagagacactctattagagaagacctggaattcagttcagtttccttagcaaaggacaaaatggggagagaagacagggaaacagtaagcagccacgtgagattctggggaagacctgtgtcttctgagcaaagtagcccctccagccacaggatagacagtgacttctgtcttgcatgagtgaaaccactggatctggctctgcccgcccctccactttcttgcttccttagcctgtgaacaaagtgaaggacaggtaagagcatattgcttttctgctgagaacaatctaataccttacagctgcattttcccacactgctttcagaacattgaattgctgggtgtccttaagaaagggttgggaaattacgtcacagtgtctctctcgtgaagaatcactctgggtacatttatttcatatagtgtatgtgttatttagttcattaaagatgcgtaaggctgggcacagtggctcacgcctgtagtcccagcactttgagaggctgaggtgggcagattacttgagcccaggagtttgagaccaacctgagcaacatggcaaaaccccgtcactacaaaaaatacaaaacttagctgagtgtggtagcacatgtctgtggtcccagctaccagggaggctgaggtgggaggattgcttgagctcaggaggcagaggttgcagtgagatgatgccactgcactccagcctgggcaacagagcgagactgtgtctctcaaaaaaaaaaaaaaaagaaaagaaaagaaaccatcctgattaaccttgtctaatccagcactcatcttttttgagcttgggcccgttttttttttccatcctgaggaacagtgtttgcctcttacctgttggggaaatgctctcttagagtctacaaagctctgacatgtatatcatgtctctatagccctcaccgtgatcctgtgagaagagcaaggcagatgttacctctcttagggatggaaaactgaggtgccgatgttgacctgctcaaggtcaccccgctaaggacttgaaattgtgtcctctgagctcctgcccagtctcctttccatcagaccacagttgggggtctggaatattttataagggtcagttctagagagaagattaatcaggagcagtgaaaggaaagaactgcttgtgagagcctgtggtgaatttctgcaatcacattgtaaatatttgtctgttcccggtttcaacatgacccagaatgttctagtttgacgtttggctggacagggtcttacatagcaggagtgctcaggtacatgtttgttgaacatatgacaaatggatgattcttacaaaatcccatcctatacctattactgtttcaattccagttctacacattcatactacatgcagaaccaggggcccatgcacctccttctgtgcactggtcaatgaaagtatttattggaaagccaaagtccactgcatatctgatttgactgtgtccttgcactataataatgtgcttggtgttcattcagatgtctgagccattattatatcttaaactcaatagacttctacatttattgactgccacctttgtcctggcaaacttggcagatcctggttaatgctcctaattgactattgcctgtcaacaggttaacagagagtccctgagggaggccaactgtggatctgcaggctggctgcaagacaacagaaaccattttaagcttcagttctaacaagctgctaaggagtgaagtgggggaaaggagtggactgaacagcattggatggtttccacaccccataaaagcgtgtgcaagtacatttgtgtacctggttctcctttgctaatggttttaggcttaattctctaacatcaaaaggaagtccttactgcaaacagtgtcttcctactgaaagaaagctccactctaagccaagtcttctgaaagagttgcctctggccatggtacagaagctagaccaccagggactagcaaaccagggccaagactggtgccaccttgattttatactaatctttaacactggaaaaacttgagtacccctgaatatggtaagtccatctgtgctttttttttttttttgagacggagtctcactctgtcgcccaggctggagtgcagtggcgcaatcttaactcattgcaacctcgcctccccagttcaagcaattctcctgcctcagcctcccgagtagctgggactacaggcgcccaccaccatgcccagctaatttttgtattttagtagagatggggtttcaccatgttggccaggatggtcttgatctcttgacctcgtgatctgcccacctcggcctcccaaagtgctgggattacaggtgtgagccaccgtgccctgccccatctgtgcttttgctcacagtttggagaaaaattgttaggggattatatctctacctgagtagttagctgaggagattcccacccacccttaggggtttttggaaatctctgagggtgatcttggctgtccagtgagagcatgatgctggcattgaatgggtgtcagggaaccagttcagtccttcctgcccaatgaaggattgtcctacccccaaatgccagtcatgatcccatgacacaacactcttctagggctggaagggatcttctatcccaactcccatgaaccaggaactcgcagagaagcctttcttctgaaacacttctcagacttttccccgtattcgtttttttttttttgaaagagtctcactgtgtcacccaggctggagtgcagtggcatgatcttggctcactgcaacctctgcctccctggttcaagcgcttcttgtgcctcagccaccagagtagctgggattacaggcgtgcaccaccaggcatggctaatttttagtagagacggggttttgccatgttggccaggcctcaactgatctgcctgccttggcctcccaaagtgctggaattacaggtatgagccaccacgcctggcctccccatattcttgaactcttactggattccagtttcacaaccctgctggtgacatttggctgctggtactaaatccatacatgaggtgaatgcttctgttttgtatttgtgcattcatccctctgcctagtttagatttccagtttagcaatttcacctaataccattgagcttgcagacttgtactggcttcacccactcctgtggcaccattttaccctcgtctgtgttgctgaggtggtaggtcaccagttgaactggaaaatctttttgtgatgcagcaacttttggttaaacgttttttctgggttttcatctgtggcagttacattgcacatctggttgctccaggttggattgtgggcatgtggggataggcttagaacctagatttatttaaaacttagggcagacacactgaagtattaatagtgcatgtttttcagtgggggactatgggcaatattttcctcctttcctttaggtttttttgtggcgttttattttgtcatgtcacgatgtatcttggctttggctgttgtaacagaatactacagattgagtggcttaaacaaacatttctcacagttctatggtctgaaaagtctaatatcaaggttccagcagatctggtgtctgatgagggcttgttcttaatttgaacatagccgtcttctcactgtgtcctcatatggcagagagtgagcgagctctctggcctcttcttctaagggactaatcccatcacaatggccctatcctcatgacctcatctacacctgattactcccaaaggccccatctcctaacaccatcaccttggggggataaaattcagtccatagcgctgtgtgtaatcaaaagaatatggttgttgcagtcaggaagacctgggttcacatcctagcactgccacttagtagctgtgtgactggccacattatgtcatctctaagtgtcacttcccatagggaactggggtgctgctgtctgcttcatagggttgtgggatccttagatgaaacagcacatgcaagtttccttcctttcatcattttttttttttttttgagacggagtctcactctgttgcccaggctagagtacagtggcacaatctcaggtcactgcaagctctgcctcctgggttcacgccattctcctgcctcagcctcctgagtagctgggactacaggcacccaccactacgcccggctaatttttttttttttttgtatttttagtagagacagggtttcaccatgttagccaggatggtctcgatctcctgacttcgtgatccgcccgcctcggcctcccagagtgctgggattacagttgtgagccacggcgcccggccctttcatcatttttttagacatggaggtctctctttgtttcccaagctggaatgcagtggctgttcacagatgcagtcatagcactgtagcctagaacacatgggctcaagtgatcctcccacctcagtctcctaagtagctgtaatcacaggttcatgccctcacgcccggctccttaccctgctttatcaccaaagtgctgtctgtgtggtgagtgccaaaggaatgaagaaactgaggggtaactgtctgcttgtgtgctttcagtgatctgcagaatgcagccgccggttccttcgcctctgcctttgctgcactggtgctctgccccacggagctcgtgaagtgccggctgcagaccatgtatgagatggagacatcagggaagatagccaagagccagaagtaagcaccacttgggcacaaacgtcaggtctctattgccctagtgtattggatgatttttcattttacattgtactaaagtggcagatgtggaagccaatttatctactccaaaatattgtttctagaatgctttcccctatcagagattttctgaaaggattggctgtgatgggacccaccacccactgcataaaaagtcttagacagatatttaataccccagaactggagaagccaggagcttaacaccctttttggcctcttggaaacataaggcatgatcttcagccatttttggaggtacataatgggtggcttttgaactttgccttagacctgagccttcataagtgccaatttggattctgagatgaatatttgatccccacttcaggtttcgtatgggtattcaggctgattgacccagatcctagaggtaactattcttaccccacttatccccagtccttcaagtgtacctgcagatggcccaagttctgagaacattaatcaatacttttataagcatagctactcttcagtgattaaatcactctctagctcactcttgaaaacacattctcattatcctttgagagtactgtttcatacacaatttgatttacttgaattggaaagcaatttattatccttattaattgcaaaacttgcttacttatcttgacatctggctgagttctgaccaaggatattgctgtggttaactcaaagcctataaatctgctgggaaaaagcagtagataaattgaccattttcaaggatcagtccccactcagtgagaatggggtttggaaaagtgccctattttctgcacccttgagattcattacagccaacttgaatctaatattcattgcctagaagtccaagagtgtaagtctttaaaactttttattgaaataatacacatagtatcatgaatgcacattgaagtcacagtatgcagctctataaatagtgacacaatttatgtgcctttgtaacctgtgtccagattaacaaatagaacattaacaacacccagaaagctgccctcatgttccttggaagtaattcaaggtaattaaaagatagtaatagttatatccaaaggacttaggcagatcaacaccttgaattatcagttgactttgtatttgaggtctagcagtgttcacacaaggcatggtatggtagcttggggctaagactcggattggaagggaggttaattgtgttgagctggattactttgttacattccatgtagcagtgctgcaggaagggctggctgatggggaatacctgacagtgtcttctgaagctctcagaaggaaaatagtttttaaatgtctgtggcctttattaccttgggacttgatccttcatctgtccaagccaagtctccttcttgctgagaacaaagtgaggagagagggattcactaagttgcactgagtatgtgatttcttggcctgttcttagcagggataaacctgccctggttgccctcaatcatgaaggggagtcagacaaagagtgtcctgtgttctggctgctacaggagcagggctgcttagaagaaattctcccgcatccctggtgctctgagaaataaattcttggtgcttctgcataacaggagctatataacttgttctcagaatttgtcttgtcttcagacaacatttactccttcactcatttctctgcactaaaaacagatcctgtaaacacctgaacaaatttcccaaaaacacaccagaaagattgaggaaataggaatcacagcgataagggactgggcaatacaatgccattttatgtttgctgagtttagataattccttactgtaaataaatttccttcccacagaaggatgccgttgagtcttaattcctggctcttcatttacaaaatcagcttcttccttactagtgcttgatcagatctgttaattggttgcaaatgcccttgtcttttcttccttcccacctgctgtaaccgtgctatctctctgtgtctcctcccagtacagtgtggtctgtcatcaaaagtattcttaggaaagatggccccttggggttctaccatggactctcaagcactttacttcgagaagtaccaggctatttcttcttcttcggtggctatgaactgagccggtccttttttgcatcagggagatcaaaagatgaattaggtaaatgtgtttgcattgacagcagtggggtgtgatggtgtttgctccctgcaggtatggtttctgtggattctctgccctttgtgctctcctccccacattggtggctccatctggcacagggaagcttctggatgcctgaaggtaacatggtggcaggcagttgatagcacccaccctccaggcctgataatttccttaggacagggcctgaagcagtacatcccaaactttcttactggaataaagttttttaatttttctggatctattttaggggagaagaaatccagaaattactttcccaattggggaatcacctataaataatcttgaaataaggttaaaacttggaaatcttaatagtgttttgagagcagtgaaaaccatagttctttgtagcttatcgtgtttagctggttggtacaactacatgcaatgtttggctcacataagtgagtttttcttaccatctccctcagtgtgtgttgaatctattctgtggttagtcaagctcccagacttaattgctatgtttaataaaaacaattttggcttttaatgataaatgaagaatcagggctattaaaatacttaagagtgagaaagttgaaaaaagacatagattgtgtttggcctgtcttctccccactgtagggggttgccactcagctggaggcctgctggttcgtgtgggccagcccttgacacctcagtgaccaagcgaaatataaccctcactaaggcttcttgtacttggcaagacccaggagtagacctgggctaccaaacaaaaccctgtgttcttagagcttgggaacaagagctttgacagttttcctcaaagaattgtattctgtagcattagcatttttattttcatctacctgcagccattactacattgacctctggaaatgtcacatcagctgttcttgagacaaaataccatttgctattttttttttctctaggccctgtacctttgatgttaagtggtggagttggtgggatttgcctctggcttgcggtatacccagtggattgtatcaaatccagaattcaagttctttccatgtctggaaaacaggcaggatttatcagaacctttataaatgttgtgaaaaatgaaggtgagtaaatacctgtttttcaagcatctatatacatcttaaaatctgagatacgggccgggcgtggtggctcatgcctgtgatcccagcactttgggaggctgaggcaggtggatcatgaggtcaggagatcgagaccatcctggctaacacggtgaaaccccgtctctactaaaaataccaaaaaaatcagccaggcgtggtggcaggcacctgtagtcccagctactcgggaggctgagacaggagaatggcgtcaacctgggaggcggagcttgcagtgagctgagattgcaccactgcactccagcctgggcaacagcgagactctgtctcaaaaaaaaaaaaaaaaaaaaaatctgagatatgaactctgttttgattgtaaaaagaaagaggacagtaacacagaaactttgtgtcccaaatagaggacagataccttgtctgttactcatagtaatcctcccttacatttgtataacatgtaaagttttacaaagtacttacacctcccttatctaattcaatcttcataaccaccctgggcagtactaatactatacacaggtctccaacttcaaggttggtgttcctgccactgcccaggtgaagctgcaaagctgctgccacctctatctccatggttgcctctgtctggccatctcaggcctcagctctgccccatccatatactaagagttaaccaagcgtggaattggggtatgttacctgagcatcagtcagttttgccaggagacctgatacttgtccttgtttccattagtctatttaggaaaagctgggaatgcatccttctatgacttgttggtttttagcactgttgtctgggtttgcatgtgtaaatatacctatgctatgcagctgcgtgggtatccccaaaggagggattgttgcagtctttgaccgcccttttatttgctaggaataacggccttatattctggactgaaacctactatgattcgagcattccctgccaatggagcactctttttggcctacgaatatagcaggaagttgatgatgaaccagttggaagcatactgaagtgtcttggtgggcctgagccaagcacaggtgtttgaggactacagttcatctcagggtttcttggagtacaagaccagtgtgaagttattctgatttcttgggaattttgctttttgtcttcccttctaccctacatcttaaactttatggaagaacctctattttgcatcatatcatttctgtccataattgtactgaaatagaaaagtgaccgctcttgctcttggtaaaatatagagtggtcagtagccttatgcacctaattcaaaaggtggaatatagttctgtcagggcttttacgtaaacctccacttgtacatgcaatttggacagttatgtgttgagggaaatacagtttggtaccttgtttatttcaaatatcagaaaaacccagaggtgatcatttctcatgaagatgcttataaatggttgcttaacccattctagatgtagggtctgcttaatgtgtgtacttttctaagtggttgattattttttatttttttgatacagagtctcactctgtcacccagactggagtgcagtggcacgatctcggctcactgcaacctccgcctcctgggttcaagcgattctctcacctcagcctcctgagtagctgggattacaggtacgcgccaccatgtccagctaattttttttggtattttttgtagagacgaggtttcaccatgttgtccaggttggtctcgaactcctgacctcaagtgatccgcccacctcggcctcccaaagtgctgggattactggtgtgagccaccatgcccagccagtggttgaattttttaaaaagtgttcatggggtgcttgaaaactaaaatatccttctagatttgtaagacagtatacctgcatactggtgtggcttccacacttgagtaaaagcttcagagtaggtatcctagatttccccaagatgctctactcttaaaatagtgccattcattttctaggtgggatcatattccacgctgactatattgctaggggtggcccagagggtcaggcctttgggaaatagcatggcctttaccagcttcccttctctcccaaagaacttcccttcttgggctttagattgaggaaggggctgagtggtaggcggtgctgctgtgctctgatgaagacccatgtggctagcaacagcgcttaccttttgtctctgggtcctggcctggggccatcaatccactttgggccactcactgtctgctctgcctccaccaatcagaaacccttccaaggaacagtgagagccaaagccaagagaagccttcttccctgtttggtgattgtgtgacagtgggtgaacctctctcagagagaactagaaagaactcagtgcttgtactccacagtgagtaatgtcaggtctgacccatcctgaagcctgtcttgccatgcttttacagtgttggaggcttctacatttggtacttgcagtcagtaagtcttaatgatgactgtatatgtgatatgagtttataaagcaatggaacataagaaaagcaattgtaggccaggcgcagtggctcacgcctataatcccagcactttgggaggctgaggcgggcgggtcacaaggtcaggagttcgagaacagcctgaccaacatggtgaaaccccatctctactaaaaatacaaaaattagctgggcgtggtggcacgtgcctgtaatcccagctactcaggaggctgaggcaggagaatcgcttgaacccgggaggcagaggttgcagtgaactgagattgtgccactgcactccagactgggtgacacagcgagacttcatctcaaaaaaaaaaagaaaagaaaagcaattgtacttcactatgccatatgtatgtattcactgaccaaaaattcactgaccaaccaaccaaactccacacttcatctgatcccccatagacttggggatggacagctgttctttggccatatggtataagaggatcattcttgtcactacttaagttagcctcatcattttgtgctgctccaacaccagcagggtatctcccaataaagtgttcctaagcagcctgtatactgagtgcaagcaggctatcaattttaataatagtccataccatgtatgtgtttctgtcagcagaatgtacatgttgtacaaaacctccaggttccttaagctttttgctgtccatgaatcctctgtggcaactgtaatcacagagccagaagccagagggccagggatatgagaggctgacaaacatcaggggacatctggggaggagatccctgtcatgtctcttgtgccatggagctattatggctggtcttccatttgctttttctttaagtgaaaaccatttttctactttgcttttctctccatacttaaatggtcagtagctactgagtggtgctttatctgaataggcctggatcgaagtaaaatagaaatgggactggctttccacaggaagtaaactgcttcagagcccacagtcccctgctcagtgtccggaaagaagtcagtcatccctgttggcagtaaatcttcccacaggccgtccattagagatttaactagatatgttcaatagaaagagtctgaggcaagtggaaatgaggaacggaaacttaggttgggagaatattttttttttattcattctgtttgcttaattcagagtacagtttgtgctatttcatatctgtactccaggcagaaatataacttgaaaatactgtgtctaaagaaatttcagtgttctatcatt

SEQ ID NO: 38419 - DNA, 8786 bp, Homo sapiens
gggacgagggcgcgtgggtgaggaaggtcaggtctaggtaaggctgtcggtgactttgggggtctgcagcaaggggcgatggctgcgaagtctacgggggtctccaaccttgtagagtcgccaggaatagggcgaatccacttcattagtgaccagctcgggcggttcacgtgcatcacacaaataacttggcctttttctgcctcagttgggggatttcttaaacgtagaatacccgcgtttccgctgccgtaatttcctctcaggcgcaattactctcttccatattggttaacagtagaaggctcagtttctctgctcatcacacggccttcggcactgtagctttgggtggtgggctgcagattaattttgtaaccaccttaagaaaaatacggtaaggtgatatttaagaaaaatatttgcgaaatgcgctcccgagtcaaacatcggttgacttgacaatactacagtttccatcacagtcaggcatgatcgagtcaggtggagggagttgaagattgttcttgatgaactgaatgcagctaatacattttcagtgccgttgatgcctctatgactccgtaaaataatcggtaccgggtttttttgtttttaagcattctgttgagattgtttttatgtttagattgtttctatgacaacgtgtgtacactgtatgtgaattccttggatcctgatggttattagggtgggcactgtgccgtgaattttgcatattagcttcacatcgcagatagtatgactgtcctcgtgtagtcgatgagagaacctggcagagaataagcaccattacaaaaacgacgtggccattaaaaggcagaggcgagattccaaccagcttttttattctgcagctggtgcgttctgctaaccaatggtttttgggaaactggagaaagctctctcccagaacaatttacacacacacatacatacacatatcggcatacagatgtacacttccactgttttcaaaacgctgaagcacatcccggttaagaactcttgcacttcatctttacctttcaaagagaaaaggcaaacctaatacaaagccacttattgaaataatcttttaaatgcatcagacctatcaaaaagatcaaagaagtttgccctgttatgccaaagtaaaaatatgggaattttcttctcatgtgggcttaatttgttttgctcagcacatttgagtaatttgtttttgcttagcattttcagctccagttaacttttttcatgagagtacagttttctttagttcacatttaaagaaaggtaacacttaaagtgacttgtactccccgagaatggtttcatgtgaatcaaaatgtaattgacatgcacgttgtaagaaaagctcccgtgttattcttcgtgagagacatgtgtctgtgcactgtggaaggaaacaacaaagcagtgtcattggtaattgttaaaaccactttcagtttcctcctgtttagcaagtgggcctttgtttctagtaagggattcaggtttgaaaaggcttattccctttctctgtcataaaactttaggacttggattttatgatataaccatgttccagcctattctagtgtgacctttttacttacaagttatgtatcccagtaatttgccacattccaaaatgggcatggacataacagcagcatcctgtgatggcttcagtgactactgtcctactgagtcccttcctcctcctggctatcttgtcaagttatcaaggtgctggtcctctccctatgtttctctggctgtcagtctttgtaaatgaggtcatcattccagggaggcacaaagtttttactatatggagtatctatctgtctgtctctctctctttttttttttttcttaaacatgattaagaacaaggaataaacaaatgtgtctatgtagaatatatgaaaaccaaacttacagatctgggctcgttcttttttgtaagttaccatttactactcagtgccactgttactcattttcgcactagtcatgcaagctttgttttcagaaaaggagactcagagaagatgagtaactgttcacaataacccaaggattaagtgacagagccagtagtcaaacctaggcctcaggaatccctgttgcctcttcattgacaaataaagggacttggaattcagaacagattttcctgaaaacactgtaacaaactgatagttcccataccagcttacagataactaactgtggaaatactgtgcaattacagcagaaatatattctgatgccacaatggtaattaagcaaacaaagcaaagttgatgaagcaactattgttttttaatctaatgtttggaaaaaggtaactttaaagggcaaaggaagagaaaaagcatgcaaagaaactaggtgactctggacatttgcaaggctttttagaggtttatggcactgatttgtttatacattaaactgctaaatgaatttttttcaccttgagactataaccctagtcctaacaaccccacccccaaccagagttggcaaagaagtgaatcaggaaactgagaatgctgaatggaaaaggaagaacaggcttgtaggtgatctgcagatggtggggagggaggggtggacgttggatctgacagttctaccgttgccagccttcaggtggcactattgacccaaaattgcttggttggtgttctgaatggttttgaggttgacagtggtttgagatcagcctctgctttttttttttttttttttttgacacacaatcttgctctgtcactcaggctatagagtacagtagtgcagtcataacttagtgtaacctcaaactcctgtgctcaagtgatgtccccctcctcagcctccacgagtagctggaactacaggtgtgcactaccatagcagactaattttcttattttcttttgttttttgtttttttttctgtaaaaacaagatttctccatgttgcctgggctggtcttgaagtcctgacctcaagcgatcctcccacctcagcctctcaaagtactgggattataggcatgagctaccatgcccagcctcctctgttaatggatcttgaaacaggcattaaaacttccttaatttaaacacggtttgttttcttacaagaactattttgaaattcacttggcaccatttttatgtaggagggtttttggtacatttctcccattggtttttcaaagtttatgcctttttcctgcttgaatatcagcaccttttcatctcagctgaactgtttcccaggatagtctctgagtcagcaaagattctcatctcactactaaaatttctcataaattggcatattctgccaacaataacccctacgtctggtctaaactgagttgagatagttattccaccagcagctttcttgatttttatgtatcccctgtatagttttttatgtctgttagctgtaattcgtgcatatcacggatatcattcttatacccatttcagtgttgtatgtctctgaagaaaaagctactgtttccagctgataagaacttaggtagtttgcattaaagcagaatatataagatggaggatacagcaagtaaccttacaattcatacgtgccttctatttagtaagaaaatggatcttttgagctattggatttatttttatagggctactgtctgtttttcccaaatggctctcagtctctaggcaaaattcagttcagtaacctagaagccaaatgacctcataactcattagcagctctcagagccttctggagcccttgaggagaacagtgttcaaaggactgatagtaaagacaacataattatgtctctgccatgattacaccttttgatggcaagcagtcagcatattaatgctgcagattgcttaggtgggtgttttctgaaggtataatgatgctggattaggataacttgtttccctgtcttcttcatccccagcctacaaataggtaaactgactgtcagtaaataacctggtgaatcacaaaatagttggttgcaaaggaggcaatacagcaaggaagtaatagcatgtaaacacgaagtgcaaaaatcgcagctgtaaagcatggaaaggaaatagccatttggactgtggatacttctccactccaaggcatatcctgccaacactgcactgatccatgagtggcttgctgtgtttgcattttctaacttattcattagctaatcttggaatttcttaccctaacctgtttaactttcttctcattttcaataggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacaggtgatgacaaacacaaagagggacctatgagagactttttttcagtagatcagaaaaggaaaaaaattagcctttctatccttgtagttttgttcttataatagagcccaggtagttcaaaaggtacagttggcaggagaaagtcttctttcaaaatacccataatggagagaccaaaaaaaaaaaggaaattcatgcttgttggaagatatattttaattatgtctacaacatgactaatgttgaatagatactgagctgtagagaggtgtttaatcatttgttaatctaagagcactctaaaaaggatgccaagaggccaggcgcagtggctcacgcttgtaatcccagcactttgggaggccgaggcaggcagatcacgaggtcaagaaatcaagaccatcctggccaacttggtgaaactctgtctctactaaaaatacaaaaattagctgggcatggtggtgcacgcctgtagtcccagctactcgggaggctaaggcaggagaattgcttgaatctgggaggcggaggttgcagtgagccgagatcgcgccactgcactccagcctggcaacagagtgagactccatctcgagaaaaaaaaaaaaaaaacaatgcagagaaaaactggtccaagtactgaggaagaaagcctcagaaacaccaaggttgccagggcagtgggctcttgttatcagatgaacagagtccctgaccgacacctgatctgctgcttaactggtatgtgggagccttctttctcttctggtggcatttttgttgacatttcttcctactgtcttctggcatttttattttgtaccctttttgacatattaatttggtctagataagctgtagtttgcctttaaggataatacgtaaatcacacaggttcttaacaccatgtgtttgtatgtgtgtgtatgtctagggagtaggtgcttagaactgtgtgcatctctgaaaaaaaaaaaaagatcaggccaggcacaatggctcaggcctataatcccagtgctttgggaggccgaggcagacagatcatctgaggtcaggagtttgagaccagcctggccaacatggtgaaaccccgtctctactaaaaatacaaaaattagctgggcgtggtggcacacgcctgtaattccagctacttgggaggctgaggcaagagaattgcttgaacccaggagatggaggttgcagtgagtcaagatcatgccactgtactccagcctgggtgacaaagcaagactctatctcaaaaaaaaaaaaaaatcaaatacctgtgtgatctttctcattaaattatttttttggccaggtatgatagctcacagctgtaatcccagcgctttgagaggccaaggcgggcagaccacttgaggtcaggaattcaagaccagcctggccaacatggtgaaaccccgtctctactaaaaatacaaaaattagctgggtgtggtagcacatgcctgtaatcccagctacttgggaggctgaggcaggagaatcgcttgaactcaggaggaagaggttacagtgagccgagatcgtgccactgcactccagcaacagagcgagattcggtctcaaaaaaaaaaaaaaaaattatttttttaattaccaaactaatacatgcccattacaaaagaattcaaatagtacataattgtataaagttaaaatacctaccatctttttaaaaatttaacaagttgtaattggagttgtctttgggcaacaatactaaaattattgggaaccatttattctaatacaatagaattaatagtacagcacaacattcattgcagatcactaaagattggtacattcactatccagtggatatttcttacgtaccttccacgtgcaggcacttaagatggcactaggggaacagcagtgaacataatagatgtgcttggttaacattagaggttacaatctatgacatgttttgaatgtttggaattgctttgggactacctctcttgccattagtctgggctcagaaaataaaaactaattttattataacccaaaataaaatattgggaggcagatatcctgaggagaagattataacccatgaaaaaatcacattcagttattttaattgatctttttgctgctgctgtctgtttgtttgaaaaataaagacttaactatctttggggacagggaaaaatagttatccatagaaaaacaagattattttcacgtagtcactaggtatggtaaatgatacctctaatgctaggcctcctgtggcatcaggcaggatgaaactagacagtctccaataaagaaaatattattcagagatctgcaaaagagggagggaagcaccagttctcagaaacaattgattcattcagttaaccaggtacctagcttgtatcatcaacagagacagagtcgccagaaagctttctttctgtccaacggttgatgagaatgaaggagggacagaagagggggaaaaaaaataagtaaattataggatctgttacaaagttgaacatgctgtggaaaaaaatagtagagccggctgagcaggatccagagtgctgacggggcctgcagtaggtggggagaggctagattacaggatgaaacaggacagtcagggtcagcctcgttgaggagttgaggtttaagcagaggcttgaaggtggtgagtgagccaagtaggacttggggaagagtttgcaaggcagaggggcaagagcacagcaaaggccttgaggtgggagtgttcctttccaggaggcgtgcaggtaccgggagggtgtgggactggagacggattgcaaggggctgtgaagccatagtaaggacaatggcatttgctctggttgaaatggggaactatttgcagggctatgaacaggagtagcatgatctgacatatattttagaagaattataccagctgcactgttgagaattatttggggacactcaccactaatcccaaagagttgtatactgtccatgatgttcatggatagcctagagagttaaaacttaagctcagcacacccctctcttacatttgattcatacactgttattatccatactttacaggttaggaaactaaggtgcagggaggtaaggccacttatccaaggtgacagatctagtaaatggtggagccgtgatttgaacccaggttcacatggaatccagagcttacatgtttaaacaccataccaatctttaggtatctgggcttaagatgtggacttttttttataatataagcaatcatcaacttctgtgccatccacatacttacgtagtcctggctgctttgattcctttagtatctgtcttttgatttggcttccttctgcctgagcctttccccagcagcctttttgtgtgagttacctgctgccactaaggtttcaccatgttggccaggctgagcttcctccagacctcaccccattctgagtagatgctagttcctagggcagtcagggtctctgtgtagctattgaagcagattcccactttgtctcctctctgtttagtcttagtgttgcagggaaatttggggtaatcattagtattgtgtcattgttatgtaggtttatgtaggctggcctgggaatttccctgcagcttgtggcagtgtttctgtgaggggaaacggacttacaagtgaacttttggaatacaccgcatctctgtgttagggactccctatactttttgttcaccaagctgagcatgtggctaacttgtaaaagtcaaagatcgataaccagaatgacctaagagagcagtgcgtgctagattagtgtacttttctactcgtaaaaataactggttaattattttttccttcttcattcagagatgagcatcaggattttatggatgagcaaaaacgactaaagaagcttcgtggaaaggagaaaccaaagaaaggagaagggaaaagagcagcaaaaaggaaatagtgttggtccctcaagagggagactttcttcctcagtggcggagagaagaaagtgcatttattgtctttccacctattggaggaatgtcatcttcctaaatgaagtttatttggaggaacacagtcatctccttggtgaaatctaatccggttacattgtggctggtttcttgaacacattctaactgtgcaaaattatcttggccttggccgtgtaatgtgaggtttacctgattctctaatgaaataaatacctaagttattgtttg

SEQ ID NO: 38420 - DNA, 43218 bp, Homo sapiens
gtagagtcttagggtgaccccagggggacgtaatgtttccgagaagaaggacagaaagaagactgggagacaccggaactcgaaagaaaatcggtaacaaaatgtgggttcggccaacagtgccctgtaggcctgaaatttcggtctggccagagcaaggtgattgagagggcgggggttcgggcctagcctgggcttgagctgtcctttgtgtcttgagcggatggtggggccgtggaacatgaaggagtatctttgtgtacgttcacaacgttcacatcggtgtaggccaggttgctggactctgactcaaagtgttatagaggcattacgtattgtacccgcagctgcagcctaagcgagctgcttcagcttcctagtcacaggatcccacgcgagaatagagccataggttagcgtcgcaggacgttgttcgcccccggatacctcacatgcagcctaccctagagccagtcatttcctattgtgtgctgggggaggagggagtgccctggtgtaggcatttggaattggaaaattgagctcctccccaagctctgccactgattggttggtaatcttggccagtttacaactttgctttcctcagctgcaaacagctcagagtgcctctctgggctaactcagagggtaatttcaaagattataagataatgtaagtgaaagaaattgccagtttataaaggtgtttggggaaaaaaaaagacgaaaatgataggtaccttgatagaaaagcctgaaaagtctcaacatatttccttattccagtgccaggcacattcctgtatctaaaagcttaatgaatggctgcatggttattaaaacaatattaggagatttgacaacttaggtaatgtgattttgtggaatatctgataggatagtttcagctacaagtaacagaaaacccaccgaaaggatgttcaaagagcagttacaggttggttaattcggtggcccagtgacaacatcaaggtcccagtgcttctctgccaccctaagcatgttggtaacgttgacaatagaatccaggtaaaatatacagacatgtattgtgtcatgtacccatcctaaactagttattaccaagaataaataattgtttggggcccatcatgcttcagcccctgtcactaggggaaggacctagcctcccttgataatctacctgcacaaaattagggctttgttacaaatgaaaaaaagagatgtggaaaataagttagataagaaactagcagtatctgccacaaatgatatctcttgacagctaactaagagctagaccttgtggggatggatcacaaaagaggtagctgtgaagtcccagtaaaggtgcttccaggacaggtggaagaatggtaagaacaaacttgcctacaggctagaccagtccaaagcatatatgttgaagaagagctaatagcctgtatatgaaggtgtaagtaaaggagatgttcatggttgagtcactgtggtgttcacgtagtcatctttcccttcttggtttgtgcttatctcttttttttttttttttttgagacagtctcactctgtagccagactggggtgcagtggcacaatcctgactcactgcaacctctgcctccggggttcaaatgattctcctgcctaagcctcctgagtagctgggactacaggtgcccgccaccacgtccggctaattttttttttttgtatttttagtagagatggggtttcatcatgttggccaggatggtctcgatctcgtgacctcatgatccacctcggcttcccaaagtgctgggattacaagcgtgagccaccgcgccccgcctatttaatgctattcttacatcagcactgtctcattgtggtctgagattctccttatctggatttgtggctctttcaccaagaacaagagactcccgtggctctcttctttaaatcctgttgccataattacaaagaaataaacacagtttccaatgctttgaaatgaagcatgtggtattaactcagtggattaccagagagagagggatatacctgaaatgggagaggaaaaaatcttccctagactatctttcctaagagccatcaaaactataaacaagtggacaaagaaggaggaagcttgaaagctttatcttcctgaaaataaagagatgacatacaaagtccaagatagaccaagattgaaaaattagaccacattatatccctaactcaattttgtaaaaaatcacaaatgcttgactgtatacccactatatgttcaagtaacatgttttaatcatcaaaatttaaaaatccttccacgacaatcttttgcaagtttttccatttctgtctttaacatggtaccagtaataacaactacaacctgtttgtattgaaattatttctatagcccagcatctgctttctctgaaaattatctttttaaaaatagtaaaactaacatcattacaaaagtagtatatgtgcatttcagaaagttaggaaaggctgggtgcggtggctcacgcctgtaatcccagcattttgtgaggctgaggtgggcagatcacaaggtcaggagatcgagaccatcctggctaacacgatgaaaccccatctatactaaaaatacaaaaaattagccaggcgtggtagcgggcacctgtagtcccagctactcgggaggctgaggcaggagaatggcgtgaacctgggaggcggagcttgcagtgagccgagatcacaccactgcactccagcctgggtgacagagtgagactctgtctgaaaaaaaaaaaaaaaagaaaatacaggggaaaaaatggcaacacattcctgtcacccagagatcaccactatttactctttattatttgtttttttttttttgagacagtctcactgttgcccaggctggagagcagtggtgcgatctctgctcactgcaacttccgcctcctgggttcaagtgattcttgtgcctcagctaccagagtagatgagatgatgggcagatgccaccacaaccatttaatttttgtatttttagtagagatgcagttttgccatgttggccaggctggtctcaaactcctggcctcaagtgatccgcccatgtcagcctcccaaagtgctgggattacaggtatgagccaccgcacctggcctgctcactgcaacctccatctcccaggttcaagcaattcttctggctcagcctcccgagtagctgggactataggtgcgtaccaccacacctggcgaatttttgtatttttagtagaggacgggttttccccatattggccaggctggtctcgaactcctgaccttgtgatctgcccgccttggcctcccaaagtgctgggattacaggcgtgagcccctgcccccggcccctattcttaagtatatatcttttccctagtgatttttatgatgatgcagctgtatattgaaacggaaagatactcatttttgggagtaaaattggttatgaaacaaaaacaataacaaagttgcttttgaagactatgcgttaaaatggtagtggtagttatatttttaatttttatgggtacatagtaggtgtatatatttatgtggtacatgaaatattttgatgcaggcatgcaatgtgtaatcacttcaaggtaaatggggtatcttccctggcgatgtttaacatgatttccagaatgaattgctcactacgtttggtgtgttttccattcccagatggtactgccttttaaggtctattacttaaacataagtatggctctggttcttaccgcctttaccgtatccttcatgggaagttgatactgatcggaaactgacacagagccttctcacctacactaagggggcctaggtaagcaagattatctttctcccaacttcagcaagaggttttcttactggtgttcagaatgcttgattgagcagttagaaaactgttgctacctagtctccagtcttataaggggacaatggctgcaagtcatgcctgcaagaacaagaggctcacacagttttgaaattagcacaacttctagctggataggagtctttttagtttcatttagccttgagttgaaactaataggagtcttttaattagaaaaaagctcagggctctaaacgtaccttcaacatgttaattctgttaccaaaaactggcttggtctgtgttaactcccaacagaattctttttcagtcactgaggcagaggtgcttccagagaaagattcttgacctactcatactgaataattatcgttactagaagctgcaaccaaagactcctggagggtagtaagaggtacagagaatgcaggttagatacagtgaggacagagaagaaaggatgggttggaggctgggcgtggtcactcacacctataattccagctactttagaggctgaagcaagagaatcacttgagtccaggagttcgaggctgcagtgagctagcattgtgccactgcactccagcttggatgacagagcaagaccttgtctcaaaaaaaaaaaaaaaaaaaacatgggttgctttgtagtttagagaactacatgtttagatagttaatttttccccaaaagggcccatcagattgatactctgagatccagggtttgtctgacactcattagcctatgagttgtagagatgggatggccaggagtgaagtgatggccttgtgtctttctcccctgcagcatacagaaaggctgtacctggaggaaggaagtgcggagccagcctgagttgggagaagagctccagagagtgagtcaaagcgctctgtgtcctgctattaatgatgccctcatagtcagaggaagcctacttaagtgaaatccatttttgacctgtcaagtattaaatattctcttaatttttagtactgaatgatagaaggcgcctagtgaaacaaatgctttcacttttttgctaggagggtaaatgagtatattcttacgttaggtacacagggatacagtacaagtatgccagcctctttaaactataaagaagtaaacaagatttggtttaagcatcagtctcttgtgagtctgatgggtaagcccagtctcagggcacactgacaatgttagtggagaacgagactctcccagtgtgctgccctgaccctctgagattggtctgtgtagccacgtggtggtcatcctgtgccacctctggtttggttctaatcaaaggaagcagtatcatctgtggtgatccgtcttacacacttgcatcattttataccaaaggagaatttcttttgttaaaaatttatttttcattatctactcataaagaaggagccaaagggctgggcgcagtggctcacgcctgtaatcccagcactttaggaggtgaggcgggtagatctctggaggtcaggagttcgagaccagcctgcccaacatgttgaaaccccatctctactaaaaaatacaaaaatgtagccgggtgtgctgggcgtggtggctcacgtctgtaatcccagcactttgggaggccaaggcaggtggatcatgaggtcaggagatcgagaccatcctggctaacacggtgaaaccccatctttactaaaaatacaaaaaattagctgggcgtggtggtgggcacctgtagtcccagctacttgggaggctgaggcaggagaatggtgtgaacctgggaggtgacagttgcagtgagccgagatcacaccactgtactccagactgggcgacagagcaagactctgtctcagaaaaaaaaagaaaaatttagccaggcatggtggcgcccaactgtagtcccagctactcgggaggctaaggaagaagaattgcttgaactcaggaaatggaggttgcagtgagctgagatcgcaccactgcactccagcctgggtgacagagcgagaccccatctgatatggtttggctgtgtccccacccaaatctcatctgcaattcccatatattatgggagggacccagtaggaggtaattgaatcgtggggcaggtctttcccatgctgttctcatgatagtgaataagtctcacgagatctaatggtttttaaaaaggggagtttccctgcacaagccctcttttgtctgccaccatgtgagacatgccttttaccttccaccgtaattgtgaggcctccccagccacgtggaactgtaagtccattaaacctcttttttttgtaaattgcgcagtctcaggtatgtctttatcagcagtgtgaaaacagactaatacatcgtctcaaaaaaagagaaaagaagaagaaggaactaaagaagaatttctttggaagcaaaatatttggaagcaaaatatttggctcctgactgaaagggttttgatccatgcatacattaataaacccttcagaaccatgagttgggataattcactgtcccttgtgctagtctcatggagcttttctgctcttctgggagtgctcctggggtggtctggaggcctctcaggcagagcagaggctggtcagcaagccacagggcttgccatgaagtggtttgttcatgatttgtttctgggaccctgggaaaaatgttctcagggtctgcctaggaaggctggttttggaagcttgtggatttctttctgggtgagtcaggaaagttgtgctcctgctgggcgcagtggctcatgcctgtaatcccagcactttgggaggctgaggcaggcggatcacaaggtcaggagatcgagaccatcctggctaacatggtgaaaccccatctctactaaaaatacaaaaaattagccgagcgtggtggtgggcacctgtggtcccagctactcgggaggctgaggcaggagaatggtgtgaacccgggaggcggagtttgcagtgagccgagatcgtgccactgcactccagcctgggcgacagagtgagactccgtctcaaaaaaaaaaaaaaaaaaaaaaaaagaaagttgtgatccaagggaaagcatacaggttttaatgatgaactagtttgttcctttgtctcctggctttcattcttcatggcatgtgctcagggcagccagtggagagaggcatcattctgcatggtatagaagccttgggtgggtgtttcatcatctgtaaaatgaggacaacaatactgaactttcaaggccattgtaaattagaatgtacagtacaagcattgtaagttagaagtcaattagaacatgcaggagggattataactcagtgtttagcgtatagcagacacttagtaaataatgcatttactctgttccattctagaagctccattgttgtttgtacaacaaacacctctgttgcagtgcttatcagattgtcttgtaatcacgtaactcctcaaaggcaggatgtgtgtaataacacatttccttggtcaccatttgtacccagaatggggaaggaagaaatgaaaagaatccagtatctaagcccagcctccatttcacttgcacgccttttatttatgaaaatatagtacttgtccatgtaaataatatctctgaatggataccaggaaaatggtaagatgagttagctggagaacttgggtactgagttggagggagggtaacttatttttcaccaatgtatccttttgttttgctttaaaataatttaccacaggcatgcattacttctaaaaataaaaatgtttactgtcagaaaactcccccaagttaaaccaaaaccaaaatatgttagatacatctgtaacactcattataaaagatgacatataaatgcctcaaaaatagaaaaggtgatcaaacttactgagaaatgtgcattaaaacaatgagacctttttcagttagattgcagaaaggtaaagaataatacctggccaggtgtggtggctcacacctgtaatcctaacactttgggaggccaaggtgggtggatcacctaagctcaggagttggagaccagcctgggcaacatgacaaaacctcgtctctacaaaaaatgcaaaaactagtgaggcttggtggtaggcgcctgtactcccagctactcgggaggctaaggcagcggaatcacttgagcccaggaggcagaaattgcagtgagctgagaccacacgactgcattccagcctgggggacagagcaagaccctgtctcaaaaaaaaaaatgagcatggtggctcacaccagtaatcccagaatcccagcactttgggaggtaaggtggtcagatcacttgcaccaggagttcgagaccagcctgggcaatatagtgagactctgcctctacaaaaaataaaaaattagccaggtatggtggcgcatgcctgtactcccagctactggggagggtgaggtgggaggatcacttgagaccaggaggttgacgctgcagtaagccgtgatcacgccactttactccaacttggatgacagagtgagaccttgtctcaaaaaaattaaaaaagactaattccctatgttggtgaggctgcgggccatttgccctgctgtagtgggtgtagagtcttcacactcttggtatgagaataaattggtaaaactttctggcaggcaatctagggtttgtttccaaagttaaatgtggttaattaaaactaattttacttatgcctgtaatcctagcactttgggaggctgaggtgggcagattgcctgagctcaggcattcaagaccagcctgggcaacatggcgaaactctatctctactaaaaatacaaaaaattaaccgggcatggtggcaggtgcctgtagtcccagctactcaggaagctgaggcacgagaatcacttgagcccaggaggcagaagttgcagtgagccaaagattgtgtcacactccagccggaggggcagagcaagaccccgtctcaaaaaaaaaaaaagaatgcttggttgagcatggtggctcacaccagtaatcccagcactttgggaggtaaggtggtcagctcacttgcaccaggagttcgagaccagcctgggcaacatagtgagactctgtctctacaaaaaaatgaaaaattagccgggtgtggtggtacgtgcctgtagtcccagctactggggaggctgaggtgggaggatcacttgagaccaggaggtcgacactgcagtaagccgtgatcatgccactgcactccaacttgggtgacagagtgagaccttgtctcaaaaaaattaaaaaagactaatcccctatgttggtgaggctgcgggccgtttgccctgctatagtgggtgtagagtcttcacactcttggtatgagaataaattggtaaaactttctggcaggcaatctagggtttgtttccaaagttaaatgtggttaattaaaaataattttactcacgcctgtaatcctagcactttgggaggctgaggcaggcagattgcctgagctcaggagttcaggaccagcctgggcaacatggtgaaaccctgtctctactaaaaatacaaaaaattagctgggcatggtggcatgcacctgtagtcccatctactcaggaggctggggcaagagaatcgcttgaacctgggaggtgtaggctgcattgagccaagatccactgcactccagcctgggcaacagagtgagactctgtctccaataatgaaatcatgaaaaaaaatttttttttttgagacagagtttcgctctcgtccaggctggagtgcaatggcatgatctcagctcaccacaacctctgccttccaggttcaagcgattcttctgccttagcctctcaagtagctgggattacaggcacgcaccaccacgcctggctaattttgtatttttagtagagatggggtttctccatgttggtcaggctggtctcgaactcccaacctcaggtgatctgcctgcctcagcctccgaaagtgctgggattacaggtgtgagccactgcacccagctaataataataatttgaaccaacattctaggcattttccctaaggaaataatcagaacgtatgcagatttgtgtacaagattgtaagttgcaatattgtttttgacctgaatgtgtaggtttcagtggggaaacctgatccccagtccctgctctcctcccaccccaaccccatccatctactacctttcccaaatagagcttgcgtagggccattggtgtccaggatccagagcagggcatgggtttgtgggaggtggtggttggaatcacctggggttggatactggacttagttcctctatgggtaaatgagagcctggggattgtcggaaagaggcctagggtgaaaattaaaatgacttaatttcaggagcagtcttggccttggagattcatgggacttaagagaggaagggcagaggctgaccgtgtagatggtagcttgttgctctacctgggccagagaagcctgcttgcctccctatctccaaggctgaaagagggttgtgcagctgaagatacaggaatttaggatacaggcaagtgccatgacctggcagcttggtatgtcgctacactgcaggagcctgctggcttcccaccactgggagtgccgttaggtgtctgtgctagacccatggccagagggtgaaaggaggcatgagtaaataggcaagagaaaagcgataatatgctggaagaggccttagagccagagggagaaggagcagacagactctcataaataaggagttctggtgaaacagaatttctgcgagagattcaattatagcaaaactttatggaaccaaaaagcttaaaaaaaaatcagaagtttaatagataaactgaaggagagaatggtcagcacaaactgagtagcctgttagatcaagtggaagaaacactcaaacacagcaaaaaaagagagagagaaaggaaccatgaaagcaaagaggtggaggaccaatcagccctgaagtcgatggtgatcaacccattcctgaaccatccctgtgaccggcagatgtccctctgcttgacttgcttaggcaggggtcctctgaactcatcacagagccaagggagaatgggatgaccttaatgggttaaaccagttagggaacacactggaacaaggggtagagtctgtgccacaaacacaaagagaaagggtggaagtttttttagtgtacaaataaccttgaatatctcctgtagtgacacatggtgcctaaccgaatgaaccgttgtgaagataaatgagatcttgcataacatgtttaacacaatgcctcacacataagccgtggagaaatagttattttctcatttgtgttttaaaggagtatttttttcttttttgagactgtcactttgttgcccaggctggagtgcaatggtgcgatctcggctcgctgcaacctcggcctcccgggttcaagccattctcatgtctcagactcccgaatagctgggattacaggcatgtaccaccatgctcagcaaatttttttttgttgttgtatttttagtagagatggggtttcaccatgttggccaggctggtctgctggtctcgaacctcttgacctcaagtgatccacccgcgtcagcctcccaaagtgctgggattacaggcatgagccaccgggcatagccaaaaaagagtttttagttttttttttttttttttttttgagacggagtctcgctctgtctgtcacccaggctggagtgcagtggcgcgatctcagctcactgcaagctccacctcctgggttcacgccattctcctgcctcagcctcccaagtagctgggactacaggcacctgccaccacgcccggctaatttttctgtatttttagtagagacggggtttcaccgtgttagccaggatgctcttgatctcctgacctcgtgatccgcctgccttggcctcccaaagtgctgggattacaggcgtgagccactgcacccggcccaagttttgggtttttttgttttgttttgttttgagaaggagtcttgctctgtcccagactggagtacagtggcgcgatctcggctcactgcaacctccacgtcctgagttcaagcgattctcccacctcagccttttagtagctgggattacaggcacgcaccactatgcccagctaatttttgtatttttagtagcgacggggtttcaccatgttggccaggatggtctcgatatcttgacctcatggttcacccgacttgacctcccaaagtgctgggattacaggcatgagccaccgcgccctgcccaaaaaaagagtaaagtttgaagggatgtacatgctgttctgtttgccagttcatcttaacggtgctgtatttagaaccctggaaacagccgggcacggtctcaaaacaaacacacaccccgtggaaacaatagaatgttgttactctgttgttacttagggagtgttttttcaaactgtactgtgcttgttactcacatgggggtcttgttgaatgcagattctgaattaagtgcccattctgactcagtccaactgagtcctgaggttctgcatttttagcaagctcccaggtgatgccgctgctcctggaccgcagactgcactgagtagcaggcacctgagttttgcctgtttttatgattgattgggctccccacggcatccatcttctagccagtgggaaaggggagaggaagtacagagcgagcaatttcctttttttttttaaccccatcttttattttgaaaatttcaaacctcctcaatttttgaaagaataatgcgcttcaccagttgttaacaatttagcaatattcttttaagcacatgacacagaagttgccaacattgtgctctctcttgttcactggtgaaacttttggcacatagcctgatcctgctgcaggagaggctgagaaataaaagcctagcttgacagtgatctgcctgctgaagggggtgggattctgttactactagatgatgataaagcagttattttttaaaaggagaagatggcagagtaggacaatggatactaggggacagtttgacacgcagactcaaatctttttttttttagatggagttttgcttttgtcgcgcaggctggagtgcagtggcgcaatctcggctcactgcagcctccacctccagggttcaaacgattctcctgcctcagcctcccaggtaggtgggattatgggcacatgccaccacgcctggctaatttttttgtatttttagtagagacagggtttcatcatgttggccaggctggtctggaactcctgacctcaggtgatccacccacctcggcctccggaagtgctagaattataggcgtgagccaccacacccagccaagactcgaatcttataaccagttctcttcaaattggattctggaaagctcggagttgaaatatacagcccaggttggtcgtggtggctcacgtcagtaatcccagtattttaagaggcccaggcgggcagatcacttgaggccaggggttcaagaccagcctgggcaacataatgacattcccatccctacaaaaaaacaaaaaacccaaaaaacctgttttttaattagccaggcatggtggttcacacctgtagtctcggctacttgggagactgaggcggaggccaggagttggaggctgcagtgagccgagattgcgccccaggctgggagacagagaccctgtctcaacaacaaaaacttcgcgttagatcttgcattatagaacccctacaaccggagggcagcttaagttgcctgttttactcagggacagccctaaactgcctttcgccagaatcggacggctgagaatccagtgtcgtcgcggggtggtgctgccagctggctccgggtggtcggccaggagccagccttgtgcacctgctttcagttgttggccagccccggcgctgcaggccctcgcgagcttaggatgcgcctgccagggcctgtgcgggggggccactcggtagagccgcgggacctcggcccggaaaccgcgccaccggcgtccgcacacgctaggccggggagcccagaggtctggccggccatgtctcggcgacctcccggagcgagggacagggaaggagccggccctcaccagtgccccgcatacgggatcctgggcctggcttcgcacggagcctgcccgctcccaacctgcccgctcccaacatggcggcagcgccggcctcagggggcggggccacgtgggggcggcggccaatgggcttccgggctgcgctgccggcagggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtgaggtggcggggggcggccgccggggctcggacctgcggcggggcgccgagggggcggggtaggcggggaggccgcgccggggtcaggggggccagcgcccaccgggtacgagcgcgctggtgaggcaggcccggccgcgcccgcgcccccggcgcacggtcctcccgggagccggtttcggggacggcggcggggagtgggcgctggccagggacgagggttgaggaggtcgcggctctcatgctgggtgggagtcgggccttctgcctgggggttgcgtcagtgtccgaccccgcgatgagtggtcgggacaatttgcaactagagggtggtcctcatgggtaccctgtggggtgtcgcgcgaggtgaagggccaggccatttccgtcgggtcagcgatttccgccttcgccccgctctcgcctggcctggtcagggcctgttttggtacttgttgcgccgattggagtcatctgcgacttgtttgccctcctctgaactcctgaaagccaggggctccgtctaggtctcctcctagtcttattctcccagctttcgttgttaagacaaattccttacgttcctggccctttacagaccggccctacagaacccacacccccagctccgactttcttctccagattgggtacttcccagggagtaaagggaatctgtagcttttgtggtttgtcctgctgggaaaatttgggggtaagtggtgggccttctctggacgaccacccacaaatctgtgtgcccaaacggagacaggacccagggtctggacatcaggcaaggggtactctgcagtaaacgtggacattggccgtttcgtgggtttgttttcactctgccaagtccttgaggcgtacacttttgtgtcactcatttatcttgaaagaaaaggttaacagcccaacagagtagttcgctttggtatctggagtggtaatcagagtgccagaactggagagaacattgccgtgtacagatgtttgccttttaccagggcactgaaggcataaaacccttagttaatgcttaactgagtgaaccatgaaagtcatgtgactccaaaggtcgactctagaaatgcggcagtccatgtagcactgtgatgtagaaattctatgatatatgggtcagtgttcacaggcagggagagggggagtcttcaacatctttgaattaaaaagcatctggggcaaaaacaaataaatacacacatatcagtgaactgctttaagttcagttagagaaggtgagattaaagaccagaagaaactcgagggagactgctgtataagtcccagttatctttccaaacagacaggttcatcacagcagtgaaggctagtcttcatctcccttcttgtgggattttctacattaatgtgcagatctgcccttggagaatggggcgtgcatgattgggctgtggtttgctggagtttcatcttactgaagttgcagacactgtgggtttctgtgacaatggtttacactgaaagtagcaaagtcaaggcatggtctggtatcagcatgccagaataaaacacacagacagctttttaaaaggtctgtgtccgtcctatctttagcctctcctggttgtaacttgaagtgactttgttgccgtgtttgttttgaccaggccgggacagtatggagagtatctttagatgtgacttatctgggttgcttagcaacagcatgcttcagattagaatggaagaaagttcctggatgtgaggagatttgaatgataaaagatacttacacctaaaaggagaccaggagggattgtgccctgttcttgctaactgggtgctcgtaactggagacggggtgtacctgttagcggtggttagacgaggtggatacagaatccagaatggtcacattgcagccatagggaacagatagatgcagagaagaggcttcagccctctgagttagggcagtgcatggccttgctctgctgaaatagcccagaggtcccatttgcttggtgacatctctcacttgaatagaaagctggctgtttatcagacactgttttcttaaatggcagctcctccacatctgcgtcatctccattatctcccctatccatctctttttggaaggaatccacgaagccctcatgactgtttgtttgtttttgtttttttgttgtcgttgttgttttttggagataggttctcactctgtcgcccaggctagaatgcagtggcgtaatctcggctcaccgcaacctccacctcccaaactcaagtgattctcctgcttcagcctcctgagtagctgggattacagtcatgtgccaccatgcctagctaatttttttgtatttttggtggagacggggttttgccatgttggccaggctggtcttgaactcctgacctcaagtgatccgccgcctcagcctcccaaagttctgggattacaggcgtgagccattgcatccagcccgccctcatggcttttacacctcttttcctggtttgcagaaagcaaggctggggtgtggaccctgcatcgaagctggttctgcttatgtccatgtgaagtgctttcaagtaaaatgctgatctgcaaaaagatgctgaaagtcctttgtctctttctggctaagttcaaatgccgaatttgattcagcaaatagttgtgagtgccttgaagtgcaaagaatgatccaggatcaggactccttccctacatatcattattttgatatgtatgtatgtatatatgtttagtgacggagtcttgctgtatcacccgggctggtctcaaattcctggcctcaagccatcctccaacctcagcctcctcagtcgttggggttacaggagtgagtttgccaggctctatatcattctttttagcatgacctctgataggaggctggcaggacagttcaggacttatcagaagcccaaatatcttacactgctgattaaagagagacctgtgtttgaaaaccaaacgggcatataataggattaacattctgctatgaacactaaggcatttgcgtagtgcttgtgggagtgataggaagggggtctgaaccgggggagccagggctttctgcaggaagtggtttggggtccttgtcaacagtgaatgctgcttaatggagccagagtgcccccctgcggaggtgggcagagaggtgccagtcaccccaaggtgccacagctctaagctgagatggtcagatagagggaagcaaacaagggccactccctagtcccaccttgtcagcagctcagacgggattccccatctctatctcagccagggagaagccatcgcgagaactggctatgagtgcgacagcttagagatgttgcaatgtctcttcaagttaggagtgaaattattatccattttgccccaaaatggactcttaaacccccatacacttggaatagcatgtattttgtgctttgaagccagaaataaacattctaaacaaagatttaaagttgcaatgaagaggaggtggttgtggacagacatgcagaacaaatgtttgagaaatgttccctttgcttccacagaaaaacaaaagaaaggcattttctcgtgtttgacaaaccatgttaaaaaaatattcttggccaggcacaggggcccagcactttgggaggccaagtgggcagatcgcttgagctcacaagttcgagagcggcctgggcaacatagcaaaactccatctctaaaaaaatacagaaattagccaggcatggtggtgcgcatctgtcatcccagctacttgggaaactgaggtgggaggatggcttgagcccaggaggtggaggttgcagtaagttgagatggtgccactgcattccagccggagtgatagagccagaccttatatcaaaaaaaaaaaaaaaaaaacctttcagtgctattttttgtggtatagttactgttattaaaaagcaaatggcatttctctttttttgtttactgtattcctgaaatagggtcgatttggccagcaaagtattgacactggggcccatcttgaaaacaactaactattgaagaaaataatttcattttataaaatagtagttgggtaattctcccttaggtaccaaaaagggctcttttctggaaaatgttaatgcaacaatatttccctcattcctttggtgttcatgggtgttctattgaatgctgttccattcttatttctttctagaagatagctcattctgactcctgctgtaaactgttcagagattattctttccagagtctgttacattcagaatgtcttgctagtctgtcacttgctgcccttctctttctacttagtttcagattactttgcatctcctctggcctcccgtttttaaccttttcattgatgtatacacacagaaaagtgcactgcttgatgagttgacatggcatgaacataacctgtacatccccaacgccagaagacccatgggcccccttaccaggcaagccctcttctattaagaaaagcgtttttcttgttgtaagcacaagaaaccactaatagtaattatactagggatggggcgcatacaggattcggaatttttgctttgtgttgcacatgaattcttactttactatgaacatgggttgctttgacaaatttaaaacaaaggcctgaaaggactccccttactcaagaaaaggaaaatgccttttttaaatgtttttttgaaatggttgtcttaaaatttctaaatattttttaaaattagattttatatagccacgcaaattgttctttaatggttatgtaggaatacaggctgcttggcctcccttgtccacagcctcctctttgtttctttgcgactttgactctgtgtttagaacatttatttccgggatgagtgcacaaaacaccatgctactccaaggcacagagtttcagagtcagcgctgagtctattttagagcaaaatgggtaacactactcataatttgaaaacacactattaaatacccaagctgttgctaactaaaagcagcctgtgaggttattttaatataaaaatgcaagctgaggccgggcccggtggctcatgcctataatcctagcactttgggaggccgaggtaggtggatcacttgagctctggagttagagaccagcctggccaacatggtgaaaccccgtctctacaaaaaaaaaacaaaaattacctgagtgtagtaacttaatgtctgtactgtcagctacttgcggaggctgaggcaggaggattacttgagcccaggaggtggaggttgcagtgagccaagatcgtgccactgcactccagcctgagtgacagagtgagaccctgtgttaaaaaaaaaaaaaaaaaaaaaatgcaagctggcgcggatgcagtggctgagacctgtaatcccagctacttgggaggctgaggtatgaggatcctttgagtccaggagttggagaccagcctggacaacatagggagacccagtctctacttaaaaaaaaaaaaaaaattcaacctagacttggtggcttgtgcctgtaatcctagctatttgggaggctgaggttgagggatcccttgaaccctaaagttcgagaccagcttgggcaacatagtgagatcctgtctcttagagaaagaaatctatgtgtgtgttcgtcattttgacatacaacatcttcacttttttctgacaatgaaaacaacccaaggttattgcaaaaaaaagatccagtaatacagaaacaagtgatacagaatggaaccgtctgctgcaattgctggggcagattcaggcagaaatttggattacttttattttattttattttattttattttgagacagagtctcactctgttgcccaggctggagtgtagtgatgaagtctcggctcactgcaccctccgcctcctgggttcaaacgattctcctgcctcagcctcccaagtagctgggattacagccaccatgcctggctaatttttgcatttttagtagagatggggtttccccatgttggaactcctgacctcaagtgatctgcctgcctcggcctcccaaagtgctgggattacaggtgtgagccaccacgcccagctagatttatatttgatagttatttgattccagaggatcttaagtgcaaacccagagaagcagagagtaaaaagcaaaaaggcaacaaaacccagcagatggtgagggaaagggaagaagccagggaggggcaagtggggacaggaagtgctctgaaacccgaccctctcttgctgggctttctccttttaaactgaggagctgctgtgtccatctcgcccgctgcttcctaggcggtacagagggtttcctgtagccttaagttttctctccgagaacagacagattcttggttgagccttaaacagggtccagtcttgggtgttagtcaagaatgctgttcaagtaaatacgttttactatcatttgactcccatgtgcccccaaacctggtattatttacaggtagttttgttgttgttttgtttttaaaccaaacaggttgacccattcactcaatctgagttaggaaatatattccaggcacaacctatcaggcggttgcctgcaagatcccagctgaaagcatcgctgggacaaaggtgatgctttggcagccaccctgttggctccgtccagcccacacctcagttgtctcaagctgctctttcagtgggaatgtgagatctggtagcagaggctcatttcaccccaattttctatttcagaaaaaggggccgggtgcagtggctcaagcctgtaatctcagtactttgggagtctgaggcgggtggatcatgaggtcaggagattgagaccatcctggctaacagggtgaaaccccgtctctactaaaaatacaaaaagttagccgaatgtggtggcgggcgcctgtagccccagctactcgggaggctgagacaggagaatggcgtgaacccgggaggcggagcttgcagtgagccgaaattttgccactgcactccagcctgggcgacagagcgagactctgtctcaaaaaaaaaaaaaaaaagaaaagaaaaaaggaaactcatccgaagcaagagaggcagccacggggtcccatcttggcagcacatcttctggtccccggtttagcgttctgtccttctcttgggtcatgttcttgtctctgttcttcctcatcccttcttcgtccttgtcatcgccacttctgacactgactgagtggggccacaaaaggtgagtcgtccttccggctgcccccaccacaatccagccctggctcaagagcagggaaggtgctgtcccccaggctgcagacgggggttagtacagcaacctcagacagcttcctctctggggggaccctgcgtgtcttgggtgcagtttcgaggaggatgcagagggatggatccctgccttcttctgtgtgacccctgcggtgggggagcatccctgctcagcccaggggatggcacttttcatgtttgccgtgagattcctctagcaaaagcagtgggttttgtgagtacttaggtaatggtgccagaaagcaccatgacaccctggtatgtccgccccatataatcagagaatctgactctgctcactgctgagaccccgatacccagggtagggcctgaattttcaatgcaattgcgataaattaatgactaaatggattctcagtttgaaatgtaaggcgtgacagaacgttcaacccagggaagattgagtcaggacccgggaccttgccggaacacctgtggccgttgctgctgttaactgaggtgtaattaacatgcagccaagtgcacagcttcacccagcagatccgtacgttttgacaactgtgaaacaagacgtagcacatcgccatcgcgcttctcagctccgccttcaccactctgggtgccagcaccggcaatttgtttggccagttccagagtgtcataaaaacagaatcctccattgtcactcctctgtccttgaagagatatgcatcgagttgtatgcggccactctgcgggctcccctcggcacatgatggtcttcagagagaggctgtttggaaatagagtggtgggtgtttgcttcttgtcacccggcaaatgattcatttttctgctgctctgacactttggaagaagccagggatgctgaggagatggcttgctctcacgtgggcagctgctcctttgagaaacaagccatgcgcagtgttagctgctgacatcctccacttttagcccttgagcccatttcactgatgagcaagacagtggcctgtatctgtcactaacgtgcttttctttttctcccctgttccccaaagacaggagtgtggagttcatgagtgttggatttttcaagctagtaaaccttgcagctgcaagtggtgtttaattcttgtggtatggatgagcacatgctaatctcccttgagcttctcttgagcagaagcctggtgtgctaacgggcaggactggggtggtgctttgagaggaagagggggaaggtggcccgagagggagatctactgagatgtgagctgcctggagtttggggtggggattcctggaggggctctggattttgcagagggacagctgttggtgcaccttcaccagtgtgctgggacagaaagtggggtgagtgggtgagtgaggaataagtgtttgaagggcaggagtaaagcagaaaggtggcagcaggtgttgagctgcaagtggttccattgcctggaaaggaggtggcagggaggcctgcccaagatgggtgcctgcagggtgcggacagcctgtcagaggtgcggaaagcctgacattgaaaatgtcagacagtgggtgcttgggccagagagaaagagcctgaggagctggaccaggggttggggggcggcctttagaagcagcgtctcatgcagccttcccagcgatcctgaggtaggtgggagaatcttcaggccacggctgagaagctgaagcgtgtggcgggagatccgtctcagaacacctgagatccctgcagggtctgggagcatgttaggggctcagagtgcaggtagggactggcagggaggagctgtgggcgggaagagagagaagggagggcagggcagtgtggccatggccagctgaacactgggagtctgctcctgaggtcatggatggaggccaggacacctctcaagccattaagagggtggcctttccaagcgcagcatgacttgttggtcttgaagcagtgccttcgaaggaggaggagtcccccgtggacttggggcattaggacagggactgccaaggagagagggcactaggaaacagggttgtttttggcttttttacctggggtgcaagtggagcaccctgtgggcatcatgagggtgtcaggaaacccttctggtaactgaaacgcagtccattctgtgtcccccagattctgagttttcagcacctgacagtggcgggggatggcagacacacctgtgggtgctggagacatcttggcggcccttcctccagtttggcatcatagtcccctgtgggctgagcacatggggctcctggacagttgttaccgatggagggtatccaggttcttgacatcttgaacaaagaattggacaaaacggcacaaacaaagcaagaaaaagatgaagcaacaaaagcagatttattgaaaacgaaagtacactccatagggtgggagcaggccctggttacagaattttctggggtttaaataccctctagaggtttcccattggttatttggtgcatgccctatgtaaatgaaagtgacctgcgatcagtctgattggttgaggaaagcagccaaccagaggctgaagtgaagttacaaagttacatcctatgcaaatatctgattcattgtggaaagcaaccaatcagaggctgaagtgaaattacaaagttgcactcctatataaatgaagacttggccggagaccagcttgattggttgcaggaggggaccaatcagaggtactttcagttcttgatctgcttggtagaaaagcaggtcggtgtgaagggagtagcctctggttcttttgttacttggggatggaaagttggggttttcctttggatttagttctaagaagtcagcatgaattggccttaggttccctgcctccagaccctattctcctgcctcacagtgatgttgatcagggggctcagcttggctctgccagttcagacaccagccccttccagctactgccagtccttggaggaaagcagtcttggtaccgtgtccggagaggtcatttccatgtaaaagaaatatgaggtctacaggcagctcaggagcacggagttgggggaagcagagaaggtgtgagtgccgaggcgcaagcacggcttttgtttgggtcaagcaggatcagtgcctccctccttgcatcgctccacctccggaaggcggagaactgcgatgcagacccaggaggccagccaggagagatttctcaccccaggctcgagcctttgaagctccaggttctaacttaaaaattcaagggagtggccgggctcggtagctcatgcctgtaatcccagcactttgggaggccaaggcaggtggatcacgaggttagggatcgagaccatcctggccaacattggcctgacaaggccaacaaccttgtctctactacaaatacaaaaattacctggttgtggtggcacatgcctgtaatcccagctacttaggaggctgcggcgtgagaatcgcttgaactcgggaggcagaagttgcagtgagccaagatcttgccactgcactccagcctgggcaacagagccagacaacatctcaaaaaaaaaaaaaaaaattcaagagagtttcgcattctcccgtgcaatacttccctgcttgttgtagtagagatgcgtcctgtgcctttttaggaacatgttctgaaagatggcttgggcaactgtgactttagtgctctatccccccagcactgccctggtacccatcctgtttagagggctcagagcagagagcacctgcctggcagggcccgtctctgactttgccttgctgctcctcccagcactgccctggtacccgtcctgtttagagggctcagagcagagagcacctgcctggcagggcctgtctctgactttgccttgctgctccccccagcactgccctggtacccatcctgtttggagggctcagagcagagagcacctgcctggcggggcctgtctctgactttgccttgctgctccgcacagcactgccctggtacccatcctgtttggagggctcagagcagagagcacctgcctggtggggcctgtctctgactttgccttgctgctccgcactgcactgccctggtacccgtcctgtttggagggctcagagcagagagcacctgcctggcggggcctgtctctgactttgccttgctgctccctgttatcagcactcttgtccctgtgtcctccgggtggcctgcagggcaatggaagatgagtacttagtagaaggttctaggtgggcacatgagggttccttgccagcaccagggctttgttcacacaggtgttgcatgaagccatccagccaagagccagggctccatgcctctgagccctcaggcactgcatcatgctgggcctcagctccatacctgccgcgtgtctgtctcaccatcactgtgctcaaggaaggtcgccaccagatgctcctctgtgcgccgggcctgctggggctgccctggggcctggaaagtgctttaagcaggtcctttgtctcgtgtcaggggatgggctccaaagttagtggttggaactaactttgccatctgctggagggctttgcccctgccatgccttgagcccacacatactccaggggtgactgacacagttggttttgcatcagaattggccattgccacctctgaggggctgggaaatgggtgaccctgccccacagtgcctgcactgcccccagcagacaatgctgggggagcagcttcccaccaggcctggcttggggcttctccagggaagcccaggtacacctcccagcctgtaggtgaaggtgcctggaatggaactcgctattcccagaggcacagagctcccgtcacagcggctgggtgacagcagtaattctcgcagatgttcaggccctgggaccccagaagtgaaatgacccagggcgtcagcaggaaaggaggccccactttttcaggacctctccctccaaccagctccacgtccttcccaaagctgggcccagcgtggccctcatagccagctccgtctctctctccttgggcctgctgtgactgcaggcacggatacactggggagacgggatgtagaaagctgtgggaagagggagcaacggcagggcaggggccagtggggttggggggggccgctggccctgcctttggatcatctccgacttgatcagcatgaacccctgactctagagggaggctgatgggccagggcacatgtgggtccccctcactgcctccgcagcagtggacctacagccatgctctttgaccccatctcttcctttcatgggcacacaggtgacccgagtctctgtttcgtgcaccttcctgcctcttctctgcccctcagttgggctgagacacatgaggtgctgtgatgcatgctgcatttggccctgacttaggtgtgacgcgtttccatttttaaatcgagtgtaaagaactggcctccagaaacacggaagcacttttagtagggatttgaaaatccgcagatcgttgtgtatctcagagcccagtgtttttcttgaaattcacactggaaacaaatgaggatactgggggaaatgtgcagtcccaggacatgagagatgcgagcttattacgaatctgtctttggtaccaagccacaatatagagatttgtgaaaatctttaaaaatcaacttgactgggccgggcgcggtgctcacacctgtaatcccagcgctttgggagggcaaggcaggcggatcatgaggtcaggagatcgagaccatcctggctaacaaggtgaaaccccatctctactaaaaataccaaaaaaattagccaggtgtggtagcaggcccctgtggtctcagctactcgggaggctgaggcaggagaatggcgtgaacccgggaggcggagcttgcagtgaaccgagatcgcgccagtgcactccagccttggggggcagagcaagactccatctcaaaaaataataataataaaaagatctggaacgttttcgtcccctcaggaagtcatccctgccccaggcatccacggaggtcaaggccttgccaaccccacttcctgggtccagctctcaggtggttctccctgtggcctccagacccgggctgtaccggctggtttcgcaggttgcctgtgctcatcctgccctctccggtgagagctgagccggtggtgtttttttcagagccagctggccctgcaggagctcagaaacctgggcggctgggcctatgggctctggagttctgcccagggtggccaggtgggcagcctttcccccgtgctggttcctgtagcaaggaggaggccgtgtgctggggcccttgtgtcaggagctgtctctggaaaggctgaatcgaggaaccagcctctgccttgtccgtcgatgttgtggggttagtggctttgtcccagagtttcaaagtgtgggtaagtggtttctgggtttgccagttttcttagcccttaggggaaagggggtgggagcctgccctcagctggcttcgtaaaaacacagtatctgtgcttgagttacacgcccggcgtccttttgcgttttgagacctcagtggagtgtgcgggccctgagtagtatgcacccactgacagtgaaccagatgctgcccccctgcggttccagtgtatgtcagtgccagccacgtgcccaggacccaccgttcccagggatacaagatcccgtggcccatggtggcagctgcggcacacagcgctgctttccagagctctcagtgcggacaacagaggccttgcattcagtcacctggaaaacccaccatccacattggaaacccagtctctccggaatgagaaatttggttggttttctttagctttttgtttttttgtttgttttgtttattttttgagacagaatctcactctatcgcccacgctggagtgcagtggcacaatcttggctcactgcaaccttggctcactgcaacctctgccgcccaagttcaagcaattctgttgcctcagcctcctaagtaactgggattacaggtgcctgccactgcgcccagctaatttttttgtatttttagtagagacagggtttcaccatcttggccaggctggtcttgaactcctgacctcatgatcggcctgccttggcctcccaaagtgctgggattacaggcatgagccaccgctcctggccctggttggttttaattaagaacattttcaaacatccacgtggcatacccgttatccagatctaacgcccattaatattttgccacttttttgctccaactaaattaaactaaattctggaacattctgtcattttgcccctgcatattccactgtgcatctgttaatataaaatatggactttttgtacataaccacaagactcttctcacacctgacaagattaacaccttcatctgttcttttagaggttttgttcctttgtgtgttctttgtcatctgttttgttttgttttgttttgtttcgtttcatttcgtttttgagtcagaatctcaccacgtcacccaggctggaatgcaatgacaccatctcagctcactgcaacctctgccacccgggttcaagcgattcttgaacctcagcctcctgagtggctgggatgacaggcacaccaccacgcctggctaatgtttgtatttttagtagagatggggtgtgttagtccattttcatgctgctgataaagacacaccagagactgggtaatttataaaggaaccaggtttaatggactcacggttgtacatggctggggaggcctcacaatcatggcagaaggcaaaagtcacgtcttacatggtggcaggcaagagagaatgagagccaagcaaaaagggaaaccccttataaaaccatcaggtctcgtgggacttattcactaccacaagaacagtatgggcgaaactgctcccatgactcagttatctcccaccaggtccctcccagaacatgtgggaattttgggagctacaattcaagatgagatttggggagggacagagccaaaccatatcatagtgtttcaccatgttggtcaggctggtctcaaactcctgacctcaagcagtccacctgcctggacctcccaaagtgctaggattacaggtgcgagccaccatgcttggccccagctttttgttgttgttgttgttgttgttgttgttgttgttgttgttttttgagatggagtcttgcactgttgcccagcctggagtgcagtggtgcgatcttggctcactgcaacctctgcttcttgggttcaagtgattcttccacctcagcctcctgagtagccgggattataggcacctgccatcatgcctggctaatttttatatttttgtagagacagggttttatcatgttggccaggctggtcttgaactactgacctcaggtgatccaccagccttggccttccaaagtgctcatattacaggcatgagccaccattcccggcctatttttaaagggtctggagtcaacagtgcatggatccagaaccgtgggaacaaaggggtgggcacaagggcggggtggggggtgtgagtttagagaggcttctccctataaagctgagcatgaactacttggcacacctgacgttgaaccaggagctgagaaccacacaagttaggagtcagagcagagctgctcaggacgtcagtgctggccctgtcccaggtcaaggggataccccgggaagtggctggactgagccaagtatcagctagtagtgggtgctcaaggctggtgtagaggggcaccgcctccctgccagcactgtcctgacacttggaccccatcagctcgttccagcagagaaccaccctggggaggggcctagctatctccactccgcagagaaggctccaggaatctgattaactaaggctgagccagcagagagaccagattcagcgtctaaattcctccccttgtcaggaaagggaaggttgtgcagaaacctggacagtggacgccgcgggcacttcccacccatggcagcaggagggcgggagctcagagaggctgggctcgccctgccagtggagtggggactgccagataaaagacgaggtctttcctgggcagtgagtgagtcctgggggcccaggggcttgcctccacaccttgcacctgcccccagcagctttcagctgcggatttcacggcctttcctgattgttgtttgactccgtcatttctgttggtgattccaaaatggtgactttctaattcagtcattatttctacttttattagctggcattcttctgtaaagaactttcctcaacgctgagatgaactacgcagttcctcctaaaaaaggaggatgaatgcagcatcttttcccatttatttatgggtttgtttatttatttatttttagagacagggtcttgctatgttgcccaggctgatctcaaactcctgggttcaggcgatcctcccacctcagccttccaaagtgctgggattacaggcatgagccaccacacccagccttccatcctttccttttttttttttttgagatggagtctcactctgttgcccaggctggagtgcagtggcgcagtcttggctcactgcagcctccacctcccgggttcaagcgattctcctgcctcagcctccacagtaactgggattacagttgcccgccaccaagcctggttaatttttgtattttttgtagagacagggttttgccatgttggccaggctggtcctgaactcctgacctcaggcagtccacccaccttggcctcgcaaagtgctgggattacaggcgtgagccatcacaccaggccccatcctttccttttaacgactaatttccaacttaaagaaccaaggcttctgttttccccttctcggtgcccagcacttggccggccagccttcctccctccattcctctcttcctttctatacaaacttccttgttaaataaaacaggggggctgctcctcccgcccctggattggatgcactttcctgatttaaaggagtccttggccactcgtgaccccgacttgaactgtggtgtcccccaaagtctctttctttccgcccaggagtgttcacttgctgggcggggaggagaaattggggtgtgacccactcagcacaaacccacgccctggtcataaagccgcaccatttcccctgcaaatccagccgttcactgccccggccaccgggctgctttgaagggggatgaggcatgggggctgctgaacccacaactgtcactggcagccactggctggagttgagagaagtcaggctggctggggccgttgaccctcggaaggaccactgtcataagatgtgagaccagtcaggggcagctcagatggggagagaggctggccagggcttccttcagctggggctgagcagtggagggcctggttccccatcctgcctgccctcctgggcctgggtcttcccagcgatgggggcgactgcagcgcctcttgggagggcgatcgtgagaggcagaggcctctgagtgctggctgaggggtgtccacccgtgggacatgctccgtgctcttctgtctcgcctgcctcacaagctgagcatgaggaagaccaggctgtgaggtgacgcgtcccccccacccttccccacaggtgtgaatgacagaggtggtgccatccagcgcgctcagcgaggtcagcctgcgcctcctctgccacgatgacatagacactgtgaagcacctgtgtggcgactggttccccatcgagtaagtggagcggattgcagggttggggagagcccgtgagcctcaggtgcagaagctgggcggcgggggtgggggcctcttgggcccttaggaccgtgctgcaaagatgggaatggcctggaggggccacaggggtcccaggttacccacctcatctagggacccctgctgctgggctctttccacctctcagggtgtgcagagttccccagaagggctctgtgagaaatttcagttacagagctatcgggtgtggtgctatttataattcagaaaatttagaagccactcaagtatcttcacagcaaggagttggttacatgcattagagtaattagagtatgtgcatataaaagtgcaatattattcagccgggaaaaaaaaacctgtcaaagagttatattttttgatagagaaatcttttttacaagatattaaaggagcctgtaatcccagcagtttgggaggccaaggagggcagatcacctgaggtcaggagttcaagaccagcctgaccaacatggagaaaccccgtctctactaaaaatacaaaattagccaggtgtggtggtgcgtgcctgtaatcctagctacttgggagactgaggcaggagaatcacttgaacccaggcggtggaggttgcggtgagccgagattgcgccattgcactccagcctgggcaacaagagcgatattccgtttcaaaaaaaagaaagaaagatattaaaggaaaaaagtcagtctagaaaatagtatgtaccacgatcctatttttatttgaaaacatgtacaagataaaattttataatgataggtatgaactgagcgggggtgaaaaaaattttacaagggggtatgtaccatttaacagtgtttcagtatttgaggtgggtagattaatattaggccctatgattgtttcttcttgtctgtcttgcctacaatatatgcacatacagcttttttgatgaaaaaagttgacacaaactttgaaaatggaaaataaacaagatcttgccagccaccagcatttccttgagtgttcacctcagactgactgaacctcatgctcttggcagggcggtggcagggacccctgtgcgtctttgtggaagcgggaactgtcacagtccaggtgatgtgggctggcggtggcaacatgagttaaaaaactgttcttggctgggcgcagtggctcacgcctgtaatcccagcactttgggaggccaaggtgggtggatcacctgaggtcaggagttcgagaccagcctggccaacatggtgaaacctcatctctattaaaaatacaaaaattgggccgggcgcagtggctcacgcctgtaatcccagcactttgggaggccaaggcaggcctgaggtcaggagttcgagaccagcctggccaacatggtgaaacctcatctctattaaaaatacaaaaattgggccgggcgcagtggctcacgcctgtaatcccagcactttgggaggccgaggcgggtggatcacgaagtcaggagttcaagaccagcctgtccaaggtggtgaaaccccgtctctactaaaaatacaaaaaaattatctgggcatggtgcaggcacctgtaatcccagctactcgggaggctgaggcaggagaatcgcttgaacccaggtggcagaagttgcagtgagccaagattgtggcactgcaccccaacctgagcgacagtgagactctgtctcaaaataataataataataataataataaataggcctggtggcacgcacctgtaaccccagctactcgggaggctgaggcaggagaatcacttgaacccgcgagtcagaggttgcagtgagctgagatcacaacactgaactccagtctgggtgacagagtgagactccatctcaaaataaaaataaaaacgtgttcttcagcccagcaatttaactgctggaaactaatctagagaaataaaagctgcagtgagtgcatagatcagactctgcccagggttgcctgagagccagtggagccacgctggaccgtgggccttggccatgtgagccacccagcctgcctgtctctcctgcagttctcgtgggcctaaggtctcaggttcccaagactgtgacatgaaccgggctgtgaggcagcaaaactaaccctacacaccctagaaactccatgtgcctctgtcctcctgaccttgtctctctggggctggggctggattcgcctgttaatgaccatgtcctgggcctttatgcccactgttttttttgcctgctccgctcagaggggtcttggcctcattgttgatgagcagccgttagcagcctcagcctcacattccccttaagggcgggttcctccctgtcagggaaggcattgtaaactcaaacgcctgtcagctgtgaacctggctcttcctggaatcactccactcccctagtcttcagtgtccagaagtctcacagattctcgtaggcactcctccagtgtccaagggtgagaagggccctaaaatcttcactcacctggtggaggaacagggccctgctgctgactctccatgagttgcttccatggagacagtttcatgtcggataaaattatttttcccgggccaggcgcggtggctcacacctgtaatcccagtactttgggaggccaagacgggcagatcacatgaggtcaggagtttgagaccagcctgaccaacatggagaaaccccatctctacttaaaaaaaaatacaaaattagccgggcgtggtggcacatacctgtaatcccagctactcgggagaccgaagcaggagaatcgattgaacccaggaggcaacggttgcagtgagccgagatcacgccattgcactccagcctgggcaacaagagcaaaactccgtctcaaaagaaaaaaattcccatcagagatccccagtcctgtctagacagatcactgctttaagaaggtggctgtgacagttaggtagagacttaagtgatgggcacactcctcggcagccttagagcagcaggcagaagtggcccagagctccctgtggttctgatgtctagagcacgaccatagttggacttgacctgtggcaggttcacctgagtatgttctgtttctcaggtacccagactcatggtatcgtgatatcacatccaacaagaagttcttttcccttgctgcaacctacagaggtgccattgtgggaatgatagtagctgaaattaagaacaggaccaaaatacataaagaggtacgtacgtgtgtgcagtgaggacttggcagtcactgtcattggacgggccaagggggcttgcgatggaatcatgctgcctgctccacagccgtcgtccaaggagcctgtgacccaaggaatccaagtggccaacgacacttgtccctggctggtgcttttctgtgtgtgtgtgtgtgtgatttcatggtgcgtgggcctccagtcgtgcccagcagcaggcttcataaccactgtcgttctgaagcaggcatgagcgcagatgatgcattgagaatctgcagttacaacgtgctatgaaaatacccctgatttgtgttggcggcagtgtcatagaaaccgctaagactgcttcagcttgttgaaggaaatgctagttacagttagaggtcagggaaagtacagagataattttttttcctctaacttcacagagccctttaagatctaagaaccctttgggcatccgtggacccacctcagtctcacttcaggctagcaaaccccagtctgaatgtaaacagtaagaccatggccatattgttccaaatggttgagtttagtcaagattctgtgtgatgatgttggtcatcccagcatctgaggtaatgtttaccacccgaggatttagccaaggagggaaaaacccaccaacaactggcagatggttcaatttgtttggcttgaggttatttctttaaaagttagagaaggggccgggcgcagtggctcatgcctgtaatctcagcactttgggaggccgaggcgggcagatcatctgaggtcaggagttcaagaccagcctggccaacatggtgaaaccccatctctactaaaaatacaaaaattagccgggcgtggtggcaggcgcctataatcccagctatttgggaggctgaggcaggagaatcgcttgaacccacgaggcagaggttgcagtgagccgagatcgtgccattgcactccagcccgagggacaaaagcaagacttcgtctaaaaaaaaaaaaaaagaagaagaagaaaagttagagaaggcctgggcacagtggctcacacctataaccccggcattttgggcagatcacgaggtcaggagttcgagaccagcctggccaacatcgtgaaaccttgtctctactaaaagtaaaaaataaattagccaggcatgatggcgcttgcctttaatcccagctactcaggaggctgaggcacaagaatcacttgaacccaggaggcagtggaggttgcagtgagcggagattgcacttttgcactccagcctgggtgacagagtgagactctgtctataaataagtaaataaaagtgcaagaaggcctgtctctccctttaaggacccgaatccactggcatctaccctgttttgcctgtggtcatactctgtctggcacagcttttttctcctgagtcactttttctgccctagcttcctcctgagcttttttctttgatttttaagagctaagatgtagcagaaagcaagtgtcaacattcttttctctcctcttttttttttattgaaacggagtctcactatcacccagggtggagtgcagtgatgcgatcctgatcccggctcactgcaacctccgcctctcaagtaggattttagacgtgcgccaccacaccaagctaatttttgtatttttagtggagatggggtttcaccatgttggccatgctgatctggaatccctggcctcaagtgatccgcctgcctcgcgggagtgctaggattacaggtgtgagccaccgtgcccagcctgatctctcttgttaatgggacacgtggtcccccccttcccccaatgactcattcccctgaaccccatccccctccgggtggctttcctgagtgccccctggtgactgtgtgcctgcccccaggtggcggctgggtctcttcctcctctggaatgtgtttgtgttccctcgaggccgacatggggaccctttggctcatgttcccggctctcagtagagggccctctggcctgcacgctggcactcattcatctggccccttcctctcaggcttagtgagttcaaggtcagggcaaagtagaccctgttaagagatgtcagctggggaacagacacccttcctgcaggcctggagtaacaagagtgataaggacgccttcctccctggactgacatatctgggtgaactgtggcttgaagagggctgggagagcagggagcctggacaggctgaccccagcccagcacgtgggagcagaaaggccttcttgttctttacgagttggaagatgataagagcctcatgctgatcagattcatgactcccacccggaattccatctctagaaccaagagatggtgggtggctttacgcaggtgtggcggtgtcctctgcctgtgggggcagcagaaggggttggacggccgcccaagtctcactcctccaagatcacctggggcagcgtgcgattctttaactgaacctctaaaactttgcatttgtccactgtcctgcatccaggcctaccaggtgacatgcgtgcattcccatgaggcccgcgtggtgctgtgtagttgctgccttcatgccataactttaccttgtgctggcatcagagcctcattcccgtccttggctaggcctcccacacacccctaggagaagctccttttgtgtgtgttcttcttttcagctgtttttcaccagaagggcataaacgctctcatttccttggggagtgggggcccctctccagtacctcttgattctgcccctcccagtcggtgtccctctggctgtcgtgggaagtcggtgcggagcccgcctgggccgggctgtgcagtgagccgtgcaccagacgtgtgagcctgactttctctctgactcttcctctaggatggagatattctagcatccaacttctctgttgacacacaagtcgcgtacatcctaagtctgggcgtcgtgaaagagttcaggaagcacggcataggtaagggcagccgggcccgcggcttggcgcccaccccacccccttgccctaccccacccccatcccatctgcacccagtctcttccctggccccaacaactctggctcgtgaacatccctcagtctcatcttccatcctcgttcccgtcttgggccagaccttcatcatccctcccctgccagcacacccaccaccttcagccatcctctttccacatgcccccaggcctttctgctgcagcctcgctcagcccccaggatggagctgaggaaactggcacctctcacttctgctgccgccacacgcacaactcgtgtattcactgctcacgattcagagtagaaagcgtgaacacgcacgaggaagcaacactcaccgtttctccgatgtcccaccccactcggccacacggccagtgagcggcagagtcttaattaattttaaacccaggcccatctagtccatgttttcctgggctcacatttaccctgtttgttgtctgaaagggagtctccatgcgggcccagcccatgggagggcgctaccaggccacctctgcagtccctcccagcagtctgtagctaccaggctccatctggccatgagattttagggactttgacagtggtggtgaagaaaggctggtctctgatacggtgggccgagacatctccgagagactcatgcaaagcccccatcctagcccagtcatccttccttcctaactgctctgcctgcattacctttacctcttctccccaaggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcggccaccctccctggacgattttatatccttaacttctgggggagagggactgtggcttcctgtccataaggtggcagagccagtgagcaagttggagctgtggtccccctcagatgatgttcaggtggccaagcttatggatgcttctctcccttacctgatcgtgttgtgggtaaacctgacacacatttgggtaaatcgagttgcacatattaccatgttgcccaggctggtctcgaactcctaagctcaaatgatccgcctgccgcagcctcccaaattactgggattataggcatgagccctgcacccagctggagagcctcctgctccacttgcactggggatcagcagtgcacaaaacggacaggatcccctgtcctcccagagcctgtgctagcagaggggaaacaagtgcggagagaagagatttttactttttttgaatacttgggttcaaaccttccttataggatgcatgacccaaaggtatgcccttccctgcttcttcctccttaactttcactggcccctgacaggtcagagggaagccaggaaactttataatagtcagaatgtggcccaaaaaaatgctgtgcgtgtgtgtgtgtgttttcaaattcatgagtctaggatttattcattacatagaataataagcaggaaagagaggggtgaccccacactccacaggccgtctagcttatgtgaagacaggcatccagggggtcagcactgttgaccccctccttgtcatatggacagggctctgtccctcttgctgccacaaaggttgagaatctagggagaaccagaagcacctgcccttctgccaggccccttccccaccccccgtgcatccctgggtgtggtgtccacatgcctgctgcctcactcagaaggcccttctgtccccagaccccaccctctgttgttttgcacagcagaggccacttcgtctcatgagcctttccagctctgcagaggcttagcgggctctcagcctccgaagcctggcttgccatctgcacacagtcccacaggccactgcgcgggcccctgatgactgtgccctggcgagcgtggtcagggcaagtcggaatcttccttaacagagccccacggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcggccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggtacgccacagcagacacaaaggtatgggagcttggtgcctccagccacaaaagtggaaggccctggatgggcacagagaacggcagagccggaaggggccgtggggactgcagagtccaccaccttatgcaccagcacagcccagaggtttggtgacttgtgccaagctaacacagcaggctccatggcaactgggctgtgcacccgactttggatccatcagtgcctttatttgtgtggggaccgagaggcgcctagtggctgcaggcagacaccatggcctggagaagggctcatgctcctggagcacccaggcccagctgtgtggcccataggcagggtgtggggtgggcagagtgtctccgccgggccttcaccctgccctgctcttctctttcccacaggctcttcagctcccctccctgcttctggaaacctctgcctgctgccctggccctgcccccctgcgcatgcaccgtccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggcctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctgatcactgcagtgtccagcccagtgttgaacagattgtagcgttctgtctcattacgagcaaataaatagactttcattgg

SEQ ID NO: 38421 - DNA, 4583 bp, Homo sapiens
gcggtcgtggcggtcggagatccgagagctctgcttctctgaaaagcgtgtggctttctggacttggtgagtgaaaggctgattgtttcctcgattcatccgggcgctggcggtggcgcgagtggccgggcgcggggcgagtggccgggcacgggggcgaggattttggggggttcctgggaactgcttttcaggttcgcccctcgggaaggggtggggcggacgcgggacctgactgcagagtgaggcccatgtcctccatcggcctgttctggggccacatcttccgctgccggaacccctttggtgtggcgcggtccccactcgagtggctttcatcgctattgggagggcagtggtggtcgcggccctctcccacttctccctgcctctcctcccctctccttccttcttccctcctcggcccctttgcggagcactccgtggcctttcttcccatattttgctgttgttttgccaaatggtaaatggttaagatttttaggtaaaaatactgttcccagggaaaaaattggaaggaaaaaataattattctcagggaaaactagacccacgcacgcccttttctttcattttccctctcccctgccacatcggttggggtctcccgtttgagctgatggccttttcccacctctttttatgacattgcgtcccccctaccccccaccccccgtgtgtcgcgagcacgcgcccccgcacagaagccttccattgcagccccctccttgcccctccatcctcaaggttccagtgcttcccctcccccgcgcatgcgcaggcacacgcagcacacaccctctcacacaccctcacaccctcacaccctcccatgccttccccctcctctatccgcctaccacatacacacctctagcaccggccccctccctgctcggcctctgcgtgctctcgcgaacacatgcctattcacacaccccctccggctgccctccttcttccttcctgtcatatacacacataaggacatccttctatcgctggccagtgacatacatatgtagccacatgtgctcattcatacccccttctcaaatgctctcctctattgctctgtctgccacgtgtgtcagacacagctctcttttgctggtccctgaggtgcacacactcgcactcacataaatccttctacggggacacaacctgcctccctgcttgccatatccacacaggcaggcatcattctttgattgcctgcctctgttccatccacctcaagcacatccctctccagtgctgcgcaccccccacccccgcttccatttgtgcctgctgcatttgctcacactgacatttctccattgttgcctcccattttgactaacatacacacacacaaactctcagacactcctctccattgccaaccatacactcctctgcctgtgacatacgcataaacatgggcatccttctgtagtttcagctgcctcacatacagctacacacacaaacaccttccctttcctcatacatacacgcacccctctcctccaaagccaccccacccatgcctgtcattttcatacccacatccagaatgggtctcattctaacactcataccctttccccctacaaacgtaaacatccctctgttgcaggattactggtccccttccacctgtccctctcctcttgatagacagacacataggcactcgtgcacacacggcgatctgtattttccactctattccaatttgcatttctcctgtatgtctgcagcactcagaaaaatgcagacaccccataaaaaaaactatagcagtctttcctttccccacgttgcacaattccacagtacttcacccaccttccaagcgtccagtcaccccccaaccttccgtcagattctcctctaagtctggctttcctgcaaacccagtcttgtaatcattttgccaacattaaaaatgtgttccaggtctacacctgacagtcactggaatgctactccaggccttagaagaaagtgaaactaattttaaaggccccttattctttctgttacctgcctgctgaagtgaaaataaatctccctgctcctttattctaaactgattttactttcccatctcaaaaacgtgtgcagggagcaggagccctcctacccgagccccagctgtattggaaaccctcctaagtcagagtgatgggtcaggaatctagcaagcctgtatggcccaatccaacaggagggtatcagtccaatacaggtaggaggtatggaagaaggcatgcttatgtcagtttcaggccacccacgagccagcgggaaaggattgccagccagagaaagacgaactccgaagtcccaatgcacagatcagcccccagtcaaaccaccaagaggagccgatcgccattttccactactcgtcgtagttgggacgacagcgagagttcgggaaccaacctgaatattgataatgaggactattccaggtatccgccaagagagtacagagcttcgggtagcagaagaggaatggcctatggacatattgactcttatggggcagatgatagtgaggaggagggggctgggcctgttgagcgaccgccagtgagagggaaaactggcaagtttaaagatgataagctgtatgacccagagaaaggggcaaggtctttggctgggccacctccacatttctctagttttagccgtgatgtgagagaggagcgagacaagttagacccagtccctgcagcaagatgctcagctagcagagctgacttcctgccacaaagtagtgtggcctcacagtcgtcttctgaaggcaagctggctacaaaaggtgacagctcggagagggagagaagggagcaaaatttacctgcacgtcccagcagggctcctgtgagtatttgtggtggtggggaaaacacctcaaagagtgcagaggaacctgtggtcaggcccaaaatcagaaacctggcaagtccaaactgcgtgaaaccaaaaattttttttgatactgatgatgatgacgatatgccacacagtacttccaggtggagggataccgccaatgacaatgagggccactcggatggcctggcaagaagagggagaggcgagagttcaagtggctatcccgagccaaagtaccctgaagacaaacgggaagcgaggagtgaccaagtgaaaccagaaaaggtgccgagacgacgacgcaccatggccgaccctgacttctggacgcacagtgatgattactacaaatactgcgacgaagactctgacagtgacaaagagtggattgctgctctgcgtcggaaatatcgaagccgagagcaaaccctgtcctccagtggcgaaagctgggagactctgccggggaaagaagagcgggaacctccacaggctaaggtgagtgccagcactggcaccagccctggccccggtgctagtgccagtgccggggctggcgccggggccagtgctggcagcaatggcagcaattaccttgaagaagttcgagaaccatctcttcaggaagagcaggcatccctggaagaaggagaaattccttggctccagtaccatgagaatgacagtagcagtgagggggataatgattctggtcacgagttgatgcaacctggggtattcatgctggatggaaacaacaaccttgaagatgactccagtgtgagcgaagacctagaagtggattggagcctctttgatggatttgcagatgggttaggagtggctgaagccatttcctatgtggaccctcagttcctcacctacatggcacttgaagaacgcctggcccaggcaatggaaactgcccttgcgcacttggagtctctcgcagtggatgtagaggtggccaatccaccagcaagcaaggagagcattgacgctcttcccgagatcctggtcactgaagatcatggcgcagttggtcaggagatgtgctgccccatctgctgtagcgaatatgtgaagggggaggtggcaactgagctgccgtgccaccactatttccacaagccgtgtgtgtccatctggcttcagaagtcaggcacctgccccgtgtgccgctgcatgttccctcccccactctaaagaccaaggccgtttactcctggtctgattattttccccatctgaaatccacaatactgcaggagccctcttgaaattaacaatggaaataaaaccaatcagtcagttagcctaaacctattgattcctcgtgattatttccaatgtgaaaacagttgtgtatgattgcattaaaaatcatatcatcttttagaggttagaaaagggaaaactaaactttctaaatgctacttgagattgcagtaagaagatacgttttctaacctgaaagttaaatcgcatttgttttcttcagtagaatgggaatgtgttgctgttacttgtaatgtcaagtttatctgttaaatatgtccaaaaggcaaaatcatttttgttgcatgttatgggtcgatgttcctgtaattgcagtgccgtaaaagcttattaaagttgttcttttggttttacatggt

SEQ ID NO: 38422 - DNA, 1999 bp, Homo sapiens
gggtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcggatcaggtacgctgcggcagtgtccgctgctccagccccgcgggcggatcccatctttgcttccgtacctttaccagtgtccctgtctctctgcagtccgagaatgtcgaccggggcgcgggctccatccgggaagccggtggggccttcggaaagagagagcaggctgaagaggaacgatatttccggtgaggctcaccgggtcccaagtccagccctggatctcccaatggccttccaatccttaaactgccaatcgccccacccgttcctacctggtgccttgggcgccccatcccccaacagaactcccgggccccaatccagtataccctaacccttgatgtcccgaccgttgccacgtatagggcactcccagttacctgcacaacagtttcaggcccccaaaccgtttccaccggcgggtctccaaaacaacccacggctcaactcctcctttatcattaccatctcccgcgtggagttctcctcaggtcgtgcgaaacacccccagattcttcgcacagtgtctagatccgaccgcccaacgtttgcctcccagcctgactccctcggcccttacccacctgtcaccccctctacgctctccttcctcgccagcacgccttagctttgcaagcctgcatgcattcaggcttctcaggtgtttctagacccccgactccgcaagagtgaggatgatgggagctggtcatgggagctacttatggttggacaccatcttctaaaggcttttgccctactcagcccaacctagacctgtagatttccctctcctgcttaggagtatggagtgggctgggcctccctttgccagccttgagttatctttaactgacttctgtccactctggagagcagtgaggaattaatcttgcttttgcttgtcctttggcctttcacttctgccttctgttgagaattatcaccatgacacctgccataccgtatagagagccaaggtacagccgttagagactatctaattgagcccctacattttgtagttaaggaaaactgaggcctaaatgtgaccaaaccaacattgtaatccagtcccttcttggaacctaaattgaactgccaagtactgcgcatgcaagagaccctttattggccttacagtgggccattcatttctataggcaaagaaagctctagacagattggaataggaaatggatatttgccttttagctacacccctttgtctgtcttcctcattttgttcctttttttttccctaaaggggagtcaagttccctgggttgttcccctcataaggtattagggacttgtgtcacatctctctggagttttctattttaaagaggaatctgaaagcaataagctctttggtcttcttaagatggctacacctcaatttaagatggggtattctttcactagttgaggagtagaagaggatgaccagctagactcccatggaattggaactcctattccttgcttagacattacaggttatgctttgagatctctttggggtgaaggattgaaattaaaccctgagccaccgtgtccttgtagagcacagagtagagaacaactggcagctttgaaaaaacaccatgaagaagaaatcgttcatcataagaaggagattgagcgtctgcagaaagaaattgagcgccataagcagaagatcaaaatgctaaaacatgatgattaagtgcacaccgtgtgccatagaatggcacatgtcattgcccacttctgtgtagacatggttctggtttaactaatatttgtctgtgtgctactaacagattataataaattgtcatcagtg

SEQ ID NO: 38423 - DNA, 4257 bp, Homo sapiens
gacaggaagagaaggaaaaaagagaaggcgctgtcccgctcttgctacggtggcctggaggagtggcgaaaccggaacagagaatttatcacttctgggactcacagtcgtgatgtctttcaagagggaaggagacgattggagtcaactcaatgtgctcaaagtaagcgtgagcggagaggatctggagccgcttcagtcgctccctgaaggttgggaaggagctttgtttcattgctctggcaacaactcgggggtgcaggagagaaccaggcgacttagagctgtgtagtgactcctttttcggtctatgatcgctgttctccccagggtccttattccatttcactcctcatttctataatttcacttccacccctctctcctatcccgctgatcccgtccggatttcttcccctactccctgcagaaaagaagagtcggggacctcctagccagttacattccagaggatgaggcgctgatgcttcgggatggacggtaagagcaaggagtggctcaagcctgagggttctgcggttagaggctcaatagacttttttttttttttcctttgagacggaggtctcgcggtgctgcccaggctgccctcgaactctagggctcaagtgatcctgcctcctcagcgtcgcgattagctgggtttacaagcgcatgccaccacgcctggcttcaacaaacttttgttattaattaggacagcaggagtacctaggattctttggcggccagtgaggactggaagaagtggagattgggtcaccagggagttgggttttgcaaagactgctaggacagggtgggacctatggcagggacgggcccaaccctcttcccctggaccacttatcctcttctctacccctgctcagctttgcttgtgccatctgcccccatcgaccggtactggacaccctggccatgctgactgcccaccgtgcaggcaagaaacatctgtccagtaagttagggggaagacgggatggggaataaaccctcgaaatctctgcacaccactcttggtgctatgcttttaattctgtttccctttctcctcaggcttgcagcttttctatggcaagaagcagccgggaaaggaaagaaagcagaatccaaaacatcagaatgaattgagaagggaagaaaccaaagctgaggtaatcagagagtggagagtgtgttctaggcaagaccctgctgcacacaccaggctggaagggcggagggctgaaggctctgactctgtctcccatctccttaccaggctcctctgctaactcagacacgacttatcacccagagtgctctgcacagagctccccactataacagttgctgccgccggaagtacaggtatgggacgggaaagccagaggtaggaaggctcagaaggagacagatggctctaaaagagttttccagtgtgtattctgaggaatactagtgttctggagatgttacttagtgtttcaagaaaaggagaattttggctgggcgcggtgactcacgcctgtaatcccagcacttttggaggctgaggtgggtggatcacttgaggtcaggagttcaagaccagcctggccaacatggtgaaatcctgtctctaccaaaaatgtaaaaaattagctgggtgtgtggtgtgtgcctgtaatcccagctactcaagaggctgaggcaggagaattgcttgaatccgggagacagaggttgcagtgagccacggtcacaccacttcactccagcctgggtgacagagtgagactccatctcaaaaaaaaaagaaaagaaagaaaaagaaaaggagaattttgtgatttttaaataaagtttgggaaatggcactttgtaattctacttgaagaataacagttttaaaaactatacaaagtcttaagattaaaaaaaacttgtaaaattttaagctagcctttcccaaattcatgattctgaaatcctttgtatgcagaacttattaatatcttgagaaatatagtttaagaagcactgttttaagaggttgggagtcataggagagttggccctttcccttactgcttttacagactattcttctctacctagaccagaagcccctggtccctctgtctccctttcccctatgccaccctcagaggtcaaactccaaagtgggaagatcagtagggaacctgaacctgcggctggcccacaggccgaggagtcagcaactgtctcagcccctgcacccatgagccccacaagaagacgagccctggaccattatctcacccttcgaaggtgagtatgcctaatcagtttcctcagattttcttttctctctgacacccttgtttcaaagctattgtttttcctttttttttttttgagatggagtttcactcttgttgccccagctggagtgcaatggcacgctctcggctcactgtaacctccacctcctgggttcaagcgattctcctgcctcaggctcccgagtagctgggattacaggcatgtgccatcacgcccggctaattttgtatttttagtagagacggggtttctccatgttggtcaggctggcctcgaactcctgacctcaggtgatccacctgcctcagtttcctaaagtgttgggattacaggtgtgagccaccgcacccggactcccattgttgttttccatctttggtttcgttttgttttagccacccaacttacatggctctcaattttttctcactgctaactttttttttttttttttttttttttttggtagagacagggtttcactatgttggtcaggctggtctcgaactcctgacctcaagtgatccacctgcctcggcctcccagagtgctgggattactggtgtgagctcaccactaacttcttaataagcctctttcctgatcgatgctattttctctgatgtttccagctctggatggatcccagatggacgaggtcgatgggtaaaagatgaaaatgttgagtttgactctgatgaggaggaaccacctgatctccccttggactgatacccttttcccattcattcacaaataaattacaatgggtgctgagaacttaactttccttaagtctggttccttgttggatctcaggatttcagatctgttcattctcattccaactactccttgcctgcaaggtacacagctctccacactccttttttttttttttttttttttgaggcagagtctcgctctatcgcccaggctggagtgcagtggcacgatctcggctcactgcaagctctgcctcccaggttcacgcctttctcctgcctcagcctcctgagtagctgggactacaggcgcccgccaccatgcccagctaattttttgtatttttagtagagacggggtttcactgtgttagccaggatggtctcgatctcctgacctcgtgatccgcccacctcggcctcccaaagtgctgggattacaggcatgagccaccgcacccagccacggctatccatacttctaacccctcccccacctcctaccaaagccatgccaagcgtcagctgcatcagcctggtgccctattaataagactgtcaaaaagaggtctttgcccttcatgttgtctgcctgcttctccactaccactcaaagtcctttcccccttcaaatcacataaggactgcaggtaggcactagggggacctggccacatctggaaacagggctgtggctaagttccctgtgaaagtagaagagtcaaaaggcattggcagggttatggggaacaccaagggagggaacacccccacctcctcctagtaacctgaacctccctgcctgctgatccccagagtataaataatcccctggtgaactggcagtaacccttgggggttagcgccaagattctcaccccaaagcccaaggaaggaggcaggcaaaatggatagaagggcttttatttacaggaaaggaggacagatgaggatttaagtgtccagtgctcccagcgctagttggtaaagggaaatgcagtgttatctcttcttttgctggcgacctgtaaaggagcaatattaaacataagtgtttgttccagctcctgctttctgcaaaggcactcttctcctttccagtcccttagccaaactcataaattggtagtgtcttaggccaccttacaggcccatcccacattaacaaaacaaaacaagaaaccacaccacaaataaaattacgatacctctaaacaag

SEQ ID NO: 38424 - DNA, 26321 bp, Homo sapiens
aagggtgtccgcggcctgccctccaggcggaggagcccggactgcggaaggatggagctggccgccggaagcttctcggaggagcagttctgggaggcctgcgccgagctccagcagcccgctctggccggggccgactggcagctcctagtggagacctcgggcatcagcatctaccggctgctggacaaggtagcggccaacccgctggaggaccgcggggcctagaatgcgccggggtcgacctccccgcagggagtgcggggcggcagtcgcggaagggacaggggcgcgtcttctccggctcaggaaggagctccgcccggaccctgtctcaagctctggagctagcgcaggggcggtgcctccaagtgactgccgtgcagatccaggggagttggaaggtcacaggagttcagcctcaggtcaggcccgacggggcatgtagttagaagttaatgacagttgaaacgtgggtcagctggttcctaggcccgtgcacacgtctgcaagggacgttgatcctcactctccaatgcgtgtcagtggcatatgggggctggggtgggggaggggcggtatcttagggcttggatataggaggaaaagaaacagaacttttcaaggactggatgtgcagggtggtgtcaggggttgccgagaagggccctactgttttagtgactcgtttcttttggttgttgccccttccttccaagttgctcttaataagttgagtccgaatcttcaggcaggagtaaagatgtaggaggaatgggattggttgttgaagtctttggaatcaggtagccatccaggtggaaggcattgcccctgaggcctgtcatccaaggcttgtcatcagttgctttgtgtaatagtcgcagcatggcaagtaggttaaaagtcgcctgcaggtaatgtgggtgaaactgaagtttcctaatacaggaccaggatattatagtgttagagttaggaggatacctcatgctcacctggttaaaccccaggtttcataggtgaaagcaacaggcctcaagggtgaagtcactcctgaaatggcccagataagtgaatagcagaggtgggattggagggttcatgatcttgtgaatgtcaaacatgtggttgcctttttaggcacttgcatttttgtttacatcaaatatagtgtttttatattttaaaacagaaaacaaacgtttgcaatatttagaagttgctcacctgttaaacaggaatgaaaactctgcctgtctcattgcaggaatgaaaactctgcctgtctcattgcagggttgttagggggttcaaatccaatctgtcagatatgtgtgaaaatttgatagctgtaaataactctacaatgcacaggacagtgaccccatacctctcccggggaagaattatccagtcccaaattgtaatattgccaaggtcaagaaaccctactctaaataaatggagaatataggtattatgaagaaatttcctgtctaaatacatatatatttgctttggatgcagtccgtccctctccagttagtgggactgtaaaacatgctatttggaatacttacaaattagtagggctggcctttacataatccagaacacagcagatactgcaagtggctaagctgccatatttactttttttctgtatacagatgttatatcttgatggattactcactcaacaaactctgaatgcttgctgtgtactaggaccattgggtttaacaagatgatcaagaagttcacagtctagaacaggcagaattaatttcttagggtaactttaaaaggtaccttagtttgaaaattgatacattttcagaaaaagtctttcttttaatttttattttttagagatgaggccttgctatgttgcccaggttggtcttggaactcctgggctcaagcagtcctcctgcctcagccctcagcctcccaaagtgctgggattacagggatgagccaccacacccagccaggcaaaattcttttatcttctctgctattccatttttcttaccagccacatcaaggctttggccaagttttgttgattcaactgctcagacgtgtctagcatctggcttatttcctcccattttctttcctttatctttgctactttgggtactcagcacccctcacttagaattgcagtgacctcttaactagtttttggcctaccagctctctgctcctgtctatcctacaccttccagtgcagtcaaacatctgagaagcagtgatcttatcactaccttttcagtggcctattgattgcagaaataataataatcatcactgtaatagctaacatttattgcatgatttcttataattcaggtgctaagtgttttggaagtattgatttactcaatccttgcatcaaccctatgataaggtactatgatgatcacctttttacctatatataaatgaatgcatagaaaggttaagttggtttctcaagattccagctaggatccaaacccagctgtctgcctccagtcctgtgtcttcaacatgctcctgcattgcctctccaaacagaaggcaaatgctgcctggtgggtacactgaactaatttggtctcaactcacatttccatcattctctcccattaccatagacctgacatcttctcctctagcgagcccagaccgctgtgccatcttccctgtatacagacgaggcagttgaggtccagggaaagtcagtggcatatacaaagcacacggctaagaagtggtgaataaaactgggatttagatccaagtccatctgcccatgaagcccctactctttccccaagccacacacactctttttctaataaagcttccagcatgtgggatggaccgtcttaggagggtgagtcctcattattggaagtacagtactgtgttggagaaaaaactcaaactgtttttttcattatctcaacatcaccaacaacacagaagcacagaagactcctgtgaccaaatgtctgaggatttctctccaaacaccaagtaagcagtcagttttgcggtggacgtcagctaggtgtcctcctgttcagtgttgacactacctacctggaaatagtgtcagatcccgtaggttgaggtcccagtcccacaagattaaccccctcttccctgccacttgtaatgccagttgaaagccccaggttgttttacctgtgcttctgaccaactggctgtaaataggggatcccatgaccccctccttggattcaattaatttactagagaggctgacagaactcagggaaacacttgctttcatttactggtttattataaaggatactacaaagtatacagatgcataagatgagatatgggggaaggatcttggaacttccatgccctccttggatgcatcaccctccaggaacctctatgagttcagctatccagaaactctctgaaccccctcctcttgggtcctttatggaaacttcattggctaggcatgattgaagcatggacaacagtgttgaaatatgactggacagaaagggtctgatctcatattaatagactgattggggaaacccaagaaggcctgtccagattcttctggcctctccatgcgacattccttcttccagggtatgaggcaggaccctccctggaatgaagttcttgcaactcttggctcaactcctgaggcctaaagtgcaccaacgtacaaaagactgtaacgagggctatgagagttatgaaccaggaacagtggatagaaacctgtgtgcgcgcgtgtgtgtattggatgtacagtactggagtatgtatgtgggtgtgtgtgtatactctatgtccaatacacacacgccgccacacatatgtatacacacatatgtaaattatatatttatatacacacatatacatatgtatgtatatgtatacattttgtatatatagctcataatatcacaagtactgtattcagaaaggagaccagagacaatttgtttatatacttcattgagcctttattgaggatctgcaatgggtcagatttccatctatggaaatggatctgagatagagttgctcccctgaagattctagtggcttagttatgaagttatgggcgtcggttggactgatggtcctttaaggacccgattgtgcatagcatgcttgccactgtgtggtacgagctggttgtgacgacccttcactttgcttcccacactcagcatagaggtggccaacctaaggccaaagctatgtggcttcttggggctcttgagcaagatttgaaacaagaatagagaaaaagaaaattgtgaccatgatttaaatgatgctgtaacaaagttactgttacatgtttttaaaagactgaaagaagagtagaggctcttgaaagagatttcaatgtagcaaattgtattttgaaataaaaataatagaattgtgtccttttttttagtagacacaaattattctgaatcctgttcttggacaagtgggcaattttgatgtacagcttttgataatttttttttgttttctatttttctcttaaatcacaaaattctggactggaaagtttcttctaagccatgctgtccaacaccattatctttttcctctacttcttctttctttgcctactctatttccttcctctcttatttcttctccatgttgtaatgataataactttatttgatgctgcaaattataaatgctgtcatataagttttcacttatccttctaaagagatgtggaagataggcaaaaatgggcttactttacaaatggaaataagatccagagttgttgagcgagccacatgagacctcataactaataactaatgtgaacagtctactatgataaactcagtaccaaatacacaacttgcttccatacaagaactacattctgtttccggaggctaaagcaaaactagaccagggctgccatgggtattgtgggaaaagcatggattttggagtcagatagtcctgtgtgagagtctcagctctgttcctctatcattcatttaagcatttgggagatattcatcaactgcctcccatgtgctactgtcttcatagaccctggggataagtggtgaagaaggaacatggtgctgctgcttcaatgaatgagcttcttgaacatggatcatattcattgatgagaataagcccatagtatatgatgaaatgtccagtggaaaatgctataaagtactttaaagaaaatgttataaagaaaataaagcgagataaaaggatagagagatggcatggcagggtagccaggggtgatgtgatgtgtttcagataagggagtccagaaaggccctctgtggaagtaacatttggccgatttgaataatgcaaatatctggaggagaaatgaatctgagagtgtttctcaaagttcaagcacattggaatcactcgagacagctttacaaaccataccaagccctaccttagggattcaggtttaactggtctagggtggggctttggtggtccttttgagaggctcccccttcacataggggttaattattttgtcctctctactttcgtgtatgtttgaaatctttcataataaaaccgttttatacacgtgtgtgtgtgtgtattatgaatgtgtgtgtgtgtgtgtgtgtgtgtgtatatatgtatatatatatttaggcttctcaggagattcatatgaacatgctggcttttaagccactgagatagagggaacactgggttctagtccctcagccaggctgagcttgcctcattttccaggaggagccaggaggcccacaggactggagtggatatgagattgaagagtggccaggggccaggccctacttactggccaggtgatattgatcagttactttttcattttgaaatctcagtttcctcatttgcaaaacctggataatacttacctttcagggttgttgagaggattgaacgaaatgataacatggcagaattgttctcaaacttgagtgtgtattggaatctcaaatttgagcatgcattgagtgtgcatttggatatatatatgtacacacacaaaagcatgcattgagtgtgcattagaatatatatacacacacatgcttgtgtgtgtatatatgtatatatatacacatatatacatgtatacatatatacacatatatgtgtatatacacaagcatgtgtgtgtgtgcatatatattctaatgcacactcaatgcatgctcaagtttgagattctaatacacactgaagtttgagaaccattctgccatgtatcatttcattcaatcgtctcaacaactctgaaaggtaagtagtatcctggttttgcaaatgaggaaactgagacacacacacacacacacacacacacacgtatgtatatatatatgtggaaaatactatatgtgtatatatatacacacacatatagtatatatgaatatatacacatgtatatgtgtgtgtgtatatatactaatcacactcatcaatgaatgtgatccacgttctcatcaatgaataagttctatgttcatgtatgtatgtgtatagatagatagatagatactcttcttttttatgcattatatttctaaccagctgctgaatgatgctgaggctactggtccgggaatcacactttgagaaccactggtggatggggagcatctagcatggtgctgaggcagttctgacattgagagctaaagtcagaggcaggagaataccctagagatgagatgcaatggaaattgaaagatgaaagtgagaccaaaaaatgtcttaagacaaaagcaacatccattttagggctccctctccctgatgtttaagttagtggtcacttgggagtaaatgtggtcccctgagcagtgctgagaagtttccctgagagaagggccatgggtcacttagaaaagctcttccagtgatctgcaagtcaggcccttgcaggaacttcaggcttcgttaccatgccattaaccactgcccatagagtgtggaaccagtgcgcagaggctcacagcttcaatttagagaaaataaatgttggactgaaaagctctggctgatggcttgacttattaagtttttaaatctaaatatctggcactgtgagaaggggcagcctaaattgtgtttttgtccttgaatagggcttctaatcaaagagtttggtgaggagcagacagtactttcccagggactgttcttccctgtgctcttgacctactaaaattctcaaagaccagcatgactggaaaaactgcatttgggcaggctgggctgagagaaagtttggcctttagagagaaacacagatccatctcacaggagaagagatttcactctatagatgtgaaatccctactcctatttccccagatgggataataagccaattagcatcatgagccccattacttcaggattgtaaaactgttctgctcctttctgtcatccttctgattaccagcgtgattgatagaatcattcttgagccctggtcacttatggagctgaaatttacttgtgggcagagccaccatgtctccaggacacccgtctgtggcattctacttcccaccatagaccaaggccagctccttcttttctgtctcccttgagtgtgcaactgggtagataagttagagtctcagtttttccctctcctcgcatctgtcttaggataagcctgtgggtatgaggccatgcgagaatgctggtctcaaggttcagatttggtggaaggaggggagaggaaggagtaagatgcctcccttctgtctccaggtataagccaagctttatgctctcactctgtctttcaccagattgctgtatggcgattacaggaggtggctattaataaaacaaaacactgatatttcattcagccttgggaatcccttgagaagagagatgacttgtagggaagggtataggcattctgaatgcttggacataataccataccaacatctggagtgaaccagcaggtgaatctggggcaatgctgaatagaggttcttgtctctatacatgtgccttttctggacattttgcagaacatctttaagcctcagttttcctgtttgaaaagtgggtttactgatggtccatacctcgtatcattatttggattaagtgggataatccatgtaaaagcacttggatcagtgcctgctgttcagttaatactcagtaaacatcagctatgagtattgttttacctagctgtgtgcaaccctgaaggattagacctatcacattttcttagagaggtcttaaatattaaatcagatttagccaactatctgtctttgtagagtcttggcacatacttcccagcagcagctgcagctttgacttctgccattagaactgctttactttgatgaaaaatacttatttttcataccatctgagtctattacttgccccaaagtggatggacttggacagcttttagataaatagattgggggtgtttcctgtccctctgaggaatggaaatgagcgcttctgtgagaggcaaagagaactcaatgcacactcatgagtgcattcacaggatttgagaatatgtgatttatcaagaccaccttgtagttagtggtgtaaattcagataaacaccataaattggaggtaatgagtggtgcctttctccaggcctggatgggtgatgggacatctacaggagattactcctgtgtggggattgcaagtgtcatttgcaaacattacgacattttgacacatctcatatgtaaatgcatagcatctctttcagagtttattctgtttgggacaaataagtgtactgttgacaataatatttctcagaatactttaaccttgtaaatataattgaaaacaaattgcacagatgttttttttcacgcatttgaatcaccattgctgagaaatataccagtttaatgtttcgacaagttagccagcacgatagcatctcaaaaattagtgataacagtaacagatttcctggccatgcattcccctgtctccagcctccatttcttcacttataaagtggagttaatgatgcttacatcacaggattattgcaagtattcatgattaagcccagcctggcttagagcaggttcactgtagatattggttttcctgaaaatgtacattacagttctgaatcccagttctttaatctggaaaaaggagattatcgtacctaccttgttaatgaaatagtaacctaccttattaatgggaatgatatctaatatttactaagtacttattatgtgcaccacataatagaactttagatggattatctagtttaatcctcataatcattccatgaagtagaaacttattagacccattttgcaggttagtagtggaagaggttagattctacccagacggtgaatctgagcccatgctattaccaccacactgtcttttctgactagcttttctgatttatgagacagcactttggaatagtatatggaaaaacttggcacagtacctcatctgttgaaagtgataatattcatctttctctatacctgcctttctcctggttcctttctgaacccttcagaagcagcatctaaaaaaaaatacttcttctggccctttggaggcctgttgggcaaacacaccaggcttagggactcaggggagcatctcagtgggaggtccgttctgggtggcctggagcaggagtactggcttagggaaggaaagggttcccatccaggctttgccaccaacagcgtcatcagctgactcttggcaagtcactcacattacacagctaagctaagaccccttcctgctctaagatcctgtgtgatgggtcttctttatctttatcattagtttgtggtctggaacaatgatttgggaatgacatgcagagaaaatacagctaaataaggagacattgtagggaatagaaggggccagtgtgcaaagacacaccatttctttctgtctgtcctgttactagctgtaggacttaggcaagtaagttggcctttctaagcatcatttccttctgtaaaggtagagataacaccaacttccctatctacatcacagggctatcttagctgttacatgagagaatgaatataaaacgttggaaagtggaccatgcttagaaaaacaatgactagtattattgaaagaatttgtagcaggtcaaagggattagaaaactccttcaaatacaaaatacatgacttttgttgtattgttaataaatcatcaagggaaacagaatccagtctgcagtcaagtagaagcctctgcctggtttcttcttgggatcaagatatagtgaataccagctggtattcactatatgtactatagcaggtatatataaaaatatatatacctactggcattatatatacacatatatatctgctggtattatatataaaatatataatatataaatatatgtaatatatattctatatataacattatatttatgtagaataatatttctatatatatttatatatattttttctgagttagttattcaaaggagacagtactttttataacatggcatgtagggtcttgtacgcatttgtgcaaaactaaatgttgtatctcaatttaatatccattaaagtgtccattatctcttccttgacagtacattttagcaacatttatgtacttctgtactgttttaatgaatttatgtataattatatttcttgtaaatattcataagtcttaccagcactattctgtcagtctacttttttaccttgatgtcagatttttaaaaataaatctggacttggtaaggagagacttgtattcaaatggattatttcaaggagttagggaaagaagtattacagtaggaaaagtgctttgccgataagctctgcaggcatcttgggagttgcagagccgttcttttataaagaggagcaaagaacgttagaaagaaccatatgcggggatgtgggatgaaaggatggcatgatcggatagcagatcagagaatacttttccctgagcccagcctgttttcaggagggactgtatgctggctcaggtttaggatgggccaaagttcaggggcctggaggaaggagaaaagttcaaccagttgggttaacaagcattttgttctggttgatcagtgggggtgggcagcttagctaatcatttataagacaaagaaagggaaatctggagggtctgtgtctggccttgtcataggtaaacgggggcatccgtgagtcttatctaagtcatatggggaagggtagtggatcttcacagtaaactttatgaaacacaaaaggtaggggatttcttaaccttcactgtaatctaggatgacagggttcaaataaaattcagcattgttgataaggaccactatgtcaattaggattgtttttagctacaagtaatagaaaattggacaatcaatgacaaacagaggcatgtttatctcacctaataaataggtcagagttctacctattggtagagtttgctgtcattgatttagcattcagtgatgccagcaaccctctgagtctttctactctgtttctcatgttgattgcctcttggtcataggatagttgcagcagttccaaccatcatgtccacatttaaaacagggataagtcacacggctacctctccctgcagaggagaccagggaagttattggctgtttacattgccacggggttctcttaataaggagaaggagtgtttaccacatcaagtcttatgtttcttctggcagttgcattctgtacatgatactggctaattctctacttccaacataatccttttactatttgaattgtaggaaactaaatgtcttataactggagcattagaaaagtatccattatattttagtctagataaggaaattgagccactgttagaggtggttttctggaggagcttcaggaaaagccaagaatctcttgagtaagcttctttggagtcatttattcaaatgttagtaagcttggaaaaataaaaccgatattgcaaaagatttatatctctaattttaagagatcttacacatcagatcttattatagtagcaataaaagttttgccaaataagttttgctttttcatatcaaattgtttgtataaacaatggtgcccaacgctggtgagatgctcctttggaactggtgagaggaactggtgagagtacacacttggtgcacacgttctgcaaggtttgtaaaaagtataaagagccttaaaatgttaatctacttatcctaaaatttatctgtaagaaaacatttgtagtaaaaaaaaaaatagaattatggaccaattattctatacaaacataaatattctggaaattttttttcataaaaatatttggaaacaaatttttttggagaataattgagttaggtatggagtcttcataacctcagtataatatttagttaaaaataagaatacaaactatttataccatgtgattcccgtttgataatgtacagatgtatttatttacttaaaggaaatatgtcaaatattatcagtagatatttttggattatggggttacatgtcaccttttaaaaattctttttgtcatttttataaactttttaattataaaaaactattttttaaaatatgaagtaaaaatgagtgtggttgctgagatcctttttaaaaagaaataatgggtgagaaaatgctttgattcaagaatgtggaccaggctgttcagcgcttggacattgtattgatgaagtaggaaaggtgttgccgtgttatggagcatttggttcctctggagctctggcattgctcagttctgcctcgaagggaatgtttaaaggaagttgtcgcaatcgttcattcttctgtactcacgcaaattatggttgttctatttttctcttccttgagaacttcctgttctcattgtctgtgccatataacaggatggaagtcactatgggttgtaactacattcaggagaagaagagaaccagtgtaagggaacagtgtgttttaatttatgcagatatccaatgctaacttatttaaaggttggggaggtcattatcttaacacataagaattcttgttgcttagaatgtgtggaaaacaaggcctcagttttcttgaataattgctatttgtctcccttccaaagcctatgatgaaaacaagtgtgtatgagtgtaaatgtgtgggtatgtataaatccttactaagttcaattgtgtgtgtgaggggagggggcaagagagagaagatgtttatcttcctgacatctctcatcagaccctgaggtctgcccttctactggggcatccatggcatggcacataaggggttcagatagactagtttgatatttgctggttggaaattcttggtataaaatcacatgcttttagagctggaagattcttatggattcattttcaattttacattcattttttgccaggtactttcacatacatctgagattcctaaaccgggatgtatttatccctaggttataccacccaagctagaagacccttaaagcttcaggatctctagaaagattcagcatgtttattccttgacttcccctcaggccatggcacagtgtttacagagagggcttcattcatgcatgattaaccagtaacacggccttagcacatggatgcaagagttcatccaaaagtttatgttcgttcatttgtttctttgcctttgtgttgaaattaatctaatagccattgctttaattttaataatagagcctttaggcaaagctgagggtcaggaattgtaaattgccaccgtacagagagtgaaatgtgtgatggggcaactctaggccaggaccctcatggacaagaatatggcttaccaaggaaacaagggaactctcttgtactttggaatctagaaaggccttttcccaaatcaaaggaacttatatgatttgaagcagatttcttttgtttttcattttcagtcttttatacagaatcaaaaagaagcagttgttgaaaaattctgtcttggaattgataaaacaatgtgttgggtttcactatgccacatggctatttaaaatataacctctctcgagaactgtagctgcctatgtgacacccttacttggatgcttaataaacatcttaaactcaacttgttcaaaagagaactcttaattaccccaaaagcccaccaatcacctcttctccaagttttttttctgtcttagaagatggcattcccatctgcccaacttgggttatgaaagttatccttgattctttgctttccctttccccaggatctatcaggaattcctttttactttacctccaaaatatatccttaaatcactgactcctcgccatcactgttgttacttccctgttcaaatcaccatcatttcttatctgaactattgcactggtcttctcacccatctccttgttctctgatgatctattttctaccaagcagcaagaatcacctttaaaaaattaatttgattgcgtcattcttaaactgaattacgaatcagatctggtcatccctctgtttaaagccatccattagttttccatagcaatgagaataaaatctttacctcttaccctggtttacaaagtccttggggtccagccctgacaaactctctaacctcagctcctgccactctctcttttatccagagttctccagaccccaggttctttaaagatgccagcccaccaatctgaggaccttccttctaccaggaacgggcttttcctatcttcctatggctggcttcttccaacatttggaacaagatgctctgataaatgttaactctcatagaggcctttcctgatcacctgattacatagatgtcctccccatccccgcccttgcaaggcatcatttatcacacaactcttcttaccctatttaaattacctagatggcacttatagctatctctagcactgctgcctacctgaatttaagatctctgagagcagggcctgcacctgcttttttatcattgtgtcaccaagaccacagaggaggtcagtgtttggtgtggcatgaacgtcgtcatcagctgcttttctttttttttttttttattatactttaagttttagggtacatgtgcacaatgtgcaggttagttacatatgtatacatgtgccatgctggtgtgctgcacccattaactcgtcatttagcattagatatatctcctaatgctatccctcccccctccccccaccccacaacagtccccagagtgtaatgttccccttcctgtgtccatgtgttctcattgttcaattcccacctatgagtgagaatatgtggtgtttggttttttgttcttgtgatagtttactgagaatgatgatttccaatttcatccatgtccctacaaaggacatgaactcgtcattttttatggctgcatagtattccatggtgtatatgtgtcacattttcttaatccagtctatcattgttggacatttgggttggttccaagtctttgctattgtgaatagagccgcagtaaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacaatcccaccaacagtgtaaaagtattcttatttctccacatcctctccagcacctgttttttcctgactttttaatgattgccattctaactggtgtgagatggtatctcattgtggttttgatttgcatttctctgatggccagtgatggtgagcattttttcatgtgttttttggctgcataaatgtcttcttttgagaagtatctgttcttgtccttcacccactttttgatggggttgtttgtttttttcttgtaaatttgttggagttcattgtagattctggatattagccctttgtcagatgagtaggttgtgaaaattttctcccattttgtaggttgcctgttcactctgatggtagtttcttttgctgtgcagaagctctttagtttaattatgtggaatgcagctttctctcaacttgggaaccaatagacatttctacctgttctgtttttatagaagactggactttatgagtataaagtctttggtgttctggaggactgctcaccaactctactggcagacatctatatggactcagattacagaaaacaatgggaccagtatgttaaaggtgagtgatgcttgcttttcttttttttttagacgtactttcacttttgtagcccagggtgaagtgcaaaggtaggatctcagctcaccgcaatctccgcctcctgggttcaagcgattctcctgcctcagcctcctgagtagctgggactacaggcgcccgccaccacacctggctaatttttgtatctttagtagagacagggtttctccatgttagtcaggctggtcttgaacttctgacctcaggtgatccgcttgccttggcctcccaaagtgctaggattacaggcatgagccgctgcacccagtgcttttttttttttttttttttgatcattaaaaagtagatctattctgaccagatgcagtgactcacgcctgtaatcccagcacgtggggaggctgaggcggacagatcacttgaggccaggagtttgagaccagcctggccaacatggtgaaatcccgtctctactaaaaatacaaaacttagctgggcatggtggcgcatgcctatagtcccaactacttaggaggctgaggcactaagaattgcttgaacccaagaagcagaggttgcagtgagccaagactgtacttcagcagggacaacagagggagaccctgtctcaaaaaaaaaaaaaagtctaatctatttttatttattcttgccagtagaaaaaaataaaattaacttctactacatagtgcttcctattaaattttggcacaaaagcattttaaatgttggactgaaatgcacttttgctattgctaggacttgctccttacctagttttagatcctctccacagtttgctcttggggctcctttgctgccacttttaagttgtgtgatcctcccatgtatctaggttgtcatgaaaggggaggaggtgcggtccaagttttggtttgagagttgaatcaaaattttccaaacagagaagaatacatgtatgtgaggaggtaagagagggacaggatgactggttaagagcattctaggctcagggatcagcattagtaaggtcaggaaagcgtgaagcaatatgttcaatagccgccagcagtttggtgttgttgggttggttggagtaagagaacctatcctaggtcttcgactactgttagtactagttctactactactattgttagtactgctagtactagtagaactagctaatagaactagtactagtagtagtcgaagagctagggtaggttcttctactactaggcgaactagggcagctgttgggtccagatcctccagggcctagcatggcgaccaggctatcggtcttagatttttccctgtaagttatgtgttatgaaagacatcacacagggacttctcctgccacttagagctggagtagcctctgccaacccagtcatagtggaatggaactatgaaactagccaaaggcacataaagcctttagtcaagactcttggttgcaagtaacagaaagccaactaaagacagtgtaagaagagaaaaaggagtttattagttcatggcattgaaaaaagtccaggggtttctaactttgaggacagctgcaacagggaacttaaataatttcatcaggattgtttctttctccatctgtagactctgttttcttctgtgttgacctaattcctaggcagattcttatgtcatggccaagatgtctgccagaagatccagatttatattctaaccatatgaataaccccagaggaaggagaattctacttttctagggatgacagccagatgccaggattggctcttgtcagctcagcttggagtttgtgcttattttctgtggacattcatcatggttttgggcaacttagtgttctcaaatactcttcctatttagggggcagtgggatgcttacctatccaagggaacagccagacactgtctgtccaggcctcccttgcagccaagatacagtcatgtgacatagactctgccaataagacccacatgtggcttcaatttggaaaagagccatgtgaggaagcaggcagcatggaagatccatttttcagtgaccagtgatggcatctgactttagggaaaacaactgctgagtctctgatgtttgctccccaacatcaacagctttcactctgggttctcatccagtggaagcagcagttaggctttgctggaacaatcttgaggttggaaatctcactctggtccatccgagagctttactaaatcactttttgctctcaacttgctagagtgactaactacgactctggacagatctgccatccctgaattcgtcaccatggccgtgtcttgctcattttcccagccctgaaattactgcagagtcagtcttgcgaaaccatgcagctgagaagtaggggaagggtgatgccctgaaggaaaattgagatgctcaaggggcgatcaatgctgagcatgtaaaagcaacagatgtccacctctccctttcttttaaggactctcatcagcctcctgtgaccttaatgggctggcacactccttaatctacagtgtgcttctaatagattttctttcaaaacctaaattatccctccttaccatctcctccagggactttgggctcctttaactggaggtagaaagaagtttactgcacagcacagtctggggacagagggtgtgcatgccattaaatttctttgctatctccctccaagagttggctgctgtttgcacataatagtaagacggaaggattattagggaaatttggtcaccctagctgtggcatagtgcaaagaaacatgggagagaagaaagaaacttggggtaagccatagttctgctgatctctaactattcaagaaggacgttgctcattctggaaccttcatatccgacctatgaatgtgctagactgggtgactccgttccaggttagctgtaatggatcaaggaatcctaaaggggaattaaagggctcagaagcaaaactattggtactctagtgacatctggtggttatcctgaatttaaaacctctgactatttttttgatgtctgattttgtttcattgcattctatcaagaatattgattatgctatagaatggccaagatttgttggcttcttttatttgtgctgtgtttttctatccactagactctgtccctgggcaataagctttcagtggaaattaatcggtttgacttttttctagaattttataccttatgagttagtggtttatcataacctaagaggtcatctttttttttttttttcttgagacatggtgtcattctgtcacccaggctggagtgcagtggtgcaatcatggcttggctcactgcagccttgacctgctaggcttggatgatcctcctacctcagcctccagagtagctgggactacagacatgcaccaccatacctggctgatttttttgcttttttttttttttatatatagagatggggtttcaccatatttcccaggctggtcttgaactcctggacttgagcaattgactcaccttggcctcaaaaagtgctgggattacaggcatgagccaccatgcttggcctaagaggtcatacccttattagttgtagctaaaaaggcttccagatgcattaacttcttttgctttcctttagaactctatgaacaagaatgcaacggagagactgtggtctactgggaagtgaagtacccttttcccatgtccaacagagacgtatcctttccacaaggtactcattccctggccctctaagtgtttctgtgttcctcagctgcagtctattgcagagaggtagagctggtttctcagcaggcacagataacattgtctctgattcttgcagcagcatttgctaaagatattgcttcttgtatggtgtttggagagctcagagtgtgatttctgggcccaaccacatgaagtgtctgtaattttggtcactggagagcagctcttactttcctaagaagtttcctaggccttgaaattgtcaggccacagaattggggatctggaaggaacttcttataaaaagtgcttgttacagctccctcagtctacagaaggaaaaagggctcccaaagaggtgataggacagaggcacataggtggttagtggcagagcaggtgctggaactcaggcctctgcatttccagctctctccgcctcccccatctcagtagaccccacagaaatccctccttgattgttggctctggacactgactgtaagcttcttcccctcaatgtccttgtttatgaaatgaagcagttgaatgaaatgtagggaggcttggctggcactgtaaggtcttcagaagcccccttaggactaagctggggggctaggatggaattttgggggtgggtaggatggaagtaggatgactcctaggtaagattttgactccttcaccatgctcttcaatcccagcagcggagtgttttacaggttcaatttccatgtaagatccttttagcaaagggtctcttggagtcaaaaaaaagtttggaagccactgaattagatgaactgccaacacttcaaaggtgttctgccaaattttaatcactatatcaagataattcttcctccgtggagtatcagatgatatctatcacatgagctgagaaagttgggggagagagtggaacaatatttgctaaaaggaaaaagtaaaaggtgtaggagaaaggaacccagtgacaaatcaacatctctttcctgaaacatttaagaactttacttattagtgtataagagcatggagcaatagactgtccaatgtgagggtggggcaacagggggcgctgtcaagacactgaggtgggactgaacgcgggtggctcacgcctgtaatcccaacactttgggagtccaaagtgggcagatcacttgatgtcagagttcgagatcagcctggccaacatggagaaaccctgtctctattaaaaatacaaaaaaatttagctgggtgtggtgggcgcctgcaatcccagctactccggaggctgaggtgggaggatcacttgaacccaggaggtggaggttgcagtgagccgagatcgtgacactctactccagtctgggtgagactctgtctcaaaaaaaaaaaaaaaaaagacactgaggtgggtggaggctgagacggctgccatgttatagtaagtgtaattgtgttgtgcgtagtgactttttgattattttaggtttttgattcctttgagtgggaaacccaaaattctgttttatgaaagtgtaactaacaaactaaatatctgagctccatccaactatgaaattctaagtaggttttggagccagatctgggataaaaattcatgtttcatcacttcagctgggatgtgggatttttggcaaggttcttttcctctctgagcctcacttttgtcatctgtagtatggggatactcataccaaactcacagggtctttgtaaggatccaaatttaagctgtatgtcaagtgcatgatgttacatgataaaggctcgataagtagtgattcctgttgtttcatagactttcattatcctccctagaatagtgccgtaaacttaagggttcttctgtcaaggctgatggacatgaaatggttttgttattcttggtaaactagtgttagcccagagaggacatctgcctacgaaatattcatgtagtcccatgtcttcctatggtcatcagctgtaacattgcttgaccatttactatgcataaaggtcagtaattagagcattgggtgaggccagaacaaagaggaatgacaccattgtctgtcgagtgcttactctgcccaggtctttctctaatgcccccaccaagcctgtctgcaaggcagtgttactccctttcctacatagggaatctgagtctcagcaaggctgagtagcttacctaggaccacacagctgttaagtgaccattcctctgtcatctcccagtgccttcttggagaaaggaaatgtggtttcctcacataattaaaagcatgaagggatcactcacaggtaagtaatacatgctctttggtgagaatactaggtggtgtgaggcacagtcttgcagtgcaggtatggagacagggcacgtcagtgaactagtggtagaaaggagcaaatgccaagtgggaggcacagaatcacctccctttgcttccagcttgtggcgctttccttctgtctgtctacaatgctggcgttggtgtcttgccttaactggctatgcagtatgtctaccttcggcagcggcgagacctggacatggaagggaggaagatccatgtgatcctggcccggagcacctccatgcctcagcttggcgagaggtctggggtgatccgggtgaagcaatacaagcagagcctggcgatcgagagtgacggcaagaaggggagcaaaggtaaaacccatggtgcctgtcagtgcacccagccaggggtcccccacgggagggccaggctgatggggggacatgtcgagtacatgaagcgtatccctgaaggtcagaggacaggcaaagctgcagagcaaaccaggatcagcacctagagagagcctcattccaccccaacaaacttgagtagagtatgaggttgatgtttaactctgacccagtctattttctccagactcatggattgtccagatgaaaccagaccattataagtaagccagagagtttagaaagtcacttccagctggtcctgtggatacatacgctgggcctaagggtaggcaagaaagctggcaggtttgtcttggaggtctcagctctggctcagtaccaactcagagctactcaagacctgcccagcttgagtttcagcccccagggaggaaagctgcagacagagagtggggtgcgaggccacctgctctaccagaatgagtgtggccttgagtcctaggcaaaaatctgaactatagttagatggtcaccttgaatatgtcacctaatttttatgagtatctgtttcatcagttataaaatgggattaattttaccatctccttaggattgctagaataattgaatgagaggctatattcaagtgtccagcacttgccaggtatttaataaatagcagcaaaatgtgtctatggctgttttcaaaagtgcctatatttaagtatgccataagggcagtcaatggagagaagtccatctgaattatatgctacctccctctgcagtttctgagcttgaatatgaagatataaagtttgcacagttttgttgctatatttttctggtatttttcctttttctgaattgtcctttctttccctctctagttttcatgtattacttcgataacccgggtggccaaattccgtcctggctcattaactgggccgccaaggtgagatcccaggaggtggggcggggggagggatgggggagtgtgtttgacaaatgttgacttagcccgcggggctgtcaggctgaagagacacattgtctcaggcgtaatgaggctcttttatgaagagtttggttgagtgactctggttagggctggggctgccaacatccaagacggaggctgggacaagagacaaagaattgtcagcttggaatgccagcctctccctgcttgtgccccaggaccccgccagaatcactctctggaacttctggacaatagtctgctcttagtaggaacaatagtgcctttggagcctatattcctctgcttactggggaataagacagactgacctggcttggagacaaccagatgtgtccaagcctgaggaaagcttccacttttgttgttgttgcccttttttttttttctttttctctataagggagggaactgcagtggtagtttgtatcactagagactgcccaggagcctggcattatggggaccatcagcctgctttgcacaagatctactactagagagctcaacagattccttggaagagtgaaaaagcacatcaactttggagtcaaacagacgcaatttcaaatcctggctctgctactgactgtcttgttttatttaaggaagccatgcatttcttcctttttaaaaatgaagatagatgtcttctactgcatagagggggagtaaataagacaatatttaggaaaagtcttgcccagtgctcaacattaactaaataataatatatcctgctccttgatccccaatccttaccattttctaattcagtaaagcaagtgctttcatttctttggaagaatgtaacaatccagcccaagcccatttcttgtgttttcttttttccagaaacactgtttcagaaacatcttcgctttttcctagaaaaagctaacatataaggcctttttgcaacagaagttcctgttgactggtcttacttttgtcctcagtcctactttttgtcatcatctgcaacaacattctgttgaaatccagttagggagcctattcatttttgttcgtcctaaagccaacattgtttaccttctgccacatcccaaagaatcaagagtgaccactgtgaagacatagaaatgacagtctcatttcctttgcagaatggagttcctaacttcttgaaagacatggcaagagcctgtcagaactacctcaagaaaacctaagaaagagaactgggaacattgcatccatgggttgatgtctctggaagtgcaaccacccaatgtctctggaagtgccacctggaagtgccacctggaagtgtctctggaagagcacccaccactgttcagccttcccctgctgtttctgtcttcagaggcctacacactaccacatcctttctaagcatgtttgcctgacatccagctcactcgtctgcttcctttctcgctccccccatcctgggctgggctgccttcttctacagttcaatatggggcagactagggaaacctttgcttgcttactattaggaggggaagtcttcagtagggaacacgatcattccattgtgcaattttacggggatgggtgggcggagggacacaacaaaatttaagaatgactatttgggcgggctggctcttttgcagcttgtgatttcttccagcttgggaggggctgctggaagtggcatttcgttcagagctgactttcagtgcacccaaactggatgacgtgccaatgtccatttgccttatgctttgtggagctgattaggctgggatttgaggtgataatccagtaagtctttcctcgttcctacttgtggaggatcagtagctgttatgatgccagaccatttggagaagtatcagaggcctgaccggacacataatatgacaaccacatttttcctcatcatccatgaggaaatggatgatttctcttttccatatgtcactgggggaaaggctgcctgtacctctcaagctttgcattttactggaaactgaggcgtcaagatggctgtggcagctagcaaaagcaaagatgctttgtgcatagccttgtgaaaaagtatctttctatgcaataagatgaattttcctcccagaatatttagaaatgtagaagggataacagttcacagccaggtaaaatttaactggtggcttaatgactctgcacctttttctcaggaattctgcctaagttgtctgccttttctaccaccaaaaagacttttagttttctatgctttctcctgaattttggtagggtaaggtatttctatgtcaaaggcacagccttgatgatctcagggaaaaattttaatcactgtgtataatgatactgaaccttgattaataacagaaattcaggatgtaaagccacagaatgggatttattaatgtgggatacctcagactgtttgttttctttctgggaagaaaagtgtgttctataatgaataaatatagagtggttttt

SEQ ID NO: 38425 - DNA, 8632 bp, Homo sapiens
gctactcccaccccgccccgccccgtcattgtccccgtcggtctcttttctcttccgtcctaaaagctctgcgagccgctcccttctcccggtgccccgcgtctgtccatcctcagtgggtcagacgagcaggatggagggctgcatgggggaggagtcgtttcagatgtgggagctcaatcggcgcctggaggcctacctggcccgggtcaaggcgctggaggagcagaatgagctgctcagcgcggagctcggggggctccgggcacaatccgcggacacctcctggcgggcgcatgccgacgacgagctggcggccctgcgggccctcgttgaccaacgctggcgggagaagcacgcggccgaggtggcgcgcgacaacctggctgaagagctggagggcgtggcaggccgatgccagcagctgcggctggcccgggagcggacgacggaggaggtagcccgcaaccggcgcgccgtcgaggcagagaaatgcgcccgggcctggctgagtagccaggtggcagagctggagcgcgagctagaggctctacgcgtggcgcacgaggaggagcgcgtcggcctgaacgcgcaggctgcctgtgccccccgctgccccgcgccgccccgcgggcctcccgcgccggccccggaggtagaggagctggcaaggcgactgggcgaggcgtggcgcggggcagtgcgcggctaccaggagcgcgtggcacacatggagacgtcgctgggccaggcccgcgagcggctgggccgggcggtgcagggtgcccgcgagggccgcctggagctgcagcagctccaggctgagcgcggaggcctcctggagcgcagggcagcgttggaacagaggttggagggccgctggcaggagcggctgcgggctactgaaaagttccaggtgaggaggttgagggcctgggtgagagaaagtcccagaaagctccagaaagtcccttatgaagctcagagaccttctgggaagggagtggggctagctggctgctgaatcaggagccagttctcagaaacctggtgccacaagtcctagacttttacagcccgtctagtgtaggatgcgaatggtggggcttctcgaagcacatcccgggtgggcagtcaggcccaagacccgttgcagcagccccgccactctctggatggcaccttctggctctgatgatgaccggggctccgggtcccttcccaggctctggtattactaggaggacacccagcactgtcgcctctgcgctgaatctggtggcctggccactcagaatcaccaagttcctcacagccctccttctcctgaggggaggagtgaggggccgtgaatgaatggctaccagccccctcccatgtcatggcttctcggctccctggagcacattccagaggcccataacagctgctccttctcacagggcacagatgtgaccagcagctgagaaaacagcttcttgcctgggccacacagaggtgccatggccacctccccatccctcctctcagaggagacagaatccagaacatgtgggaaatgggggtggggcgggggtgagagcctgctgtgaggagcaggagacagttgtgggagatgggaccaacgggggacgggggctgtttgccttccagtcctgcaggctccaggcatcttgattaatcgtttttccttctgctttcgcttttttttccccctcttctctctccataacccatctcgtctcctccctcacctccccttcctgtgggagctgtgttctgagcaacatgtgctaccatttaatcagcatcctcagaggaggagcaggccatgggagagagctgagagtgctgacaggggccctgggctcatcttggctgatccagagggggctctctgggcagggaatagggtaggggaggcgggggtctgctacacagataagtcagccagggagcaggaggtgcttcccgggcagcggcagcgggcaggaggcaggttggttcacagaagggaccccagcccctccactgactgcctctcgcctgccctgcagctggctgtggaggccctggagcaggagaaacagggcctacagagccagatcgctcaggtcctggaaggtcggcagcagctggcgcacctcaagatgtccctcagcctggaggtggccacgtacaggtacgagacgagccctgtccacccaggcacacagaggcacacacacatgctggggcagactacgtggctgaaggggaccagaggtgtaggtgatggcaactctgctgccactgggttctgtgactctaggctggtcacttccacaccggaacatgtcctgcctgaaaccgtctgctcccccataggctggagacctgagcaatgtcctgtgcccaggaaatccccccaggagagatgatattgccgagcgggacagcctctggagaggggctgggcccgtgtggggcaactgcatccagacccttcccccaaggggcaaagctccaactctatgtgtgcccgcacccagggggtcatgtcctttggcagccacggaaaggaggcattgcaggcatggggtggctgcactgacttgccacctgacctgggcctcagcctcgtctaggggctgagggctgggctgggggacttccaaggcctcttctagcctggatgtcatggggcgagactcctctgatgcccctagtgcccttggtcctgcccagcctttcattgtccacattttctgttatcctagaaatggctgagaccaaggaggggtggcttctcacttgctatgtggccttgggcaaagcccgcagtctcttctgggaaactggtcctgttggctgaggggccattgatggggcctgaggaaggggctctgtggctggtgaggggccacatgagatccaggaaaggaggagaggcaaggcccagagatggaaggtcagtgaggctctggggaggacgtggaggagaggggctccaccgccagggaagagaagcccagaaggaaggccgcagcactggcaaggacagaggtgaggctacagcgagtgctaaccagactcagagatcatggagcaaagcagagaggagcagctgctcatcctaagttattgaattgattggtccctgctcccctctttggttcaaggggcgctgaggaaggggcctggacacaaagacctctgtgccccgaagagcttgggatccagagtgcttagagatcctgagatgagggccctgacccccagtgaagccaccaaggggaagggtctggtgggccccgaggaatttaactgctattttttgaggcatgaaaaggatttggagagggggagctgaattcatttgcttttgtctgtcgctagctctgggggccaccggggaaggaggagggagcccatcccatgggaacggcctgagaattcccacttccccagaatcctctccttctcagaccctccagatggtggcttggacaatggcagcaattagcatgagaatcggtcccccacacagaggatgaggtcattggcctggggtgggaggaggaggctagcctaagccttgtgtgggtgtgtgtagggcaatgtccgactgtgtgggaatctgcttctatgtctgagctctgctgtgtatcccaaatacagtgtgactttgtgtgaccaagtgtgtgatgtctgtgggtatgtgactgtgtgatttcaccctgagtgtggcttttgtgtgacagtgtcaaatgaagaggaagcctgcagggcctggatggtgcaagctcagcctgagttgtccccagctggcttgctgcctgcaggcctgggggcagagggctgaccccactttccctctgtcctctccaggaccctcctggaggctgagaactcccggctgcaaacacctggcggtggctccaagacttccctcagctttcagggtaagaggaggggccaagttcccccagaaactaccctgctttgctcttcatacccagacctatctttcccgagaggcaccaatctaaatttcaagtccgtggcctccagtgtcagtgagcatgctctcagcccagccatgggcgccaggggcaggcgcatggatactcttgccagcggtggctgctctgtggctcccctcattgccagtgatatactgatgctgtttcttccccctctgcctttccagaccccaagctggagctgcaattccctaggaccccagagggccggcgtcttggatctttgctcccagtcctgagcccaacttccctcccctcacccttgcctgctacccttgagacacctgtgccagcctttcttaagaaccaagaattcctccaggcccgtacccctaccttggccagcacccccatcccccccacacctcaggcaccctctcctgctgtagatgcagagatcagagcccaggatgctcctctctctctgctccagacacagggtgggaggaaacaggctccagagcccctgcgggctgaagccagggtggccattcctgccagcgtcctgcctggaccagaggagcctgggggccagcggcaagaggccagtacaggccagtccccagaggaccatgcctccttggcaccacccctcagccctgaccactccagtttagaggctaaggatggagaatccggtgggtctagagtgttcagcatatgccgaggggaaggtgaagggcaaatctgggggttggtagagaaagaaacagccatagagggcaaagtggtaagcagcttgcagcaggaaatatgggaagaagaggatctaaacaggaaggaaatccaggactcccaggttcctttggaaaaagaaaccctgaagtctctgggagaggagattcaagagtcactgaagactctggaaaaccagagccatgagacactagaaagggagaatcaagaatgtccgaggtctttagaagaagacttagaaacactaaaaagtctagaaaaggaaaataaagagctattaaaggatgtggaggtagtgagacctctagaaaaagaggctgtaggccaacttaagcctacaggaaaagaggacacacagacattgcaatccctgcaaaaggagaatcaagaactaatgaaatctcttgaaggtaatctagagacatttttatttccaggaacggaaaatcaagaattagtaagttctctgcaagagaacttagagtcattgacagctctggaaaaggagaatcaagagccactgagatctccagaagtaggggatgaggaggcactgagacctctgacaaaggagaatcaggaacccctgaggtctcttgaagatgagaacaaagaggcctttagatctctagaaaaagagaaccaggagccactgaagactctagaagaagaggaccagagtattgtgagacctctagaaacagagaatcacaaatcactgaggtctttagaagaacaggaccaagagacattgagaactcttgaaaaagagactcaacagcgacggaggtctctaggggaacaggatcagatgacattaagacccccagaaaaagtggatctagaaccactgaagtctcttgaccaggagatagctagacctcttgaaaatgagaatcaagagttcttaaagtcactcaaagaagagagcgtagaggcagtaaaatctttagaaacagagatcctagaatcactgaagtctgcgggacaagagaacctggaaacactgaaatctccagaaactcaagcaccactgtggactccagaagaaataaatcagggggcaatgaatcctctagaaaaggaaattcaagaaccactggagtctgtggaagtgaaccaagagacattcagactcctggaagaggagaatcaggaatcattgagatctctgggagcatggaacctggagaatttgagatctccagaggaggtagacaaggaaagtcaaaggaatctggaagaggaagagaacctgggaaagggagagtaccaagagtcactgaggtctctggaggaggagggacaggagctgccgcagtctgcagatgtgcagaggtgggaagatacggtggagaaggaccaagaactggctcaggaaagccctcctgggatggctggagtggaaaatgaggatgaggcagagctgaatctgagggagcaggatggcttcactgggaaggaggaggtggtagagcagggagagctgaatgccacagaggaggtctggatcccaggcgaggggcacccagagagccctgagcccaaagagcagagaggcctggttgagggagccagtgtgaagggaggggctgagggcctccaggaccctgaagggcaatcacaacaggtgggggccccaggcctccaggctccccaggggctgccagaggcgatagagcccctggtggaagatgatgtggccccagggggtgaccaagcctccccagaggtcatgttggggtcagagcctgccatgggtgagtctgctgcgggagctgagccaggcccggggcagggggtgggagggctgggggacccaggccatctgaccagggaagaggtgatggaaccacccctggaagaggagagtttggaggcaaagagggttcagggcttggaagggcctagaaaggacctagaggaggcaggtggtctggggacagagttctccgagctgcctgggaagagcagagacccttgggagcctcccagggagggtagggaggagtcagaggctgaggcccccaggggagcagaggaggcgttccctgctgagaccctgggccacactggaagtgatgccccttcaccttggcctctggggtcagaggaagctgaggaggatgtaccaccagtgctggtctcccccagcccaacgtacaccccgatcctggaagatgcccctgggcctcagcctcaggctgaagggagtcaggaggctagctggggggtgcaggggagggctgaagccctggggaaagtagagagcgagcaggaggagttgggttctggggagatccccgagggcccccaggaggaaggggaggagagcagagaagagagcgaggaggatgagctcggggagacccttccagactccactcccctgggcttctacctcaggtcccccacctcccccaggtgggaccccactggagagcagaggccaccccctcaaggggagactggaaaggagggctgggatcctgctgtcctggcttccgagggccttgaggccccaccctcagaaaaggaggagggggaggagggagaagaggagtgtggccgtgactctgacctgtcagaagaatttgaggacctggggactgaggcaccttttcttcctggggtccctggggaggtggcagaacctctgggccaggtgccccagctgctactggatcctgcagcctgggatcgagatggggagtccgatgggtttgcagatgaggaagaaagtggggaggagggagaggaggatcaggaggaggggagggagccaggggctgggcggtgggggccagggtcttctgttggcagcctccaggccctgagtagctcccagagaggggaattcctggagtctgattctgtgagtgtcagtgtcccctgggatgacagcttgaggggtgcagtggctggtgcccccaagactgccctggaaacggagtcccaggacagtgctgagccttctggctcagaggaagagtctgaccctgtttccttggagagggaggacaaagtccctggccctctagagatccccagtgggatggaggatgcaggcccaggggcagacatcattggtgttaatggccagggtcccaacttggaggggaagtcacagcatgtgaatgggggagtgatgaacgggctggagcagtctgaggaagtggggcaaggaatgccgctagtctctgagggagaccgagggagcccctttcaggaggaggaggggagtgctctgaagacctcttgggcaggggctcctgttcacctgggccagggtcagttcctgaagttcactcagagggaaggagatagagagtcctggtcctcaggggaggactaggaaaagaccatctgcccggcactggggacttaggggtgcggggaggggaaggacgcctccaagcccgctccctgctcaggagcagcactcttaacttacgatctcttgacatatggtttctggctgagaggcctggcccgctaaggtgaaaaggggtgtggcaaaggagcctactccaagaatggaggctgtaggaatataacctcccaccctgcaaagggaatctcttgcctgctccatctcataggctaagtcagctgaatcccgatagtactaggtccccttccctccgcatcccgtcagctggaaaaggcctgtggcccagaggcttctccaaagggagggtgacatgctggcttttgtgcccaagctcaccagccctgcgccacctcactgcagtagtgcaccatctcactgcagtagcacgccctcctgggccgtctggcctgtggctaatggaggtgacggcactcccatgtgctgactccccccatccctgccacgctgtggccctgcctggctagtccctgcctgaataaagtaatgcctccgcttc

SEQ ID NO: 38426 - DNA, 2047 bp, Homo sapiens
agcgggcgctgtcagaaccggattgggccgcggcggggacggaagcggcccctgggcccgaggggctggagccgggccggggcgatgtggagcgcgggccgcggcggggctgcctggccggtgctgttggggctgctgctggcgctgttagtgccgggcggtggtgccgccaagaccggtgcggagctcgtgacctgcgggtcggtgctgaagctgctcaatacgcaccaccgcgtgcggctgcactcgcacgacatcaaatacggatccggtgcgtggggccagcgactgggagagcgcggggaaccggggctcggggttgggagtgtggagacagggtggtcatgggggtctgtgggccgtctggaagccgggcggcgggggctctagagtcgttgggaggtcgaggggccaaagctttgagggtgtcgaggatattgagggtggggacggtcgtcggggaactgcgggcccaaagactgagggggtgtcaggcgggggctgggggtgagcccttggggtcccctgggacatgttctggtcccagggcgagggtccggggttccgcgattgacggagaccctgggtgtgtggggtgtcactcctcaggcagcggccagcaatcggtgaccggcgtagaggcgtcggacgacgccaatagctactggcggatccgcggcggctcggagggcgggtgcccgcgcgggtccccggtgcgctgcgggcaggcggtgaggctcacgcatgtgcttacgggcaagaacctgcacacgcaccacttcccgtcgccgctgtccaacaaccaggtgagcccctcccggagcccccagagagactcctggcctgtgtgaggggccagagacagagccctgggttccaatccgagcctcagcttcttcgtgaaatggaaatttcacttcagagatggttactgagcgccccctcgggggacacagagtaactccgccaggatcctgccctcaggtgctcccggcccggcagggagaacgacgggagagagatccggagagatacgcctggatagctcttcctctggtggcaagtgggacccaggaggggaatccacacagccttgagggtggggaataggaaactccactggggaggaggaactcaggctagatctgaaaggatgattaggagtcctacaagccacaaaggggaaagagagacttcccaggccagcagaagagattgtgccaatgcatggaggtcattggaattcaggggattggaatggaacagtgggtgcccttggggagctggtggaagaaaatgtttgagatagatagacagcttgactgttagcctgaggggctgaattttaggctgaaggtaggtcagaggggttaggactgggaaaatgtggaggaggaggccttagctccgtggggaccagtggtctctgcacagacagatgcaatggtgtgtgcatgtgtctgaagagcccatgctggggagggagtgctagaggttgcgggggcgggtcatggtgtcaccttttgcagctgtgggagctgaggctccaggaagggtagggaagaacccgaggctcggtgtactaggtgcgaatgccgccttctgtggtgaccactgtcttctcatcctttgcacctataggaggtgagtgcctttggggaagacggcgagggcgacgacctggacctatggacagtgcgctgctctggacagcactgggagcgtgaggctgctgtgcgcttccagcatgtgggcacctctgtgttcctgtcagtcacgggtgagcagtatggaagccccatccgtgggcagcatgaggtccacggcatgcccagtgccaacacgcacaatacgtggaaggccatggaaggcatcttcatcaagcctagtgtggagccctctgcaggtcacgatgaactctgagtgtgtggatggatgggtggatggagggtggcaggtggggcgtctgcagggccactcttggcagagactttgggtttgtaggggtcctcaagtgcctttgtgattaaagaatgttggtctatga

SEQ ID NO: 38427 - DNA, 114956 bp, Homo sapiens
acagagtcatgtgctgctgctcccgtcgccgctgctgccgctgccgctgccgccgcccgtggtgccccggctcctccgccgcgcttcgaggtggcagccgcgggcggggccgcgggagcagggtccagggtgcagcgcgccttcgccgccccggcgcgtcccggtgcagccgccgcccgccgcgggtgatgccgccacctccggcctcagcataagccgtggcttggcggccgagctgcaccccaaggttggtgcgcacctctcccggcaggggccgggggctgcgagggaaggcgacgcgcaggtggagccgcgccgagccggagcgcgcaaccctggcgcaggcgccgcggcccgagctgcggttgcggccgggaactcattcggggacgtccgggggtcgggaggaggtggcggcgagcggagtgggctcccgtttgctgccgccagggcctgggagattgttccgctttctgcagtctgagcgtcggccgcttcggccccgggcggccggccctgcgggaggggagtgcggcttcctggctcctgaacccctcgcgcgcgctcccttctctcacctccctccgccctatcggaaaggcggggagagccggtttcggctctgctggttcctcccggaggtgggtgtttggtgtctggccttgctggcccggcgtccaaaggtgagccctttaacttctccagaatcgcctcccctccgcttccttcctgtgcagggtgggctgcgctgggagcccggcgggcgggggcggggaggtgaaggcccgcgccccgccccccgcgcctgtgggagggagctgggggcccgcaggtgcacccagccgtccgcgggccgtctccgggttgggtaccggtataatccgcttctagcttgtttggaggcgtgggctcttgggagcgggacttctgctcaaatcctgtccaggggcttgaaaaggaggagaattgggggtggttgccgggaggaccagcacctccagttactggagggttgataggggccttctcctttccgtcaccctttactagggggtatcccttgcagataaatgagattttttgatttcttaaaaagccagctgcagtgaagaagaactgctgcaggtcgaggggaagagaggtaggtccttgctggagagggagaggtgggctgtgaggttccaggagcacgcacttggggtgtgtgtggccgaaagtatggaggtagggttgtgggaaggaaacagccgagatgagagggagggcgcactcaggatgtaggcggagagatggggaataggtactggggagtcctagcggaatgtggggcccagctggagccgcttggcttatatttggctcctcgttgcctcgcagatttcctgctcttggatcttcaaaaatatttttttgttggacaaagaaaactctgaggacatattttggaagagctgatttctggaaactttccttggcagctttgatagtaaaattccgtacaggcagcgtttattgagcacctattacgtggtttgtaccggactttggaagagtctggacaggcagggaatccccgtttgcagtaatgatgagggctgtctaccttataaacaaataaggggcccctcccagtgccaagaatgagagtgatcagaccttcctcgccatagcatctgggacctctgcttcttacagacctgtgggaagaaccctgcaccatatcctgtaaatggggtcctcaggcagcatttatttttgcagtccaaaaatagtgaccaaacacctactgtcagctaggcgagagttggggttcttgcttcatctgtcttgacaccaactaactaaatccctgttaaaatccaagtgcaagatggggaggaatctgagatgaaaattaggtggttaaaacaggggtcacgaaaagttgatttggggtgtttggtctctgtaggttacttatggagccccccataaaatgattaggtaatctatggagccagggaaaaattccaaaatcttgaattggcacagtttatttatatatttgaacactatgttagatttgtctcgtttttattgagagtgtatgtgtgcgtgttgattaaaacctaacagattagaaggttggagaggaaactgtccttagatgacccagccttccattaccatgtggagtagcatatgatgcaacacttaaagtattgagccatattcatatcattttctccctgctgtgttttccagcatttaaaaaacatggtcaaaacttggccctttttttctcaaaatcgctaaagtttaatggaaagaaaaaagaaaaaaactaggccccttttcccttaatttttatattatgcagcatttttaaaaattaattttagaaaattctgatgtgtttgtcatgtccaaatagttaaattgttttggtagctatagtttggaaattagactcgattctgttctcagtactgtagacaaaatagctattaaagtcaaaagtttgtcaaaactttgtaatcatgattattatgttgttgaagtggtagcttgtaagagatttcagttatttttaattggagctggtgtttgacattctaagaaacaccagttaatatttgttgagtgccagcaggaagcagagaactggagtgggtgctgtgggatcttaacaaggcaggagaggattctcgtagtaatcacagagagcagataagacaggcacacatgaggatgccagcagaagcagacagttacagttgtctaagaatccagggtgtgtggaaccagataaaagtttatgaagtatgctgagggaggagtggaaatctgaattgacttttgacagtggtcagggatgtggaacagaatatacgactaataaaggagggtagagggaacctagttcgtgaaaaacttaaccacaagtcagtggtgttaatcatttgcctcaagaccagtggctctcagaagtaggcaattttgcttctcagcagacattgaggaatgtcggagacatttatggttatcatagcgaggtggcaggtgctgctgtcatctagtggctagaggacagggatgatacataagcatcctactgtgcacaggacatcaacccccttcctcctaaacaaagaatgatcctgtccaaaatggcgatagtgcctgcccttagatctcagaataggtcttgaagggaggtggttcttgacatgggaggagtaataacattgagcttaggaagctgatgtaggagacttgtgctcaggtctgatgtgattagggtctgggcaaatccttattgaaagaaaggggcagtttggagggagatcatagcagatgagcacagtatgatagtggagtaagttgggaatcattgaaatcagaattggcattttagaggggccctatccaatttatttattttagtaaattcttaccctttctaggtaacttttgtttaaccccaggaaccgtgaacttctcctgaagacaggttattacacctttggactgtttgttgtatttttacttgagctgaagactgtctccttgaatttttttttccaatgattttcttcttttggagctgcctactctctttgaatgcaccaagacaatatgatgtccccttacccccagttgactttgctaatgcaaactagtcccaattcttttcacagtcttttattgggatgtggtttctcgatgtcttctcagtttatcggcatctcacatggagaatctggaattgaatatgtaattgagatgtgatctggccaacagagagtacagtaagacagctgtttgctgagacctaagcataaatgtctacttactgcaccttaagcttacaactgcctatgattttcttaggcagtgccgagcacaaacttctttattagataatcatgttttggatagtcaaaacccccagatatttgctctgtgagctgctgcatcctgtatttcttgggcagatttttttggagaagttttttttgttgttgttgttccttctcaatgttatcctatttattttgatccagtcttctagcctttgacatttttgaatttatgtcttctaattatatcagagaggaatggaggatgactttgttgaaaactgtagtcagtactatgtaaaactcagtagtttgggggctctattggtcctatatgagagctgagatcactgagtgatggaggtgagttctagggctaattagcccttattttgggggcttctgagaaatttaaatgccaggccacatggcatttagctcttgaaatgtttgcacctggggtaccattttgaaattgttcaagtctgttgcaagcttctgaaatctgaattccttcctctgggtctttgtagttctgtttatgtatctggaagagagtttctaatgttttgtgcaaatctgaagcttgcagggttagagttgcttttgaaatttgtgagaagataggataactggcaaaaatcaactatggacttgtttcccactcaggctaagctttgttttcttttttgctaatatgcctcaaatatttagtgacagccttatatttagagaaggagagaggattgaggtttagaagcaaacctttttctcagagcttggctttaacttgccgttgatgtaagttcatacttaacttgaattttacagtcttcactacaaagacattaggaaattaccattcccagatgtcttctgaagctggcaggtaagaaatcccaggtaccttagtgccaagttctccaaatactctagatctatccagtgaactagatttaataaattacttgatttgggtggtagctgtctcacagtgttgaaggagagctagaggaaaatttcaaatctcatggccaaatgtgtgtcacctctttgtgatgagtgtccattgtgccccaatcctttgttagtgtgttggctgtccagatggtgcagtctacttggtttcccttctttaccagtccacgtgggcaacctctttatatcctctggagatgaaggatattccaatgaaaagaagggatgccttttgaatatttgaaatttcttgaggggaaaagtgttgctgtccttttatattgtcaaaggctgtgtcgaagttggagtcttagaattaaggatgcagttgtgtcactttgaatagaaagaatattatagctggaagggatcaacccttaaattttattttattttattttattttattttatttttttagacggagtctcgctctgtcgcccaggctggagtgcagtggcgcgatctcagctcactgcaagctccgcctcccgggttcacgccattctcctgcctcagcctcccgagtagctgggactacaggcacccgccactgcacacagctaattttttgtatttttagtagagatggggtttcaccatggtctcgatctcctgacctcatgatccgcccgcctcggcctcccaaagtgctgggattacaggcatgagccaccgcgcctggctacccttaaattttatagttgagcgtatccaggcacagggaggtgatgtgcttagcgtaagtttacacatgtagtgacagagtaggcattagaatctatctgccttaaagaccacaataaaggctaaggatcaggatttcttctctgcttagaggtgtgtaaacagtggggtccctcgggtcttatttacataattgatctaaaagaaggaacacacagtggaatttctaggtttgcagatgacagcttttctggattatgaaatgtctaaccactgggtatttgctccagggaaaccacactaggatgtattagtcatcagacgatttgcaggtgagtttcttgtgggcaaataggtggttgggtattaaggggaaattacagaattttcataggatggtgttttgttggataaactcagggaagggctctgaaaataccttcatgttgttgtcctgacttgctgttgcagaaaaacaaaaaccatgaaatgctaggcttcatcaaaaagattttggggctgggcatggtggctcaggcctgtaatcccagcagtttgggaggctgaggtgggcagatcacctaaggtcaggaattcgagaccagcctggccaacctggtgaaaccccgtctctactaaaaataaaaaaattagccagatgtggtggtggtgcctgtaatcccagctactcgggaagttgaggcaggagaatcacttgaactcaagaggcggagtttgcagtgagctgagatcgcgccattgcactccagcctgggcaacagagactgtctcaaaaaaaaaaaaaaaaaagattttggggaaaaaaatacaaaatatagtcttaattgagttttcactgtgttttttcccccaaattcgtgggcacctaaccttcagaaagacactagagctggaatgaccattgtaatgatacctacctagaatgtttggacattgctgctagaatgtaagcttcatgaggacagggtccttgctcatctgtttctttgataaaaatattaagatttctagcacctggaaagagtcatctgagaggagatggcatggaggcctatgaaaccacaaggatagggccataggcagccttgatagttcactttattctaataagcccaagcgtgctattttaattgcctccttgtcttcctgctccggtactctgtcagtgtggttaggatagggatttatctctcttgttctctactgattttctagtgccttgcacgtggcaggccctctattagtatttgtcacccagaggaatgaaagaagaggtataccttaaaactttacaagatataaattcaggatgaatgccaagaaatatggtttttctcaaccctggctggcatcagaatcagtctggggaatattttttaaatacatatattcagacccttccccatgcctattgaatcagaatctctggatatggagtttagttttgaaaacagccctccctgcctccaggtaattctaatgtgcagctcagctcagaaccaccatcttagtagttgtgcacgaaggctgggtactgactgaagacaccttcaaatgggtttgaaacatttgtggccagcaagcccatcattggttattaagacaaaagagaagctttaaggatatgtcagtcttcttggaaggtatagtgacccaaacagcacatggtccaccatggcccttggtgcctccatgagatagtgcatcctgggctggatggatgatgggaccaactcccagtccatccttgagcagtcatttccagagtgggtccctgatgacagtttcaccagcccatgaaaaaatgagaagagtgaagacaatgcaacaagcttttctgtttcaactttagtgctaagtttattcaattataagagtctggttttttgttttgtttttgttttgtttaatcttgggttgtccttcctactggaaggttggcttgttttttcattttatgaaaggatgatgatggttttttggtgtcatttctaggtccagttttaagctggcaattttgtgatagtctttcttttgacattttactggcctgtgaaatcaaaagtctgggaactaccactcctctgaggttttcaagatgtctgtgtctaccccttgacacctccttttggggaacgctcataaatatggtgttaggttccattacaagcattttttttttcttaaaacatttttttctttcctcttatgcttgctggtaatagttaggaacattgccagagaaagcttcacttccccaacaatgcataaatcccattgctacatcttagcatcgacagatagccagcactgcaacgagttctgcagaacaaggagaagaaaggatgtacaagaagacacctttttctctgatggtcattggccgccagaaagctgtgtctcaaaatctctcatgctatagagataggacagaactcttcagattgggtattagatgccgtcagtcaaaattctcttcactgattgcttacaacccaattttaagaaatactagaaaattaaaatgcttggaaaaatggtccccatggtgcttgcaatggcactctactgagtaggcttttaaaatcagagtattctcagatatggctgcttttttgttttcgtatttaacttagctggttaagaagtacttggacaatgtatggaacacctaaagttattaataataacagctattaggcacttaatgattgtccaaacctatgccctggaatttacatgcattctcatataatcctcaaaacaattctgagtgaaagatagacttattcccactctacggatgaggtcataaggctggaaaggttatgtcatttgcaacaacgtcacatagaagtggcggaggtggaatttgaaaccagactcattttataccagacttttttattttaaaccagactttttaatattttataatatatacctattctcttatctactgtaccctttctcatttctgcacatttctttgtatttattttataatacctagtagtatttctgttacatgaaaaagagaatcaggttttgaggtgtaaaggtacctgataactcctctggttcgtgctgcgtgtttgaagagtagagccatagcggcatcccggcatttaggcttccaggccaatgctcttgtcaccccaagttggtcttagaagtatgagcctgttggtaaaactacttgaatgaaaatttatcctggaattgagagggtaactttaaatcacttaattattctggtgttttctctagccctgttctcttttgtcacccatattgatgatagaatgccacttgtaaagtacatcttaagcaccctcctcctagttagatctcagccagaataactactgtacataaacaaatcatgtaaagatatacctaatatttgctaaggtgttatgtcttagctgaaaaaactgctgtaacaaatgtttgctgaataaatgccataaatatattcaatataaaaaaactatatcttcaaagtaaatgaatgaataaataaatatccatgtatctacatcatattcataggctgtttcattcgtgcctttattttttaaatacaagaaaattatacttcattatactcaagtataatctctttgctggagtgaatttattctgttcaagttttactttaactattgaattatttatcttaacatttagccagtaataaagtacaaattgggaactgggctgcagttttatacatcttgcacaaaacacacccttcctacaaacacacacactcagagacagagagagatgcacttgttctttaacttagctctcttaagatatttttcaattccaaaatagtttctctttcacctgttctaaattcttttccttataacttatttatacctgctaagttctgtaccaagcagaaattagatctgtaatttctgtgctaatcagagttggatactagcagtagcctgggggtcttgagcaaatagtgtgcctcagagatgatttgtggcagcaggcactcgccctcagggtggggtcatcaggagtgggaggcccatcagaagtgggcctgttgagcagtgcattgttgccgcgtgggaatgtgggccggtgttgccaggtcttctgatttttcactgtaagccagaaatctggattattgtgtaaaatctgattttaaaggttggctaattcaacattttagaacttcctgtaaaccaaacaaaatagctttgtgggctggaaaccgcctctttaggcccttagagatagccctttagtggccagataaatggaagcatagggtttgaataaaaagcacaatacacttttttttttttttttttttgagatggagtctcactctgtggcccaggctggagtgcagtgctgtgatcttggctcactgcaacctccgcctcccgggttcaagcgattctcctacctcagcctcctgagtagctgggattacaggtacgcaccaccacacccagctaatctttgtatttttaggagagagggggtttcgccatgttggccaggctggtctcgaactcctaacctcatgtaatctgcctgcctcagcctcccaaagtgctgggattacaggcatgagccaccacgcctggcccacaatacacttttaaacattaatttaaattgacatgaattgaaacttgatttcatccttttctttcccaaccccagacacaaagcagagcaaagcaacccgcaagccccgtactttaatgataacaatttctgacctttaaatgtggtgtattacatctggagtggttgcatttgaacaggttgtctggcctgaggaggaataggtttagggagaaataggtagagtatgaatataaaaggggagaggaccggtgggacacacacagagagagaaggaagggtaagagccacttggagttgagtaaagagatcatctaccccaggagatacgggaagatttgttcatatcttaaaattgatttggggtaaatggggaagaaagagaaagaaagaaaaaatgtcaatgtttagaaatagtgcagaatctatgttggcagggggcaaagagtgctattattttgcaattcctagtgtatcatgttaatgtgtacggtggcttctacaaaaggggaattggaatgaaaaggaaggaaaagagtttatgtcagaaagaagactagggagtgagataaagaagaggggtccagagaacagctgatagcaaaaagtaaaccaagaatgctggaaaatgtttgcataggggaaagctggctatgttagagtacaaagcatcatttttttcccccatccaaactatgacattgagcgggtatacacagcagtccctaggaaaaagacggtttggaacaccagcttgttttgcttttgaagggccagcctccagggtccctttgtgtgaagcagtgtcagcagggctgcgtctgcgctgtcagggcacactgccgggaggatattgtctactgggttttagcccctctccaccatctgggtatcttggtgcaggacaggacctcagacctttactgtgaccccaatagtgctcctgtctttagttttatttgcttttctggggaaaatctaacatcgtttgtgtaatttgttgtacatacaccctctttgaaagagaagagagtaataatttgaacagatttctgctactagcagaatcctagtctgagaggatttttaaaagcattttgctcttaatcatcccaagtatatagtaccttgttcctggaatttcagcattttctgtggggaggggaacaacgtcttttcatcatctgcaggttttattccagtcctggggctatcatccctgtgtgatctgaactatgtctttctagactggaataactttaaatttctaatactttggttgctttttagaataaattcattttaaaatgtccccttctatttgttactttagtgcagtaaggatctttatggatttcttttcccccttatggaaaccatttgtagtattgagagaatgggttcaggttttcttgcactgttgggaagaagaaaaattcttcaaattccactgctcggccttctagggactctactctacagatggaagtcctggaagatcctatcaggaagtgaaacttgtaaataatgtttgtgctcgtttggggcattatgcgttaacaagttgtacaagaagtcttctttaaccttcttataaaatacacttaaaaaagaatccagtcctagtgacgaatctggaaataagactaggaaacacttcaccatgtgccaggcactgtttgcagcactttacatatattagctcatttacttctgacaacagccccattttgtagcagaggaaaccaaggctggcttctctagtctggctgctcctcccaatcaccatgagcagccaaggtcattacaggaagtggcagaactgtgatttgaacccaagctgccatggcttcaggatctgtgctttttaggactccttcattgccccttgaactctctcacaacaacgacgaacataaatttgctttagaaacttcttttgccttccacattacctcagtcttaaagtcagcatcagagtttggttgaaaaaagaaataaaattatattccttccctgatactgcctccccaaaccaaatgaacaaatgaaatcatggagacagtttccatctaggaacagaaacctgactaaaggatcttcctggaacaccgtactaaaacgctggactgatcattacaaaggctgtagttggagccttgttgctgtgacaacccgcatccttggcaccagacttgtttttaacagcacaaaacccatcttgttttacctttacctttacaactggtagatttggtgagcttctgagagcactttttaaattgctttttgcaacctatttggaggcagtgggaaggacctaggatttggagcttaaaagacttgagttctaatcccagcactctcttttgtggactcgtgtgaccttgggtttcatctcctgtaaatgggggaggggacagtaacggcactaggattggtttggtgaggataagaagctattatatatgacagtattttattcacaatagccatgtgtgtcaggcagtgagctgaccagcaagtcctttgtgagtcttggaatgcattttccatgggtgggtggtgaggtaggtggttggggaaggtttgtgttgatctgaaccccttttctttcctgttctctccttacctgtattccagtgtgaatgatagtgtgggtgtcaactcagtttttggcccaaattccttttccttggttttcccccctcctactttgggctctcttccagtttgcctacaaagtgctatttgttgcaagggtgaagcaggcaattctctgggcagcgacactgtggctgcaggcagttgctgtagttcaaagcaaacagccaagctagagtaggagggacactgacggggtttgttcattagaattttgaacattaatttttgaaggaaagaaaggggagtacaaatagaataggaatagaaatattgtgaaattttctttataacagaacaaaattgggtcaggagaaaggactttaagaaatcacttaacatttatcattactttgaaagcaaatgccttttttgagtaaaagcaaatgctttttgagcatttactttgtctgcagtgcactctagtggggtgggaaacgaaagttagcactaaatattaacaacggctatcatgttagtgcatttcaggtggtccacagtgggccacttttctgttctattcttatatcagccatgaaggttggtgtcattggtgttccatttcaaagattacaaaactgaggctcagtgtgtttaaataacccactcaaggatacagtgctaataactagcagggagagctaaacttcgacctaggtctctttctcatccacaatatgaaagatgagtaagatatgcccctgctttgaagataagacctgcatgtaaacagtttagtataattcagcacagtttgcagtatatgttgtaattcttgtgagagctacattttttggacatttgctcagaaggagagactgattttgactggaaagatcaggggaggtctcacaaggaaaaataccttgaatagggccttgaaggatgacaaagatggtgacaggtagagaattgatgggagagctgagggaacgttggagcagcaaagcatggagttgtagaagtacagaatgtgtttgggaaatgctgctgggatggagtgagggatggaggaggaaaggaagccagagaagtagtttgggacagattacagagggcctagagtgtcctgctgaggaatttagacttcacttggttgcctttgaataaaggttattccattgaaggttcttgagaagggaaataattttgccttgatctctgccttcagcaattctggtggtagcatgggctttcgccagcactaggctgcatctaaggatcacttgggagtttcctaaatgtgcagattccaggagcacccctccacccccatgatttcagtggttcacatcttgggtagggcctgggaaagtgtgttttgaaggctctgcaggtggttctgagggcagcctggtgagggaagggttctagagggcattggggcattctagagaaaggtctgagctgaagctaattttgagtttgtccctgtatggatgattttttaaaccatgggagggggccagtcatcaaactttgtggaagttctgtctgtgtaggttctatggtttgctttttgtcctctgtaagtattaaacagtaatctctcagagcattgtcatttggctgaagtttttcacatgtatttcctgttcaaatctagaatgtgggatggctctaatccttatgcccctgtgctagatttctccttttttgttgctgtttcttttagaaggcagaggaatatatgggattttattgtgggctgtacctgtcttcaatgacaatctcttggagagcatgagctctgtagtttactgcctgggtttttactctgcctttctagccatgggaacatgggaaagttacttaacttactataaaatgaagatacaataatatttacctcctagggttagttgtgaggatggtttatataaaatgcttagaacagttcctggcacatagttaacactcacgtgttagctgctgttgctgttattattgtcattaattctgcagatacctaaaggtattccttgcctgcattgctcgcgtattgagggcttcaccttaaaaaataactgtacaaattatgattgagagtagtaagggtgacatattagaaagttttaattattcagtgaccctctttcctttcagagccttttattttctagaaacatatgctttcctcccatgaacaagcctgctaggacatacttaaaacccatatctggtcaagaatctcttcctgcatattggctacagagctaatagtgcagttcttcagtctcttaggagctacatgaaatgatgctcacttttacatttcctaggacccagcctgaatataggtcatttttttttcaaatgtttcagagctctcttactctcatttgttagttctaaatcaactgctaacatttaaaatacaatttttgctgggaggacagatagttctaccaagggataagctatttctcaacattaaagaaattagaaattataatttatgcttaaaaaaataatgttagttcaagttttagcttgcttctctctgccttctctactgttctttgtcctgccatgtgtttgcaaaccattctcatgaccttctgcctgtgcggcatatttgtagtggggccagattatacatacgccactgacattttcatctgacctcctaaactcagcctttgagccccttcttttctttgggttttcctaacgaagtcttgttgaaaggaatattatttcccatggaactttactgatagtgtatggaataatacgatcatgctctgtgaagttcagacctgaagtcttaacattttaaacatgtatctatttgctattgcttacttagttcagtcttggcattttaggtttagaggtggttactacccattggacatccatagccactccctgcaaattaaaggggacacaaaaatgaaactgaacttctgtttttcttcacctctctgctaatttaactaagtcaattggctcgccctcatttgccctcttcacacctcccaaattaatgttatgtgcaaatttgattaaaacagcgtgagtaatttccaagttacttttgaatacggattgaattccgttccttgtggctttttcttcatcatactagtagatgtagccagtgtttttgtttctagcctgcttaacttgtgtggttcttggaacaacataagttttggttgatttaggatcctgatttcacaggatactgtatcaactgctttaccaagatcaaagtacatgggttcactgcattcctttcagttgctaattcagttgtgctgtagccaggcaatcctggagccttgaaatccaggattctggtcaaggtgaggaagcagcccttcctcctggccttttcattctgcaaataccttttctttccttcttaatatttatttattcagcaatgtggcccaggctctgcatccctgacttcctaaagctttcagcctagtgcccctagacaagtggttacattcttgctacaaactggaaagtctctgagcccctcaccccactcctccccacttcttttcttctgctgtatttatggcactgtacctcatgaactttcacacaagggaaagcaaactcaatccaattgggtcttatgggtaagaaaatgtgttggttaaagtagattctggtcagccaggctatcgaagttttagtatttactagcagtgtgactttgggcaaattacttaacatctccatgtccatgtctcttttctcatctgtaatatgaagataacaataactcctacctcatagggttgttgtcaggaatcattgaagtgttaatacatgtaaagtgcttggcatttattaaactagggttagttaaaaaattgatgaataagctattaaaagttcataataaagtttctggagttttcaggtactccgtttctctttcgtgctatttgccttggctattccactacaggcaaaggaaaggagatgaaatttaaagtatctaattttgtaaccttaaattattcatgaattgtttttcttcgtgtagactccattataatgtataatggagaattgtattcaagatatgatgtgtgtgacttattccttatgaactctgaaagtcatttttaagaacacttcttaataatgaacattatatttatttgactttttaggatccaacccttttacattgttgggctttttaatatgttatttaaaaaacaagattgcccaggccaggcgtggtggctcacgcctgtaatcccagcactttgggagaccgaggtgggtggatcatttgagtccaggagtttgagaccagcctgggcaacatggcgaaacccctgtcccttaaaaaaaaaaaaaaggggggaaaaaagaaaaattagctggatgtggcgagctcctgtagtcccagctactggggaggctaaggtgggaggattggttgagcctgagagaacaaggctacagtgagctgagactgtgccactgcactccagcctgggaaacagagtgagactctgtctcaaaaataaaaataagataaataagattgcccaaagagaattaaaacaatgtttcaaataaggaagcagatactaccacagaagattaacagacaaaacatgctttccaaagaagaatgaattataggacagtatttcatctatgtaatacacatcaaaatcaacagtcattaaataatccaaggctattcattcctagcagtctgtgctgggagcattttgaacagtcttttatacaggtatttgcatttagtcagaattttgggggatcttacccttctttcacagtattatgcctagtaaatcccagtacatcaaccatcatgtcctactttacatgcatttttttgcatactaattgaagaatgagagaggaagcttggaaaaaatgtattaagattttgtttatcacagtttgatcagtggatcagtcttattattttataaaataatatccagctgcagctcaagtgcatattttacctaatttatatctacttatattcctatggcttaaagtcagttgacctattacaaaatacatgtttatcctttacactttaccaaaatctggcgaggtgatgagggtgtatgatgcacttgagagagagcattacaagttatctttttaaagtgggattttttttctgagcaaaagatatgtagtgcagaataatatatccacagccaaaatgcacccactcatttctattcaattaaaagaaggaagaacagacccagggtgagttttcgttccattacctaaggctttgagaatatcacttaacatctgtgagccctgctgctgcttctgtaacacattaataatgacacctccctgcgaaggtagttctgagaattcattgaggcagggcctgtgagggtttgtcctatgtaatgttagtaattttgtgcaaggtgtgtgggttcattgtgtgtgtttggaagctgaggaaattggagcactgagcttagagagataccagctcaggcctgtagccaccctggccctacctgcctggtggttggatcttctaagtcatgctgtggggtgctttaagtagtgctttccttcttgctttctcaaaatcaggaaactatcttacaggcatatttttttttaaacatgatttgcgaccccttgctgcattttgtcatgtgaaatgacacttactctggttctttaaagatggctaataatcctctatgggtaaatgccaatcaggccagccagttggctctgcgaaaggcttccttgaaagccatggttcaggttttgcagagaccaggaagtgaatgtgagtgccagagacctccttcccagaaaatcctgttgcatgtgctaccccggaggtgaagacaaggtagggacactgctgtgaaggctgatagtgcagagggtcatctctttggcaaccagacagcttgtcattttttattttcttgtttgtaaaatccatgtgtaataatcaccaggactcctgatattcacacagagaattgcttgtggcaaacatttttaaccgccaaactaagatctttcttaagatgaagaaagataagcagcattgttttttagagatgagtttatcatctcctcctccacacccattagtcctcagaaaagctatttcttgaaactgaatttggagcttctaaaatggctttcacagtgttggtctcttcatctggggattatggtacttagggagtggagactttcaaagtgaaccttccacatttttccaaaatcttttgtggcataatttgtgcctacctgagagcgcattttttctttttatgaggttgtgattttaatatatatacatacacgtgcacacacacacgtgcgcatgcacacacacacacaaaagcataacagcggctatgagaaagaaacacttctgcatgaaacacagaaggagcgggcgaatagctgaccaggggaaagtatgagatggtgttcaggcctcatggtagttaggattaggaaatgtcaggggctgtgttgtattctccaaactgtaaactttgggagtcgtacagagtgaatgttaataaatatttttgataaggaggagggtttgggtttatagggagcctaagaaagagaaatgtggctgcccttcccccacagctggccactgctctggaggggagagtattagacatttgggtgtggacatagcagcataggcgaataccattgttagtctcccaccaaatgctcttctgtattttgttacctattaaaccatacaaactctcctatatatcattaaattatcactcagtacagtacttggacaaaataggaatagtctactgttaactgtttttagattaatgactttgaatttttcctaagagagattttaagaagttagatagtctaatcgcatgagtcccaaatataaaaaacaaaggctctgcaggtttaagttttcctttgccttttcttaagaatttaaatatttttcttcagaggttttccttgggctcttagataatgagtaacaaaaatgaaggagggataccaaaagatatttcaaaacataattgtgtccttaaaaacatggtaataattgacagggtttttaaaatgagagaagtttctagctaaatgccctgcttcacatccccactccccacactgagtactttgtggaaaatatgtggtagctgtttgggaagaagtattaagtttgtgaaaagacatgaagagttgccaggaccacggtaagcaaaggattgagagaaggaaaaaggtgaacagagctagaccctaaaaggatgctaagatcccttgagaagtcttttagtaagaagccctccttagactgcgagtgcctagtggacaggaatgcatctcactggtccttgcagtcttcttccccgcccctgcctttgtacttgaaggccatggtcatctgggtgcactacaattcaagtctgtgaggtgaggagaaaagggtgggtgaggtgtagttcatcgtctggaggcctcagtattgtcaagaccacccccccccttttttttgtgagtgcacaagactcttaatcaccttttcatttggttgcgtcaggagcctcatagcagcatgctactgacaggtgattgtgaactaagtgttatagcagaaggaaacagaaaatgagagaatgtcaacttgaagccatgtgtgtttttgtgaacatcatttgccactttcttaaagagccccagttagagaaaaaataatgcaggaatcgaattttagtcagcttgttaggttctgaactggacagactttgtaccttggcatatgagtagccattctagaaccttttgaacttttgccaccaagtaattctggaaaggctgacagccagcagtaggtaatggaaaaagccagtatcctctgcccgagaaattaaggtgtgtattattcaggtggttaaagaaactgcctaccacaacagcaatagctggtaagtagcaggatcattcagagatgaagggatggatcacaggatggttgctgtgctggactttctccctagaattcatgatcattggccaggagtggtggtttacgcctgtaatcccagcactttgggaggctgaggcgggtggatcatgaggtcaggagatcgagatcatcctggccaacattgtgaaacctcatctgtactaaaaatacaaaaaaattagctgggcatggtggcgtgtgcctgtagtttaagcttctcgggaggctgaggcaggagaatcgtttgaacccgagaggcggaggttgcagtgagccgagatcacgccactgcactccagcctgggcgacagagcgagactctgtctcagaaaaaaaaaaaaaaaaaagaatttgtgatcattgtaggaattcgcagtgtaggggaaatggtacagattttataatcaggaaagacctgtattcagttctccatttgaccactttctgccagagccatgggaacagttttttaatttctctgaccctgtttcctcacttgggaatatgacttttgcagatctgttggaaaatattaaggccaagagggatttaaaatgagatgttgtctagcactgagtaggagcttaatatctatccgttcctttctgcttcagtcaaaactgagcttcatatgtagaatgattattgtttgtattacattctccattttgagtatggaaccatgaatgccaacagcttgataataaaaggagccgtttgtcaagagacagtcctgtaagcgctttttaacctggtagactgtgcatgtaagggcaggcaggttacaaatgcgaatccccatagccagcacactctacatacagcagattcttaagccatctgtgtactctttttaacactgtactgaagtccacttaagtcagagttcaacaaaatgaatgaatgtaatcccaggactatggaacttctctgtgattacatagcacagagaactacggaatcattttctggaagaatgcaccatgcgattatgctccatgtggaattggtatatataaatgttggtagactgtgaggatgaggttgacaggttgatctgagtagagaccctaggaggaaccgaggatactatgtagttttgttgttgttactgttttgcagttcctggctgctctgtgttggcagctgtgtgcacgctttctcttttgagccagcgaggcacaagacaagtaatttcccatcttgaatctctcacagctgctgagctgtagtggatatactgggatgtggctatgaactttaaaaatttgcataaatccagcccctactcccctgcaaaggctcagtcttgtctttacaccttccccgaggtaattattttctggggggtaggggtgggggttgggagggtgaagaaaggaagaaaaagaaggccgatcacactgggcaccggcggaggaagcgtggagtccattgatctaggtacttgtggggaggggagaacccgagcagcagctgcaaacggaagggctgtgagcgagcgggcgggcgggtggctggcagcgaggccaccagcagggggggcccgggccgaggccgcgccacctcggcaccacgcgggcagccggtgcggcggggtcgccacggccaggggagcgctgggtgcccaccatggcagttatgcaagcggtgaccccctggtcttgcctccccgccgccctgcactccttcctccccgctgccgacacttggatctctctagctctttctctcccctgtgttttcaaacaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggtgcgcggggtcgggtctgggtccagggagcgggtcgggaagtctgcggcacggagcactgctagtgtcggatctgcatctccagctctgtgctgcagcttcacttgcccgccccccaccactggcttctcacccggggtctctgccaaactctggctgctgccgccctgggttcgggccggcggaaggccctgggcgtgcgctgcggagccgcctgcgaggactccactagggcgctttccaggctggactgccccgggctgcgctggagctgccagtgctcggggagtcttcctggagtccccagctgccctctccaccctctcctccagctgctgctgcctgaagcagcagctctttgttcctcccttactggtctggggtcatacacataaatgtcctgggaggcagggtggtgggagggtaaggggttgggacgtagggaagaggaagaagatgagttgtgggtgaagtgtaaggtggacaggagaaaagaatcttagtgtccatgctcagaaatcagctcttcagctgctgaaacagaggaccccggttccttggtttctgttttgggaaagccaggccatgccaaacagagggaattaatgatgcaggcacacaccggaaaggtagggaccaggaatgaggcacagcagcgagttctgagatgtttagtctggtgtctggcttgttaactccactgtggtttctgagccaggcctcctcgctgagacagaaggtactttaacatatgagccaggcatctttattaattccatttgtcatcaaagtaaaattgagagtgacttttctcaaattcaccaggtagattatactttcacttccacatcgtgttccatctcaaatgttcataggagaataaaacactagggttggttttatgctacagacgttttgcatctttatttccctggcaggtccaatctttctccagaataactcagattgacttctccccccagtgaaagcctagccttgttttaccgcctgtttatctacctggtgaaactctagtcttggggaggacactaaggggagtgggatggctgagaataatcagtttgatgggatcattatatggcctcaaattaaatgtttgagccctgttaaagccagtagcatcttcttaatttttatttccgaggaagggatgtgagcatatgactagaggggaggaaagtgagactctgccaaagaagatctctccctgtagcacagaggaaaagtgaatctgtgtagcacagtatcacatacactgcgcgctttcactttatcgggtagccaagccatctaaggagtcagggttaggtgtagaatttacattcatgacgtgggatgctgactatagcattctgatgctgaaaattttatcataaaacatatttactacataattaagtttgctttgaaaggaaaatttaccagggtggtacaaatttaccagcttgagtacaaaacatgtaatcaataagtacatggcattaagtagccaaaatgcactatgaaaactgaacaattaaacttatccttcctagatagacatgaacttcgtaagtttgaatttaattgtgagatggctgtgtttatgcctcttcttgccaaatacgtcatgaaaagtgagaaagtaatcgagagagattctttttattttgagacggtttttcattctgtcacccaggctggagtgcagtgacgtgatctcagctcactgcaatctctgccgcctgggttcaagcgattctcctgcctcagcctcctgagtagctgagattacaggtgcacgccaccacacccagcgaatttttgtatttttagtagagacagggtttcaccatgttggccaggctggtctcgaactcctaacctcaagtgatctgcccacctcagccttccaaaatactgggaggccaccacactcagccagtcaagagagattcttgaaagacctgtacaaccatagtgttttgcagctacttttttttttttatttttgagacggaggagttttgctcttgttgccctggctggagtgcaatggtgcgatcttggcttaccacaacctccgtctcccgggttcaagcgactcttctgccacagcctcccgagtagctgggattacaggcacgcaccacctcgctcagctaattttgtatttttagtattgatggggtttatccatgttggtcagactggtctagaactcctcaccccatgatccacccgcctcggcctcccaaagtgctgggattacaggagtgagccactgcacccagccactgcctctacttttatacctatgtgtgttccttgccccccagtttattaatttatttggggactttctttagcatctgtcactctgctctaagatacagtagaacagcttttgtgagcctccaaatctcccatttaagaacagagtctccttctattctagtgatatttaaactcagaaatcataactggcctttagattgtcatgttctgtttacacagtgtatatgatgtatttttttttttttttttactcctttcaacagagctaaactcttcttgctcctttcaatgatgtagtgaagtaggattcattttctccagtttatggagagaggaaacaggctgatgagatgtaacttgtcagtggtcgtattagtaaatggagttgttgggacctgaacaaggtcttctgatgtaatccgtggttcttttgtagtctggaaagccgctgcctaaggaagaggtggcagtgctgattcaggtggtcctttgccattccaaaagaaagctggattgccttaccaaatctccaggtttttcgttatacctcttcactcaggctctgcccagaactcaaggtttgttttcatttttaaagcagttttttttttcatatttgaaatttacacttcctgtgtgtctgtgactagatttagctgtgtttgcaccagtgtgatttgtattctgccaaaattctagtagtatattttaatttacagataccttttgtcaggttttagtgagcaagtatctttccaagggatcagattaccatattttaattttttagaattaaaaaacctcttctggcttactcctagggcagtttatatcccagaaaattaattaattagtaaatgatatatatgactctccactccccactactgctgccactgtgcgcatcccctactctttcattccagctcacagtaatccactgagaggctcacattacagaacaacgtgagcaaacccatgtaactttaaattatagattaaatatttttgtaacattccttagatgcaagtaagtttatttccttatctttgtagcgcttaaagttgaggctctctttagttacagttttaatgttgcaccattaactaaactgtaaaattatggtttaatttgttatactgcaaattaaaatttggagtacaattttcataagtgttggataaaatatttgtcttctcttcaataattggaatatttgtagtggcctataacttcccctctgtaaaactgtggtcaaaaccctcagggagaggagaaggtaaaggaggagcaaaagagaggaaatgagagctcattgttttgtaagggaggaatgaaatgatacatgtatggttccttaatacgcagtgcactgccttttctgtctgtcggtgagttgcagtggcttgtgaaccagccgtgcatctcttccaacagaaaggctaaaaatgaaagggtaactagctttgatgttaaatgccaaggaaaagttaatggccaagaggggactaggagtggagataaatgcaagttaagatttcattttttcaaaactttttttcccttcacgtatattataaagtaaaaaatgccttcttagtcaaattgtaaactgtaatgcagtggctcctgacaccaaaatcaggaagcttttatttaatattaaaagatttcaacgatcttaactggttcactgttttacttcgtatctcttataattgcagatgtttcatgagagttatttaatatcagccaagtatatattgcaaataatgacttcagcatcttcctgtatttgtaaaatagcactgcatgtatatatgaggtagggattcagcctacagacctcttgcagtaccctgaagtctacaggttgggaattgaggccaaagcaaaacaactgctccagactgaaaatgctgaaatggtgatgaaaaatgcataatatgttagccatcagattataaagattcccaggtggaatttttcctctttgttgtacattaaaaggatgatgtgttaagccctgattttggatctggtcatgtttccgggctaatcgtttttcatggtcagctttgagatctttgcagttagtcatggataactggatttctcttaagagcattttccctacaatacttctgcgaatatgccttccctgtttttgtagagtcaggactgtgaggccagtttcagaatcatgatggtcatagccactaccaccaccaccaccagccctatattcatttcccagaagctaaaagaggcttcccaatcttaacctttacaatttgtggtaagtttaaggaaagggagataggatttatccctgttctgcagtgggaaaaactgatgtgtgggttcatattgaattagtctctctgatttctgtgtgtgttgtattgacatgaatgtaagtcattctgcttgagataggttgagcagggcatggaaatctaatagggttatttcatgaagttcctttatttgttaaaagaaattacttcctatctattgaacaccatatttttcaggcattgacaaatagacactgattatctctaatcctcctggtgttatgcagagtgggtaataaccctgtttgtttttttggttttttggggtttttttttgagactgagtctcgccttgtcacccaggctggagtgcagtggcgcgatctcggctcactgcaagctctgcctcccaggttcatgccattctcctgcctcagcctcccgagtagctgggattacaggcgcccaccaccacgctggctaattttttgtatttttagtagagacggggtttcaccgtgttagccaggatgatctcgatctcctgacttcttgatctgcccgcctctgcctcccaaagtgctgggattacacgcatgagccaccgtacctggccaataaccctgttttatgtgaagaaactgaggcaggcagagactccaagtcacacagacaagctaaggcctggacttggatccaggtttgtgcagtctccaacactaaaacatttccctcactgtatatcctgctttccttgttcttgaactagactatgtaaagaaatgatcatggtttgtttagtcttacctaccctttcagcaaaagttaagttaaaactgtaaacaatatggagacagtacaaatagggacatgaaagggtcaacatttttatgaatatttttggcttccatgtagtatgtattaatttttttctaagcaacctaggcatatggaatttattggccttcatgagaatttcttgaggcgatattgaccacaaacaatattgctggatcataggatatatgcgtactaggaactgcataattttactgggaactgcacagatagttgccaactttatatctccaccaatactgcataatgccttttttttttttttaaacaaatttcctgattgctgccaacctgataaatgttgattatacctaatcaattataattatacctaaccaaaattaatggtttaattttgcctttttctgattgctagtgaggctgaacatgtcttcatttacttaatttaatttcccttttccatgaattgtctttttatgtctttagcctgccctttattttctgttgggtctcttgcctttttcttgcaagaacttcttgagagaatttttgtaatgtttcttgtgtattctagaaattaattcctctttgtctttagacattgtaactttcttctagtgtgtcactttcctaataactttgtctatggtgcctttcagtaatagcaacaataaaatctttagttttaatgtacttgtctcatcactttatattattattatggtctgtgcattttgagtcatttaagaaatcctcccctattctgggctcacaatgttgtctctcctcattttcttttattaacttcaaaggttactcttattatttgggtttttaaactctttgtaatttgagatacgaagtattaacccaatttttatttttaaaaatctggtcatattgtgagccagttttcccagcactatttgccaactagtacattctttctccacagagttttggtgctacccctaggatgtcagtgcatatatgtagatgtatctttctgagatctctatttggttccagttgacttaattgtatgttcttgggcctttgatacactgttttatttatttatttttcaacttttattttaagtttaggggtacaagtgtatactacaaaggtaaactcgtgtcatgggggtttgttatacagattattttatcacccaggtattaagcctagtacccattagttatttttcctgatcctcttccttctccacttttcaaaaggccccactgtgtgttattttcctctatgtgtccatgtgttctcatcatttagctcccacttataagtgagaacatgtggtattcggttttctgttcctgtgttagtttgcaaaggataatggcctcccactccatgcaagtccctgcaaagcacatgatcttgttcttttctatgaatttttatgttcttttttatcaaggaatactactccttggtgtatatgtaccccatttcctttatccagcctgtcattgatggacatttaggttgactccatttctttactattggatacactgttttaattgttgcatgtacctttatataacatgattttattagcatgacttcttgttacatgtacatttatataacttgaccttattgttatgattgatacattaatataaattttaaagttcaagactttaagattattttgaggcagattccttgcccttatttgtatgtgttaactttttgcagctacacattttctaaaaacacatttctaaaagacacatttttctagaaatgtgtcgacctatctaggaatattgtttaatttccttacttggtaacataattttaatattgctgacgttacattttcttctgtttttttgtgtttttttttttgtcttttcttttcttcttttgttagcagttatggctccctttcatacttggtcatctgtgtagggcagtggtgtgtcactgcaaaggcttgtcctcctctgttgctctgtatgtgcttgtagagctatgaggtacattcctggtacggcttttgaatgaatgttttatgaggtgtgatgcttactgactgcatgggtgaatactcttgaaagtctcttaattacagatgtctctttattattgggacaactttgtcagtttcagcttgattttctccaagtttactttgctctagtcttctcagtttagtgggtcttattcttccccgtctgcaatttatgtcacactgaatgctaggtcactttatttggtaagtgggtgtttgtgtgcctctgcagagtacaatgtattttccccttgtctttctttttctttttttttttttgagacgagagtcttgctgtgttgcccaggctggagtgcaatggcacaatctcggctcactgcagcctctgcctcctgggttcaagtgattctcctgtctcagcctcctgagtggctgggattacaggtgcacattgccacatctggctaattttttgtattttagtagagatggggtttcaccatgttgcgcaggctggtctcaaactcctgagctcaggcaatccacctgcctcggcctcccaaagtgctaggattacaggcatgagccaccgcgaccggcaccaccttggtttttaaaatgtgatgaaaccatgttgtgtacatagcatggcttattattataagtaaatttgaaatcatgatggggacaaatttaggtctcaaaatagatattgtgtgacaaggttaggctaagacaaagatgttaaccttggccaatagttataggattacgtagataatagctgtatttttttttttctagtgtctgtagttcttcaggtgctttatggacacaggagagagttgcagtctttttagttaactgctgagatttaccaagcttgcacaaagtctgataaaatcataatatagaatgttctagggtccgaaacctgctgagacggataagactgatatctgtgggttgttggaattgttctcgtattgtgctttaaatgggatttattagctattctcttgagtttgattataacagccctagctagttacctgactaaacttacatgctcattagaggactttatcagtatggaagttctccatttctcattcagattcctctgtgctccccttagtagctgtcctaccagccttccctcttattcaattattgtaatataattggcagccaaactacttcatccattcaacaggagacatttgctgagctccaaattattaaatcttagtccccgcccctccgtcatccccacctcctgtgtactggtcattttgttaagttctgaggatgcaatgtgagtatgaaatggtgcctaacctctgaagatagactcataaaccactaactggaacttaacttttttataacttaaggcactttatagcaatatattgtgacgataatgatagagagtagggcacatagaagggagtgttttgttctttcttgtttgtgaggaaggaattcctgaaggaggggattttggtgctgaattttgagaggctgagatcatttaccaggccgagatggagaaaggacagactgaggaaacagcccaggttcagagccccaaagggctcagtgaatgtggaacatggactaggagtgaatggagccaagcgatggtggtacagaggggagaagaggctggaggtgcctactggcttgggttcttggtcaaacccatgtctagggccatgcatttcatttctgaaagtgtgaactttatcctgacagcattgtggagtcattaaaggtaaaataagtgttgcaatcactgttttcagatatgtgaaaagaaagcagggagcactttagtggctaccatcataatccaggcagacatcatgaggacccaaactaaggtgatgaaggtgagaaaggaaaggcgagactggattgaagaaatgattaggagaaataattagttattgattagatggaaagtaggaagggagtaagaggaaggaaaaagatgattcttgattcttctggttttgatgacttacatctgaaggtgtcattagtaaggatggaaaacataagaagtttagggacaattgtgagttcaagttgaagtggagttggggtgtctgtggggcattcttttgatcttaagaggcctgagccccaggagagaagtgagggctggagacaattattgaagagtgactaggattgatcgtggtagccatgaatgtcgttgaaactccacagggatggccaaaggatcaaagactgagcagacaaaagaagaggaaaatctgaaaacaaaagtgacaacattgagtacccggtgctttttgtttgtttgtttttatatattatacaattcttacaacaatctcctgtgaaataattatgttattgtcttttacagacagggtgtctaaacctcaggtgagcaacttgccacgctgcccagagagtaaatagggaaaagctgtcaggtcctatcagggcacagaagggtccggtagagtgaagattgaatataggagattggatctgacagttaggtattcagtgggtagtcagaagacctctaaagcctaacactggattgtcaccagtgaggaatgaggaggagttaagaagtgggggcatcaaatggagagacagcgagagagcacaggcaggagagcgagcagatacacgcgggtgtgtacacgtttgcgaggagttgtgtgtatgtgtgtgatagtgattagagcttatagtttggttgagaatagtggtgaggaagtgactacaagtagaagaggaaatcattaatggagtaaagttccagaaaagataggggggccaagttctagagcacaagcatactcaaaggggttgttataaaagggaattgggacgtttattccattgggacaggagaagacgaggaagagatatgtgtggctgtaggtgaatatgcaagtggatgggaaagaagttgagaaagtttgttcctgatggcttggatattttcagtaaaggaggagatgaaatctgctgagagtgtggggccttgaggagacagctggaagttagtaacagttacctttgtaaaaggagcccagtgctttaggatgagtgatagctgtgtgtcattgaaggcccagttgtagttttgtcagtggtggttaggtgctgacggaggatttttttttttctgtttgatagagtactgtaatatgaatagcatgaatgaccttttacaatagaacgcacaggccctgcctgaaacattaagtttggatggtgatttaaagattggacaggaggagagaaggagcagcagacttaacattagggaacttgagttctagtcctagttcttccatttaatggaagacggggagttcttcctcctcatctttcaatggaggaagttgcatttgatgtcctctcaagtcttctgtagctctcagaacttctgtgagatttgcacatcattagacaaaaatgagtggagaagagagtaagagcagctagactcccatcacttatcatttatgggttcttctgatggcagcgctaatcccagagcctttgggaagttgacagcatgaacagcaggacagctgttagataaccgtacccaggtgtctgcagttgtgtctgtacctggcaatgggagaggggtagcaagtcagaaaaggggaaggacaggagcatgaatctgtgatgggatttgcgtgtggggtagacagtttggatttaccctttgcccctcctgctgagtgccacggtttcctgaggaatcactggtagcagataatttagtcgtttcataagagaaggtgatgctctttgcattcatctctatgttgtttctctctctctctctctggttgcattttcttttttctaggctcatttctcactctttgttaaaagtgtagtattgtagaagagaatcgaacagttggagaaggataagtattcagaggatcttaccttaagagtcctttctcctttccgtttccatcactgcaccttgaatgtctttgcctatagattttgaaggatttcatcactcttctgagttggctgtattcttcctctggaaggtgtacttattcttcaaagccatttaactgtctgagcccccttttaagaacagggataacatcttaaagccctcaaggtgtggttagcattaaaaggtgaatccagtcagatgagtggctccagagattattgtaataatttaacaagcctaagcaggtgataggacactcctttgtaaattaagcctctaatctttctttatgctcatgccgatttgagagaaacctgggaatttccttttcccccattaagctattacacaacttaatgcttggaaaattcttcacaggaagaaacagggtgtaacagtttttgtgaggcatcttttaaaaatgcacccttttagctgaagtctgactatacaattgcctctccacctctttgctctagtttctttttgagagtcttaatttctccacataattatatactcttcaaagtgaaaatagttaaaaaattaaaaccacttaaactgaaagttaaaacattgttcataaatatgttcttccatttcctgagaaacaacaggaaagattgctttctcaaaataaactaagtagcctgagtatgaagtcagaccaatagagatcaaagattcacgcatcatcacacaatgggaaatttttagtcatttttctaaccacaaaaataagtctaatgctagttctgggggtttgttttgttgcctgtggcatcaagatatgtatgtataattcagaatgtacctttggcatatttgaaattgtcttagcctaatgtgactatctagtgtgtctgaaagagcctattttcaagatatatttgatgagtgtgaacatactacatatacagcaatggaaaatagccttcttgggcattaaatttaggaagaatgtagaaaaccagctgactttttttatctgtttagcatctagaattaaaattaaacttgctagatcagtaaataattgcatagctatgctagtagcaaaagtttagcagctcatgttgaacactgaaccatattgaaaaaggcatctgctacagtaatctctctctctcacacacacacacactctcaggtaaggataacagcatttattaatatttctctatttccagaaataagatatgagaggttattttaaagaaagaaagtaaatgctcttatgattggcagatttttatttgtgggatacaagcaagatgagggagcagtatatgcctgcagtattcatctgtcattaatttgtgtcaaataatgtgattctgtattcctcaaatgttgtaaaataggtaaacattttgtctttcacagaaagatagaaaatcagatctccaagcagtttactgctatgatcttagcttccttttcaaatcccttaggtattttaaacctaagtctttatatttaaaatgggtctcttgtagacggtatatatttgggtcttgttttctttatctactctgacaatctgtgtcttttaattggtgtgtttaggtaatttacatgtaaagtggttattgatacagttggattaatatccaccacgcttgtaactgttttctattcattgcatatgctctgtttctccccccacatttactgcctactgtggttttaagttaacatttcatataattccattttatctcctctttgagaatgtcaattatactttctttttaaaaaggttttagtgattaccctagagtttataattgattttagtttcttaaaacaaaaaaataccccaaaacatatgtatgtgtatgcgtagaaaaaaatttgaaggcttttcaacaagacattaagagtaattatcggggtcaggcacggtggctcatgcctgtaatctcagcattttgggaggtgaggcaggtggatcacctgaggttgggagttcaagaccagcctgaccaacatggagaaaccccgtctctactaaaaaatagaaaattagccgggtgtggtggcgcatgcctgtaatcccagttacttggaggctgaggcaggagaattgcttgaacctgggagatggaggttgcggtgagctgagatcacaccattgcattccagcctgggcaacaagagcgaaactccatctcaaaaaaaaaaaaaaaaaaaaaagtaattatctctgagtggagattataggtgattttgactttttataattttctgtattatctgatttttaaaaaaaataacaagcaggtattttataatcagaaacaaagctttttccattttggtgagaaagaaagaggtaaatcacagcgaaataagctgaaaatctatgattctaaaatgtataccctctctctgcttccaccttgagataagcacattatcccataattacttgcactccactagtgggaaaaaggaaaggggtttactgcttttaagcttgcattggaaaggttgtcagcccctgtcctataccttctgtgcctacacaatgaaaattgaatcctcagaatgacttggaatcagtctaccctgtggtttgacataaagttttctacatatgtaaagttaaccaggccccactatttctgcattattgaggttctcctctaagtagaatgtctttttgctcttcactatctttcaaaaaataatgagtaggattagagcacttgaaaaccactttaaggtatagcctttgccaggcaaggtggcacacgcctgtaatcatagcacttttggaggctgaggtgggtggatcacctgaggtcaggagttcgagaccagcctggccaacatggtgaaaccccgtctctactaaaaatacaaaaattagccgggcgtggtggcaagcacctgtagtcccagctagtcaggaggctgaggcaggagaatcacttggacctgggaggcagagattgccgtgagcagagatgtcacgctactgcactccagcctgagcgacaagagtgaaactccatctcaaaaaaagtatagcttttcatgacaactttgtaatactttttttgtttgctgttatgaaatatctccttttgggtggggtggagaggggatgtcaggtagtatctgtggtaataggtgaagagatgatagctaatgtgaggctgttggtccatctggatttcagggaactcacctccccaccttgtgaaatattagagaaaattaccattactgttctcatgatgttaattatatcttctgaagttttagaggtttacatataaaccaaaccccaattaaggtttaagaaagtggcatgacttagtgcaaacagatgaaatgttgatttctttaaaagttgtcttaatactaatggatcttacaggtgttttcaagaaagttataagttttgtaagtataattttagtaaataaaattttgtaaatataattttaattttggactttttttttttccttccttacttgctgcatcaaagtgaacaaatgacaagtgaaatttttttgagtcttctgagagaaggaagtttataaaagcagatgcctttttctgtacttccaggtcaaaaattgtaggcctccattttaatatagcttattgttagaacaaggaaatttcatttaagacaagaaatgaagtcatagttacattctgtttaaaactaatagaattaaacattttgacataaataaaacaattagaaaactttacaaaataaatgtaaaaagaattcattcacaatacactgattattacagctatgttaaagtctacaattgaacacaaaatataaacaattgttatttaagggattataagtaaatttaataaattttctttacaaaatttttggtgagatatcttataagaagtagaggggtcagaaatcaaatttctgggatgcttattaagataagcttgaaatgtaattgaatttttaaattcgcattacaagtcataatagtagactattcggtaaatgtagggagtaatggtaggtaatagcaaagctaggtaatttgactctttttttttttttaagctcattttcaaatgagagactccatacacggagatagtagtgtcgaacaatgataaaaattctaggagttgttactatcttaacacatttatctaagcatttacctatgttgccttggtgcctttgactgctgacattgcaccctttcgtctgtttttaacttgtcgaaattgttgttataacatttatctgcctctgttcctcaggtatagctgtgaaaatagaaatggttcggggttaaggattgtgaatgggaggaagaaataatcctctcattattttcaatacagggaaagaggattatttgtaaccctgagcttttaccccaaaaggacataaagtataataggtgatctttgcttttataaatgtgaaccataataactactcttgggaaaggattgataggccctattttctacttgccttttcatccatttattttgtgataattcctctatgtttcctaatcatttgctctttgaaaaaagtgagagcttgtgatcagtcctgcacggaagccagtacacaatctaggtattagagcagtgcattgacagagaggctaccttccattttgtgcttccaagaggtggttgtaaataggaaagtgaaaattgttaaatgacaaaaattactttgaagtaaatttctctgcctgttttagaacttaactctagatgaagaatcagtatattttggggggcagtaatagtaagaccaaaaagcaacgtttttacagcagtgtcagaatatctatttgccaagtattatttccactttatggatggggcctaaaagccagatagtttgtttgacttgaaggtcactggttaatgagccttttattactacgtaggttttcaccggtgctgagcaagaaagcttacaaatctcctacctaaggcatgcttatatccgaaccattccaagataaagaaaatgtacaatttaagcttttctggaagaaaggaaaacctcaacactttctgatctctctcagatcaatagcattttaaactaaatcttttatgcgaaaagttaattaaggcaactccaattcctttcttaacagaaatggttttacatcatcctccatgaagtaactaaccaaagacaggcccaccttcatctttctccttagtaagtttattgatcccagggctctttactcttacacgtccaattttaaaatgtacacgtggccgggcacagtggctcacgcctgtaatcctagcactttgtgaggccagggcgggcagatcatgaggtcaagagatcgagaccatcctggccaacatggtgaaaccctgtctctactaaaaataaaaaaattagctgagcgtggtggtgcgcggctgtaaccaaagctacttgggagtctgaggcaggagaatcacttgaacctgggaggtggaggttgcagtgagccgagatcacgccactgcactccagcctggcaacagagcaagactctatctcaaaaaaaaaaaaaaaaaaaaaaaaaaaaaatatatatatatatatatatatatacacacacagacgcattttgtacgtatttttaagattttccttgaaattctttttaacgttctccattcccccttttaaagttacttagaagggctgttataggaaacctcatttgctgcagatctgattatcttctgggataaagataggtagaagttgcagggagacatactttaggttaatgcaaggaacaaatcaacttcaaagccatgcagagctgggctgaattgctgggtgctgtccagggccttagcatcaagggcacttttgagagtctgtccatccttggccaagggagtagagagatttgaaacttcatgggagggtggggcagagatgctctctaaggttacacagtgtgtacataccattcagtcacaagctttgtgctagaaaagcccatgcttaaataccacctctgtcccctgctaactgtgtgaccctaggaaagtaagctaaattcactaagcctcagtttccccctctttaaaatgaggtcaaaatgataagaggattatcatgtgactttaacatacataaggcacttggtttagttattccttcccactgactttgtgattctatagtttttcattctgtgccttttttcctttctttcttcttttcttactctccagttcattcattgtagagccattaatggttttttcaccttgtattgtcctcttctttattaatacctgtgccttagggcctactagtggtgccagggattccctgagctcctttggtagcatcactgtccatgtcacatatctggacaagtcagcgaagaggtattggtcctctgtatcctttggacttggcatatgggcatccctgaagacttttacaaagccaagattcattgctactttagctttcctgtgttgtgtactataacaagttctgctccatgaaagcatcagatagcagttggatatagatggagaaaaaggttttgtacagggacttatggatgtagaaatctatgctggtaacatttattttttcttcatctaagtttctgtttttggagccaggcttctaattacaaataattgtatttgacagagaagaagaatatcagatcctgaagggccagaatgattcatcctctttaaggggaacatgtaacataactttggggaatagctatagatactaaaggggcaacataaaacagttattgattacaaagtgtatgaagacccagttgcttggcagagtgatatcatttagaaaagtggtagaatctcattcgtacacacttcatgactaaaagagctggttataccgttagattgttaaagctagaaggaggctttcaggtcactctatgcagcgattttcttctattaataataaaatggagatcagaagagtgaagtgactttttccttgaaacataactcttaatactaaaaaaggcaagtcagggagatgtgggccctaattttgttgttattttcttacatctagtgtaccaccctgactccagcctctggacctgggagtcatttcattgtagctcaaagaaggctatatataccctgttagcccatactgcttactaagttgttaatgaaaaagttattgttcttcataagagatccgtcttttgtccatggtaaatgatgttatgaaatttttggtttatttggttgttctaggttaggaataattgaagtaggccagtctttggacagtttagttctcctgtgtttagcactttttgtatttcttctctgtgctggatgtatttatgtttttcagtctttctgtgagttaactctaggagatgggtataactgtatccatttttgtcagatgataaaaagaggcttgaaatgcttaaacaacttgttccaggttatacagcttataaactggaactggatcccaggtgagttttccagagcacatgttcataattgctgtcttttttttacatttcctgcttcccttactacctgagtattgggggaacaggctgtggaactgaagattttactgtaacaaatgatccaaggaagatcatctggcctgaccccttggcttccagcaggaagggtgttttctcccgtgatttcatggatgagatattcaaggccttgtttttatttattttttggtttgctgtttcaaaataaaaaggcttttagttctttgttattataaaagtaataaattctcatataaagaaaatataggaaataaggagaattaaaaatgacctttgtagttccctagtcagttgatgaagagtggattcagatagctgtatcccctcactagccatttgactttgggcaagttttatagccttttcatgcctcagttccctgtatgtaaaacaagaataataatagtgcctgccttatatagttgttatgaggattacatgggctcttatttgtgaagcatttagaacagtgactggcacacagcaagtgcagcacaagcattggttggataaaataaagggctgcccatgtagtcttctggtctgtggcccctggaggaagaggcagaggcagacccaaaatgtagatcacgcagtacacaagtgggtaatgggctgagctgtgtgttgaagcagagacaggaagaggcggcctgggaacctcagtttctttttgcctccttagtgatcctaataacctggaatattaataaacttatgtccctcactttcaagatgctgaaaatgattatgcttcttttttttttcctcctagctttcagagagctcatggaaaccaagcctgtttatttgagatttttctgttgcagggtaggccagacatgaatttcctttcatgtgatattttctgtggtctgtgttatttagttcttcctttgttttcttgtgctttggtgtgaagaaagaagatgccctgtttataaagccttggtctttcatgtatcatgcattcttaaactaattccagttgctctgaccctttgagattttaaaattgctttgttccggtttttaagtacttttgaaatattaaaaatgttcatgagggagtgggtcatgggaaaaatttcccagggttgtttgttcttagaaaattgtgaatttgcatggagaggttttatgctgggttaaattctgccaggtgcattggtcacttgaacttgagtctggttcttttgatatttaaatccgtgttgttatggcataaagtgcagagctggaacctcttaaaactaaatgcctgctatgttgagctcttgccccattgtcccatcaaagaaaggtcttaaccagtacttgggtttgcattgaggcaccatgtcaatagtgaggatcaaaagattggtctgttctgttttttgtctttgaaccaagactttccaaaaagaacatagacttgttttgaatattgccgcctctgggtgtgagtgattatgcaagtcagtagcatttttgtttttttgttttgaaaaaactgttcaacatagatgcagaggtaagaaattgcaagaaaaacaaaaacactttttcaaacttgtacaaagccatctttgaatgcaggtggtcctcagtttacaaggagttgtaattcttccttcatctgatgaaagacaccactatccaccagttaccatttgaacactttccatgatgtatccttctcatttaactcccagatgcaatgaagtgccaagccctctcaattctatcttaaattttatctggtatctcttaactgtgctgtgggctgctgcagtccacagctccagttgcggcctccatcatgttttgcctggactgctgcagctgcctctgaactccagtgctctctatacattggaaccttatgtcagtgacctccttaacaccctccagtgaattctcattatccttggaactccttaataaggagttaaaagccagagtccttaagacatcaagaccttgccgcaggaaacctcagcctccatctctagtctagagtactagctttacctacccccgacccctcaccatcttccagacacaaaaaacttcttcctgtacttcttattggctaagttttcatgacaataagctttgactacagggtatgtctgatgtctagcacactttttccccttctgctccttcacttttgtttgggtaactcctgtgtcttcttttggttttaatgtccttccagaagctgtctaacccctaaactggattaggtccccttgctgtttccatagaacattttacatctccaacatttcacttattacattgatttgccttttctaatagatttcaagccccataagggcataaatatgtctatcttgtttcccactgtatcccaatacccagcacacagtaggatctcccgtgtttttgaatgaatgtggtccagatcattcccttattattacttgtagtagtgcttagcacacaacctgtgaatgaatttcattcctttaaagggagttttcaaaaaccattcttgttgattactttgcttaattgtactaaatatgtataaacatgaaattatatatatatatatatatatatatatatactttctgtgcttatagtttttataaaactattaaacattttaaaatcgcaaatacaaataatatattaaaacctttgaaatttaaattaataagatgaatgcttttttgccaacactaaatcacttatgttgattttttaaaatatgaagttgttccattgggtccaaatatgtacttaaggcatatgagtcttttgactgatagtagtaatgtagagaatacttatttgcataaataagttattcagaagcacattatgaactcgaaagccttgcttgctagctcaggactatcagaacttatcagatcgtaaatctgccagtgaatagttctttagttacaattttaatgattttaatgacttacaacttttttgttagagctgtaaatgtcctgttcattcaaagatgatgttaccatttcagaattactgacatcaactccaaatatatatctaattcaactattggcagaatcaggaacaggaatatgtttgtaaattttagttcttagagatatggaaaatttttaaggttttcagcatgcagccaagtgtcagactgttgaaggaagtcaatagattatagaaatgactcattcagattattttgaaaacaacttgaacagaactttttgttatcattgcctcctctttataatttttgaattgctgaaacaaaacctttgctctacaatacctgcatgtgtagcacataccttcatgtcatttgaccttcccttggtgtgtttctgcagattatgtatcaagtctgcctctgtcctttcctcatcagcctgaagcagttactatagtacattccttcactgtttgtcattttatggtgccatgaaattaaagtcttgctcaatgacagtcttaaattacattttatcattgccgtgtgtgcttatcagcaccccaggagtactgatcactgatgaggaatgcttggtgatgtggcaattataaatacacacttgggcatggtattgctaagggggtcattcggatggtccagtgtgcatttatatcagtttcctttagattaacattaagatgaaaacacaaattgaaagattattctggagaagtcatagactcttgaatgtgtcggtagttttttagagatccttagacccctgtttgagaacacttgcttacagcattcatagactgtgtacaaaaatacagccagattattgtgtttctggaagtgttctggcgtttctaggccattcctttagttctctacttttctttagcctttgagcctatccctacatcttagaaaaccccttcttggtgagaggaatgtcaagctttgttttctggtctcacgaaggcccgataggctctctgttggggtctctctctggctatttctggttacctaggtaaccctgcagcccatcccctcaggagcatggagaatacacacctgttgaggagggaatagagagagcagggcagcaaggagagttaagggcggcatgaggatttcaagtgtatcaatcagatagatacttacacttaacattaaaaggaaaaatcggtgtgatgtcgaccccaaagtcgaaggtattttattaagccaaacatcatcagggtagcaagtcacttagtatttgtgtatttttttaactgttttattgagatataattcatataccatacaattggcccacttagagtgtataatccaacagtgtttgtagtacatttagaatcatgtgaccattaccacatcaattttagagcattttatcacccgaaaagaaactctgtccccagttaacatcattctccatccttttcagtctcaccagcccctgaccaacattaatctgtagatttgcctattaaggacatttagaataaatgaaataatacaatatatactttttcataaattatgtagtcactttttgactggcttctctcatatttttaaggttcagctacactgcagcatgtgtcagtatttcatttctttttattgccagatcatatcccattgtataaatatgccagattttaaagtgtaccattctgtaatgttaagtatattcacattgttttgaaacagatctctgggactttttcatcttacaaaactgaaactatatactccacattttatttacccattctcatagattgggttgttttccacatttgggcagttgtgtataatactgctgtgaacatttgtatgcacgtttttaggtggagatatattttcatttttcttgcgtgtattctgcctaggagtggaattgaagggctagtcatctggttattctttaacattgtgaggaactgccaagctgttttccaaagtggctgcaccattttgcattcccaccagcaatgtcgtttttgatttgcatttttctaataactaaggatgtagaacatcttttcatgtgaagacatttaattaaaatgttttccttaaaataatgttttactagattctcagggttataacttagaaaggaaacatccttttagaattcttcaaggatactaattgtaacccaaattatgaggattgaaagacaaagagtaaatggctgccctcattgtaaggactgactgttggcaggttaggttttaagtagaaatggtttagcagtctcattttcaggaacatactaaatggagtcctgaactgggttatctgtgataagcaaaggaggaaagagaaaaagaggcagatgggccaatgtaagccattccctttcaagatgctcaattactagcacaatcaagccaaagaatggccttcaaatgatgagaaaatacataagccatctatacattttctagtaccttgtttggtgtctggcacaaaatatttattctgggttttgaagaagatagaaccttgaatgcagctgacacaccaagattttgaatcataaaatgtaaggattagaagctaatgattcccacaggaaacattataataagtaaaaacaggctgcgcaaaccgtccctgggttaaattcttaaagctactgggctccttcagattatgcaaatttcttcaaaactacatctgatctctcccatgattccctcaacacatgcatgaaaggtatatgtgaattccatgacacgaatgaggtttatttatgtaaatatacctcagcatattcccccaccccccaccaaataaggcacatcaattttttacaataataaagagctaattgttgagttctaactatatgccaggcacgtgctaagcagtgtacattgtgtcatttaattgacatagcaactcgatgaagttgatcctactcttattcctgtattacagaaaaggaaatttaggttcagcaagaccaagtaatttgcccagtatcataccagctctaaagaggctaccggaggattctaggcttctggtcagtgctctcaaccactgaacacaaaaatgtctttcttattccttttagtctgctgcagtaattgggaggatatagaataactttttaagtattgacactgtattttttgttgttgtttttttgttttgttttgttttgtttttcagacagaatctcactctttcgcccaggctggagtgcagtggtatgatctttgctcattgcaacctctgccttctaggttcaagtgattctgctgcatcagcctcccaagtagctgggagtacacacgcatgccaccatgcccggctaatttttgtacttttagcagagatggggtttcgctatgttggccaggctggtctcgagctcctgacctcaggtgatccgcctacctcgacctcccaaagtgctgagattacaggtgtgagccactgcacccagccaacactgcgttattttgactgagattttgtgattgctaccttggcctgtgctgactagaataaccagtttagagaagaacgtaaatgacctgatggagctgaaaaacacagcatgagaacttcgtgaagcatacgcaagtatcaatagctgaatcgatcaggatcaacttaatgaaataaagcgagaagacaagattagagaagaaagaataaaaaggagcaaacaaagcctccaagaaatatgggactatgtgaaaagaccaaatctatgtttgattggtgtacatgaaagtgatggggagaatggaaccaagttggaagatacacttcaggatattatccaggagaacttccccaacctagcaagacatgccgacattcaaattcaggaaatacagagaacaccacaaagatactcctcaagaagagcaaccacaagacacataatcatcagattcaccaaggcagaaatgaaggaaaaaatgttaagggcaaccagagagaaaggtcgggttacccacaaagggaagcccatcagactcagcagatctctcggcagaaaccctacaagccagaagagagtggggaccaatattcaacattcttaaataaaagaattttcacacggcgtggtggctcaatcctgtaatcccagcactttgggaggctgaggcaggcggatcacaaggtcaggagtttgagaccagcctgaccagtgtggtgaaaccctgtctctactaaaaatacaaaaattagctggccatgatggtgcacacctgcagtcccagctactcaggaggctgaggcaggagaattgcttgaacccaggaggcagaggttacagtgagcaaagattgcaccactgcactccagcctgggtgacagagcaagactccgtctcaaaaaaaagaaaaagaattttcaaccctgaatttcatatccagccaaagtaagctgccttttagtttttctaaaaaactgatagagatgccaggtgtggtggctcacacctgtaatcccagcactttgggaggctgaggcgggtggatcacgaggtcaggagatagagaccatcctggctaatgtggtgaaaccctgtctctactaaaaatacaaaaaattagctagacgtggtggcacgtgcctgtagtcccagctacacgggaggctgaggcaggagaatcgcttgaacccgggaggcagaggttgcagtgagccaagatcgtgtcactgcactctagcctgggcgacaaagcgagaccctgtatcaaaaaaaaaaagaagaagatagaaactaaaggtgtctcctggcctcagttttctaagtcaagaagagagtctagttaaattttgtgtacttttactacagatttcctatatttttgcaaaattttctcttaagttggtgcatttagaagggaaactcaataaatattttgtcactgaagagatgagagacatttgacaccccctccccaccttcccctcagaattcaacctgataatgcagaggctttcacagccatctagtcccaacattgtctataagatgcttcaagatagaactttaaggaaaacacatgtaggaggcagtgaccaggggtacttggaaataggtaccctttccaatttagctttgtgaacatttgttcaatttggtagtttttaagctaactaatagcattgtgggcattttattcttggatttaaatttgggtaatttctgtaggacgctgaaataccttctacctagacatagaattcaactttaaataatcctactttaagttggttcctgggatgaggtacttagtaatacagtattgaagtggtagatggtgaagttacttcctgtggtggtgtttcattcatgtctcaggttgcaaagttatgtaagttgtttacagcaaaatactagtgaggaagagttcatttgccactgctagaaggtacagactccccgcatttagtatgatgactatctttggtcttttcttgcagctgtcttgtttatagagtcaaattatcttatgtctatctagggttaaatgtcacagtctcatgggcaatgtaacaaagtttgtattttgtgctttgttaaagaaagctagtaggtgattacttgcggttgaatcggtatttggagactcattaatgattaattgaaaacacacacaagcacttttttggtaaccgcctgcgcatagcgttcttttggggttcagatatttagcagatacccccttccctctcctaaaaatatacattcattttatattgtgttagacttaaagtatatttgaacagaatatgaagtttatgattcttaaactatttgcatttacatatggtataattactcttaggtctctgacggtaatagatgtccattttttttcattaatactcttgtttctttctactgtttacaggaatactaacaaaataccttaactgtcatctcaaaagttaatgataaatgttaataaacttcattataaaactgttcggtgatttacaatttgaaaatattggcaacccatagtacctggtacctacggtttggaacatatggtgaatggatttatttcaataccttcagtggctcttttctgaaaaagtccattgaaaatcttatgaggccttttttgtacttttgcctgtttgtttgtttgtttgttttgttttgcttgcttactcctaaatactacctcgtatttgtccacttttacttttgggcacttacagcttttaccttcatttggcattggggccattatgtttctattgacctagtattgttcagttccttggatgatctcatcctcattacctggcaatctctggcaaagtttcacacttaaattttataaattgggatatcactttcctgagagtgtattccgtctgcaacgtaaatgcaagttcttttgggacaagtgccatagtttaaacgtaaattattcattgacagtagcaagcgttgtgcaaactatgcagtgctttctcagtaagtgctcattgagttgccctgtgtgcatgatgaccagctgtgttatctggatgtggaacatagcgttctgctatctgttttcagaaatgtcgcatatcccttccagggcagaccactcattgccaaggcataaggtcgaaaactgcccagtggggtggaaagcaaaggcagttggttagctgttggtgctttctttactctctacgaggatctttcaatggcagtgaccaggacttcattctgttatttgttatagaacaggcaagacatgaaccaacccagtcatattctgtaccaaacacatctgtggtccattctgctttccccagctttggtttcttcatttcacacgtccaagagaattttcttaaggataaccatcttattagaaatatgtctaattgataatgaaatgtctgtatttagctatttaactttgttctgggttctctctgcttacttaatgtgactgcatttccctgagatgaatgctgtgggtttttgcagtctctccccaactttgcccctcccctcttagatgaaggtgcatcactagagaacctgcaccactgtgtctcctacactgtgtcaggtagacagtacatgattagtaatgtgtgtgcaaagctttcatgaatgcttttaagaagttgaactcttaatattttgcttaatttccacatgtttaggataggattaatgtagagttgaaattaagatagcatcttgggaattttagataggaatcgtttgtgacccaaagtgaataaaaattgatattacaagcaggcttttaatccagaaaatttacttattctgtccagactgtgaacagttgttttgttctcaccaaaggcaattttggtgaagtgttcttagaaacagtgtgtacaggcttctgtaattgtacaggggagagatcatagagatccagggaacatcaagatactaattcaacctgtcctctttgaaaaatttgaccccctcccctgtaactcaacaacccctcaaagctgtcgatgcaaagttgcaaaataacaaaggcttctgtattaatttctgtgttacagccttctgggaagagaatgctgggagaaaaaatatttctaaatgtataattgcatatatacactttttaggttctccttgtatttttaatgacctaatactagaacattttgataagtttagttcttaaacagaactaccaaacacaaaagccagctggaggcagcaaatgactaggtggatgttgaagctcatgacttcctttcagtggcctcttctttgtatacagctccatgtttatgtccagatggactgactatattgataggttccagataaacaatggacacattagaagaggggtgttatcatcaaaaactaacaactgaagagttaaaatatgaaacatatctttgtcatgtaggattgaaaactatcatattttattgaatcaaatttatggcatgtttctcgtaaacctaaattttataatcctgtctgttaagttggttggcaaagcccaaatgttttcccttacattcctgaaacaaatttataaagtcaaagaatcagccatatcatagcaaatttagagtgccgtttgataatgaacgacctagtaggtcattaatcttttctatgggcagtgttttttttcctcatcagctgcctaaagtatttgggaaattgtatcttgtgggagttgccattcatcaggaaatgcttgttcatagatctaagccagaccacatgtagcagtaaatgttatttatcactatggaaaccaaaaatcacaaatgggatagtctaagtgttaagcattctgcttcctatggcagtaagtcatacccaaatttggttcacttcactcaaatatttgtgaggcacttaacgattaaagggtttgtaggtactttgtttaatgaataaatttctcctacacaaagctgaaaacatcataaagggaaaaactaggaggaagagttgccagtttatgtggcttatcaagctcataattgtagacccctaaattcggaggcagaggactagagttttagctgtggtgctgccagaagctagctgtgtagctttgaactagttctctaacttctttggaactcagttttctcatctataatgagatggagttggattctatgacctcgaagtgtgaatctgttttcctttattattccttgagaagtaagaaactatttgtgtgtgtgtgtgtgtgtgtgtgtgtgtgtgtgtgtggtaagtggggcataatatttggattcattatgtcaggagtagtgaagtttactattacccttcagtgactttatcacctaaaaaaagaacaaaaacccatgcttagtaaggatagggtccacatgttgccatttatctatggattctgccttcctctccactcagtatgtattgacaaaggatgtcattattatctagcaatgatgaagtattgcaataatctgaattgtagatgttgaattgactcgtagccaaaaggtggcatttaaggagtataattgctgttcatagataaaagtaagaataatgacttaagcagtaatccaaaaatgttaagaagttggtggaagaagaggctggctgaattgatgagtgagaatgtttattcataaattcatttaattcttagttctactgagactttaccatgattgtcattgcagtagttcctatacagtgggaatatgttcctataatgggaatttgaatcattcagtgttgctgatctggttgtatctggacgaggcaacttctcttacctgttgtctcattatttagtggggggaatatctatcccatccttacttctcaagaataatatgaggataaaaaaaacctgtataaagctacaaaccaatattattttgtacaggttaagtagcccggtagaatcttttggaattgattgaaaatacaaatgcctttttgacaggcattgctgttggattttttttaacatgggagaagtttactagatttcaaattttaaaatatgcatgggattgaaagttagaagctctgaaacatttaactatctggtctttacaaaatatcataataggtgtccattaaatgttcttcattcactcattcatttattttatagtttttgatcatttgctgaatgccaagcagtgttttagaagctagattatacagttgtgaatataacaaaatccttatccttatgaagaccatatagtagatgagtctgataagcatgtgtttcatggatatctattagatatcctttaataagtgctaataacaaaattaagcaagataaagagatagggcaatgagagaagggggtgttacatggtcagagaaagcctttcatatacaacagtgtaacttccacctcttttaaggtcttctttatttctatatgttgtcatctgacactgtacccaacacatagaaggtgcttattaaatgtttaaatgaaatttttatttatttaacaaacacttatagaggacttactctatgccaagcagtgttctaagtgccttgcaaatattattttatttgattttcacaagaacgctttgtatactgtttcattttatgaggaaactgaggcaccaggatgttgaggaacttccgcaaggtcacagctaataatgaatgaatcagtttgtaaaggaatttaaaaaataaagattcttaaaggttcttagtgccacctcttgctttcaggaacaccagatagggtgggactccatattttgggatcatgttgggtagggagcatgtcagcccctgaggtccttttgaaaagctcctaatacctctacctcccaggccaggcagataccactcttctccaggcttccatccactcagagctctttcctgctggacccgttggaagcttcgtctgctctgctgacacctggactttcctggggctgaggttaagtgatagctttttctctgtggttgaggaattacagctactagaaaagaatgtatcctcttcatccattctcctacctactatttaaatggcaagtagtgtttttatactgtggtccacggacccccaggattaaaaccaccgtggggctcatttaccatacagattcctgggctccacctcagacccactaaatcaggctttgcagatggggcccaaaaatctctattttaagcttcttaaaaactactgggttagaggatgtgcacttcccgtgtgaggggaaagagatgaagaaaagagttatataagacaggtttgtctccacagagagtgcagagaggttctgtaattctgatggaattctttccctgcctggttagagcagagaggtggcagggtagtgggagatcagatattaagggaaaatccatgtgaaaactccagagtcatttagaataagggttagttaaccgtggtctacaggacagctgcctgtttctgcaataaagtttctttggaacatagccacattcattggtttatgcattgtctgtggatgctttgcactacactgatagagtcgagtagttgttacaaagactatactgcctccaaagcctaaaatatttagcattcggtcctttatagacaaagtttgttggatagcttaccaaataactacatgaagattgaaaagtttctatctgctctccaatttggtagccactggcccttgaagtttggatagtgagcacatgaagtgtggaaaatgtgaccaggtaactgaaagtttcatattatttggttttaatcaattttaaaaattaatttaaacctcaatagccacatttggctgatggctaccatgttggataatgcagaactgcagaactaaagtgaagctttcagattgggattggctgtaaaatgtcaaatatgacaagggtctgctttaggcctctggaaagagggagtctaaggaaaggaacatctagataggatatattttagaagaaacttcaaacagttctttctctctctctctctttttttttttttaaatttgtgtttattaagagttacttgtagggatccagttctgccacttacagctttttgaccttggtcaagttacttagcttctctctgcctcaatttcctcattggcaaaacaaggataataacagtaccttttaaaatttttatgagctttaagtgtgtatgtgctttaaaaataccttgcacatagtaaaagctttgtgagtgtttgctgttcttaattattgttattattatttcatgattttttgtggcctaatctaagaaaataatccttacatatttgccccactcccccttttctgttttaaggaaagtggattctgaatttcagagtaatttgtatattaacctggctaatgcagcctgttcctaaaacgtggctaatgcagcctgttcctaatttagggaccagcggtggttcacctccttccacgcaggtttgttacagttaacacggttgggtccagcacgtgacatacatggtatggtattgtctaggttttattgatggtcactgtaaacttttatagataactgaaactcttcaaaaataaactaggcatttttatttagaagcagactgtttcttagtgttagttcttgttcctaagcaggaatcatagtaatatttgaaaggaagtatgtttctattttatcttgagacgtgtcagaatctcctaacatgagtatgcttggtgccttcccttttatagaagctgagcaggactggcaggaactgtttgagaggtgcgagttccctttgtttgtgtaaatgatagcagtgatagaaattgaaaaatgaaagaaaattcagaatcatgtcactatgggtttttaaaatccagtggctatttcttaactctttcatcttcagtattttttactaattagttccatagacttgcagtggataaacaatatcacttaaaaacctcccagaagccagtgagtgcagcttcttgaaaatctgcttctaagttttctgagacagcagtgatgtgaaaatactttatagtgcctagatctgttatccaaggctcgaacagcagagtgttcagcaggtattatgtgctcaacagttgctcatcaagctgcctttttgacctgtaagatggcattgccaacacctgttgatcagtacataatatgagaagaaagcccttggctagatggcaagaggtattttcttatgcaagtagtcccattctctaggccatattgttctgttggttgtcttttctaattctggattgtgtttgaatgtatctgagatgcattgaacttgcttagagtttccatggactcattgtacttagagcagaaggaatgagaacatggtcaactattaatatcctctagcttgaaactatctacagtctgaaactttagtcatcttagggaaggaggatatggaagtatagaagtctctgatgagggccatgtgcagtgtctcacgcctgtaatcccagcactttgggaggctgaggcgggtggatcacctgaggttaggagttcgagaccagcctggacaacatggtgaaaccctgtctctactaaaaatacaaaaatttagccaggcatggtagtgggcacctgtaatcccagctacttgggaggctgaggcaggagaatcacttgaacccaggaggcagagattgcagtgagctgaggtcgcaccactgcactctagcctgggcaacaagagcgaaaatccgtctcaaaaaaaaaaaaaaaaaagtctctaatgagatgtggcccatgaaggactggattgcgcagtaagcacagctgtttggctgcagcccctatttttctgtgcacatccgtgcacccccctgctctgtatctccctgctgcatttgtccgctagactttatctatgcttttctagcactcttatctacagccgttgacacccatttgtatctcttcagctgaaaaagagtaagcaatgaaagagtttatcctgctataaattcaatgtctgttcttctccttttgtttggggatgcagcttgcaatttagaaggtggttccaattatcaatttcctgggggtataaaccttattaatataaattgcagagctagaattaatgaggagagcttttgagcagaccgacatcagctcactgtaaggaaacaattgttgagaactagagccgtccagtagtttgctactgaaagaccttggaaaagctcagatgattctggtagagatgttgaaatggataggaagctggtgagatggttttttatgttgggatattgtatacttcaaagatattataacaaaaatactttcctggtaaatctgttgtgttaccttatgtatgatattgtgtataagaaacaatttcttttttcttaaatcataggtgaatgagactatcaaatgtggcacactagtagacaccgttgttctaatgatgcatgttgtataatcatttcttccctacaaatttattttaaaattaattaacaatttactaattatagtatacttggctgtattcagtagttatttgtttgggacctgctgtacccatcacagtgtgctagcttcatgagggataaaaacataaatatggtgctgcttttgcattctaattggaaaaagagacatgtaggttagctagaatataaatgaaactatgaaatgtattaaaattgaattacaaaaaggtaagtagaagccatttaattcttcctggagcaatctagagagatagtgtggactgaacttcaaaagaagtaaggttgaaagaggcaaggataataattattaacatttatttggtatttagttatgtgtgagacatttatctatgtgctttgcatgtctctacgacgtttggtactgttaccctcatattactgattggaaattggttggggcaaggaggaaatttgatatagatgtgtaagcagggaatgttgagtagtctcgtgtagctgactatagaatttgtggggacagggaactgcatacgagatgagaaatgtagactggagtcaaattatctaatccaaaagaaaaatttgactttccagattcatttccaggatcatctgaggcaaagtgtttaatgcaaaatacattggcattggagtgatgagctttagatttcagtgctagactgtaataatgtgaaatctcattaggttggacatttgtcataaatcagaaagaagagacctaggtttgatttttttttttttttggcctaccatttacttgctgagtgttctacattctgcagagatttaggttcattatccataacatgagtaataaaatttccccatgagtatgtgaaagttccatgcttggtgccttatgtgtatataggaaggatgtaataaatattagtggatctaaatcagaaaatagaatttaaagcagcaactcttgcccaaccagctagatacccttatatatatttcctttgtatcactcttcaaccttttgaattcaacaccttatttcttcttgcatggactgttgtgctagtctttgaactgatctattcattctattccaaatacagaatgttagattaattttttcaagcacaacatgttattgctaacatacgtatgtcactgtattacataatacagtgtacatattacataatatatgtaatacataatatatttattacataatacatgtcactagcactggaatctaaagctcatcactctaatgccaatgtattttgcattaaacactttgcctcagatgatcctagaaatgactctggaaagtgaaatttttgatggcactccatttcctacagaatgaaaagcaagttcttacctatgggctcttaactattccattattaatctcttctttttactggcctatctcatttccagctccatttctatccctaatcctcccagttcaatgatttctcctttatggttctttacatctttggacatttttcatccagtcatctattcagccaacaggaaggctggtaaaagtgggagtatgtggaaattctccttcgattgcatattctttggaaaatacaaagtgcaaggttttccagctgagggtggggaggagatttctaaagaaaggagaatgtatgaaatagtcatctaaaaaacgaaagaatgatggacttgggaaatatgctaggattgctaggctaaactaaggacccccctgagattagtggtcataagtttaaaacagtacttgtcagtcagcatggtgactgattttctccaaacatgttcagcagcccaggtacagttgcagagtaggtggagatttggacttaacaaaactgtggtttgtcagatgagtaagatggagaaaagaagaagcaaggggagctatggtgtaaggaaggaaggaagtgtttatagtaataaggcaagtggaagggagaacctaagggggctcaagacatgaatggcctgaaaaggcatgatcatgccttttcttaggcatgaattgtgatttccatccattaacctggaacagcctcactgaacttcatttttagcttctgtttttcatttccaaattcatagttgagtggtcattggcctgatgacccttggcccagaacagcaaggccatgctgagggtgcccctggctatgaagtaagagatggagttggccctgttaactttaactctgcgagctgttcatgagtcttcatctggaagcagtttatccatatccactgccttggtgatggagtagtgcactgggaggggctgggactcctgaggccctgctcagcagagcagctgccagagagaggaagataaggcctcactgccatcagagttaggaccaggacctatgtttctggttgtatgctgcctacggagcttttggatgcactctgggacaggagactagaaactttggcagttgtttgagaaacaagttcctgtagaacagtagctatggctatttagcatatgtttgttaggtccccttatgtgctaagccctgtgctgtgccccaggaacacaaaggtgaataaggtagagatatccctgctgtcatggtaatttatttcttgcttcctaccattcatttgtttcattagctttgctgtttaagtactacgtgctgtgcactggactggctattggaattttaaaaattaatatgagtctactcaagggtaagcagataaattataatacctttatatttactctgtgagatacactgcaggcgctgtgagtccacagatggtaaatgctgtgggagataatgaatgcagaaaagggctcatcccctgccctcagggaggttatagtccatctaggagaagaaaaccacagtacctccagaagcatatcccgctatttaaatttttcactgtttcattatttgtatgtcaaactccaagtgtttttgtattcccagcagagttctggcgccaaagtgctaataaatgttgattgaattaatggataaataactgtgtattgcaagacagaaattgacatgttgctataatagagagtagttcttttagaaagtgtgacatttgagccaggcctaggaaactagatggccgttccatatgagaaaagaagaggcatgccaaacaccagaaatagccacttgttaggcccaggaaaccacctggggttctggctggtaatgagcctagggcatatggagaaatgtggagagattaggagggaggacgagggcagatagtggatggggcttcaactgccagtcaagggagtttagactttatttagcaggtagtagagtttttaaagaggaattccagagctgggcatggtgatgcctgcttgtagtcctggctactgaggaggctgagacgggaggatcccttgaggccaggagtttgagggtatagtgcatgatcacgcctgtgaatagccactgcactttcaccggggcagcttagtgagacccccatccctcaaaatacgtgtgtaggcgtgtgtgtgtgtgtgtgtgttaagggacagtattttcagaaacttatttcagagggtactttgagaaactacttttgatagcaatgtagtgggcagattggagcagttagatccagttggatcaactaagatccaatctgatcttcgttggattaaaataggattttatttttgagaatgggggatatccaagcatgaccagagggtaaagggaaggaacccctgggttttctgagtgcaggatcacgaccagatggtaagggaggaggagatgaacagcacatctcattgggggcctggtcagcactggtattggaacctctcagtaaagtacctgctgaagagagatgccctggaggagccggcctaggctgtggattctgggcctttaaggctgctgttaaaatcactaactgtggggtttcagctaggtggggaaaccagaaagaaaaaacaggaggggctaatgatagaccccttgcatgctccagaacatctaacatgttgttcaagtggtataattgacatattgatgatcagacagaaaatgcagagcactgaacgttcgtctcttaggaccctaattacctcctttgtaaaacaacccttcagattctgttcagcactagcagcctgtgaatctgtcagtggagaaacatagggactttagaaaagctgggtgctttctgaaaacccaaacaaacacccactgccagcatccaactcaggaaggtcatccgatcctgtcagtgtgggtactttgatccatttagttcttattcattattactgattctttgtaggtaaagtttataagaaagcaaaccagctaggttagagcgtgtttcatgttaacctttttttcctttctcattgctgaagaaagtagggcacgttgtttgaacggcatctagtcatgctacagcctgcacctaaaattgcagatgggcctttctgcaagaatccttaatgcgtgaacagagattcttcatttgttctttatatctggttataaaagaaaacaatctcacagtaagccttagggtgggctgtagatgaggtagactttgtgtgtaatggagccctttctatttcctgacattagtcactgaaggaaaacgcccacataataataaaaataatacctaacatctgttcagcactttggagctcccacttgccatatatattcacatccagatatcagaagtcatatatgcgatgttacactctaactaatgaaagcaaagataagtattgaatatttaggggcatgcatttatttaggtaaggatttatggcgaagagcaggttccttctgttttttcaggcgttgacattggggaagcgatagagtggataagaaccgtggagttagacaaacatgggttcaaaccccaactctagaagcagggtgacctttagcaagctgtttaatgtctcaaagatcccagctttctcattgtaaactagaattataattcctctcagacttgatgtgacaatggaaagaaattaggtttataaaactcagatacgcttggaaccagagaacggcacagtaactggtaataacaattacttaaatggtgtactgttggatcttggcatcaggaacctttccttgcctttgtgcccttagacccgaactattacagttcccacctacatttctccttttaagatgctgtgtttgcactttctacctcagtcccactgatatcatgcttgatgttgcctccagctaagttatgacagcaacctcccagacaattgctagtatctctcatcctcccatctccccacaaccacaccacagatctcatataccatggtatgactatacattctaaacctattttatgttattgtgaatctgtaccatctgtctgctgcctattaaataaaactacactccctttaaattttgatatcctctgaaatctggcaaaatcttaccctttgactttatttcttatgactactcagtacgaatttttggcttcatccagggatcttaaccttagacatagaatgaactcagttctcctcagtgcctttgttcatggtgatcttcctgcctaaaatgctgcatatagcattgtttataaagtatggatgcatggatgcatgtattatgagtcataaaagaaacatgagggcccagaaacacattttccttttaaagaatgatgaggaaatccatatctagacacattcctctgctttccatttcatttccgccttgacaattaatatcctgacagtgttagaatgcattaacttaataatggtgtgaatacatcctagtaaggatagtaccagcgcatttaacagcctgaagaaagagattttaagttagggtgtttggaaagggcaaaaaggcaatagtaagtttcctatatatgtgcactaagaaatatctgtctggacccatcagagaacccttattctactgttgctggtgtttactgtcttccttaacgttgttttctttgagagaataaacacattgtgcttgggcatcagtgaagacctggtgtgcaaagagtgccctgctgtctttctcttacaagatcctcaattcctcaaaccatggcttcaggctgcaggctgtggaggcagaatgggcaaggagtcattttaagttcactccctggtttcctttacatcagttttcataagatgtaacctgatgtgtcttggacctatagacaaatgctattttgcttggtcttcacaatgtaaaattattctggtttgttgagatgctttacctcacttacttgcatttttccttctattcctttactccttaaagaaaagttaaggggtgagagtggggagaggaatagtaatgggagaatctgttccatattatacctcatccataatgaatctcattgccttcgaaatttttcctcccatttttaagagtgtagtgcctcatccatggcagttagtggaaacttaaatatcctaagatttatcctttgccaattcatttagtctctgaagagtgagagactcttctcaagtctcaagacagggaggtgctcttctcaagagccccggacgggggaggtcatttgtaacttcttaagggatggaagttacatttaggattttcttttacctccaagtttcttcttagaagtttaagtagtggaagaaggatctagtagctcttatactgtagcttactcagtaaaatttttccttatccaataaggtaagtacttgtaaaatcatagtagcaattaagaggctgcttctctctttctgttggcattcatttattgtaaagacaagaacatctttttagaaaccttaaagcacttaataataagcaatttaaataaggtgagaaggaagaaacattttcctcagtttttatctcaaaacatatggtgtattcgcagcccataagttggcagtaacagcagcctatttaataaaacggaaatatgcacgtgaggttaatcaggtcaaatagaagtatgcatatgtagaatgataacctcgaagaaaactgcaaatttattcatgcaaagagtggaggggaatgccataaatattaacagtggtccgaaacttacctgattttttattcttttacttgtatgtatttatattttccaaattttccttattgaatgtcattaactttataatcaaaaagtcactttttaaaaagacatttttaaaatggggcattttaatgtttttaaaaatgttttaaaaagacatttttaaaaagtgatgccaaatgatgggtgtgtgctgatttggtgatttgttatttaaattttatttcttagaagaaaaaaatgggagaaaagtgtaaaatgtgggagaataaatgattaaatatgacttgttgaatatactagtcgtttacatgggcataaatctggaaacctcagatatcttgaagggtcacaaagagccgatttatctgattaagttaattaatacttatgaagtcctttgagcagtgcttggatatgatatgcccttttttattgtttttattttcgtcattatcacgcttggacactagcacatattataataccttatacgaatggtagcattcactaaatgcttgttgagtgaatttttctagacttttcacaactctggttcatttagtagttgtgtcacatttggactttgatgcctggaactgaactgaacacagaatgacacacatgatctaacaagtgcagactgactgtctcctcccctgtcctggccattgtcctggtaatagttttttgatgagcaagtccctttgttgcctcataccaagctttcaacctatgaaaacactgaagtatctcatagatgcagtaactaaactagttatctttccctgatgtgtactcttgaattttttaatcaaattattaacttccctggtaatctaacctttttttttggtttggcccacctttcagcctgttaaggtgttttcattgctaactctttctatcctgtatagtatcctcttaagccttatgcaatcaaaatttctgcagcagtatcatgaatttaaaatatgggataggaggagagccctatggcatggcattcttcttcttattttctttataatgttaccacctcagttatttagtttgttggctaatgacagattagggagccacagggtgggaggtttcttagaagaggggtggactgatcataccctgagtttattatctgatgccacaggagaaaacagaaaagatgtaaaaaggcaccaagggagacgtgacactgtgcatttgtcaaaacccataaaactttacagcacatatattgaacattaatgtatccagatttttaaaagccatttaggaggttggaggatcccaggatgaaattcagactatgacaaaagaatccaactgtattacaaagtacagaataaactcactgaagaaagtgaatgaaaaagggttaccgacttaaataacttaggaactatatgcaagcactatactctattcgataaagttgtttcccatgaggatataagttaatgattctgaaactattatatatgtacactggaattgaataataagtaaatggatagtggatgatgagggccttggtttctcactttggaatggaaagttatagataagcaaggagggaaatgatccatgtggtaatggatttgaattggagataccgatatgaattcatgtttagcttgatatagatacaaaatacaaagaaatatttatagatatgtgtatatacacaagttagtacgcacacaatttcttcgctgtgtcacctgagagagcctaaaagcagcaatatcccagcagcaacaagcatatctggcatccagatcttggtttctaataccattatcctgtgaaagccaccaggtctcctggccgaatgacagattccagattctagagcgggggcagggaatgtgcaagatgaacttggagcatcttgtagtgctggaaagtaaggaagagcttaacaaacccacaatgacgaaggtttatcagagggacacaggagttactgaaatagctcacagtggccaaagatgaaataatttgagcaacaaaataaagtagtaatgaactgtaacccaaactatgaaatatgtacccatcctgatataaataaatgattgaatcaataaataaatgagggaaatagacaaatctgtgcagaaaaattccaaatgatttatgtaggtattccactctcaaagaagtgggttataatacttgtcatttccttaagtgtgggctgtgcatggtgacttccctccaaagagcaatgtgggaaggcagagaaacctgacaaatactgctctagtctggtgagcaaggttaacatcagtggtggtaagtcaggctagtgtttatgcttgatatgatgtgatgagaatggcactttacttctggggtcttactcccagaaacctataatttcaggctaatcatgagaaaagcatgagactaattccagttggtggtcattctataaaatacctgaccagtactcctcaaaactgtcaaggttatcaaaaacaaggaaaatctgaggaactctctcaaccaaaaggaacctaaggagatatgagtaataaatgtaatatggtatcctggatgggatcctggaacagaaaaagaacattaggtaaagaccaaggaaatctgcaaaaagtgtgggctttagtggataatatatttttattggtctgtgaattgtgactaatgtatgatattattaatgggtggagtatattgtaactcctggcagtaacttaaatttcctctaaatctaaaactatactgtttaaatgtttgtttaaaaaaaaaaaaaaaggcagcctggatgcactggctcattcctgtaatccccgcactttgggaggccgaggctggtggatcacttgaagtcaggggttcgagaccagcctggcgaacatggtgaaaccccgtctctactaaaaatacaaaaatttagccagctcttttggtgagcgcctgtggtcccagctacttgggaggctgaggtaggaggatcgcttgagcctgggtagtcgaggctgcagtgagccgagattgtgctcctgcacttcagcctgggtaatagagtgagaccctgtctgaaaaaaaaacataaaataaaataggccggatgcggtggctcatgcctgtaatcccagcactttgggaggccgaggtgggtggatcacgagatcaggagatcgagaccatcctggctaacacagtgaaactccatctctaataaaaatacaaaaaattagttgagcgtgttggcgggcgcctgtagtcccagctacttgggaggctgaggcaggagaatgccatgaaaccgggaggcggagcttggcagtgagccaagatcacgccactgctctctagcctgggcgacagagcaagactctgtctcaataaataaataaataaaataaaataaaagccttgaggattccaaaaacattgtaggagagggcagcataccacaccctaggagcctgggggcctccgtgttacaaaagtgttgattgatgctcttgataatggagctgagtcatcaagaacaggttcaactttgtcctgagaaccactaattcagggatgttctcactacattttcctggttacagccaactttttggtatttatagccccaggctttgtatgctatatcattcattcagtctttttcctgacatggtttaacctaggaggctcaatatgtagaattcatgtctgagtcagcctctccgtatcccctttatctcctggcagaatctctggttcctggctcaggcacatccatgtttttgatttttgatttttggttttggaattatcttttgacttaagaagtcacaaaaataatacagagttctccagtacccttcactcaccttcccttatgttaatgccttacataccgtagaacaattctagaaaccaggaaattggcatttatacaatactgttaaccaatctagaaaccttatgcaagttttgccagttttcctactaatgtcctttttctagtccaggatccaattcagaatcccacatagtacttagtctcctccaagccatgatgatagttcctcattctttttttgttttttattttttttagagacggagtcttgctgtgtcatcactctggagtgcagtggggcgatttcggcacactgcaagctccgcctcccgggttcacaccattctgctgcctcagcttcctgagtagctgggactgcaggcgcccaccaccatgcccagctaatttttgtatttttagtatagacggggtttcaccgtgttagccaggatggtctcgatctcgtgaccttgtgatccgcccgcctcagcctcccaaagggctgggattacaggcgtgagccaccgcgcctggcctcagtttttgtctttcataacatcaacactttggaagcatactggccagttactttgtaccttgtctatccatttgggttttctggtattttctcatgattagattggggttatgcatttttggcaagagtaccacataagttatgtgttcttccaagttcgtcatatcaagatgcacgtgatgctgatatgttttattactggtggtgataactgtgatctgttagtaaggatgatgtctgccactccattatagaattattgttttctcttttgtaataaatatcttgtggagagatactttgagactatgcagatatcctgtttctcatacttttgctcactacttttagtgtttatcagtgtcttgtgcctgcaacagttattgctgtaatgtttgcctaacagtgatttttgtctttccatcatttcctctacatatattatttggaattctgctttaagaaagagctgtcaaggtgcattcatttttagtaataatgataaccacaataatgttgattataattataatggtacccaacattgttattatgacttgctttgtgcctggcacagtgctgagttcttggtttcacttttataacaccttcttaattagctcatctgtctgcaagagttgtatttcctggagcaccctctccagcctttcctttccctttgttcctgtaactttcatttgcccctctgtcatcatccccctgccctctgtattaacaactctgggttctctcactccatactagactttggtctcttatctctgtatctccggttccatgtataatgtccatcacatcataagtgctcagaaactgttattgaatgaaataatttgttttgagcctgtgtaaccccagttcatcctacctgagcatgctacattgttccgtttcacattctgataattgttctttagtggtcaagccatatgtttgccccatatgaagctcacaatgataaaatgctggatatttcacagtgctgctgctgttaagccaggtgtcctgaacgccctcgctccatgtttgagtttttaaattatgtacaaggctttaggctgatccctgttaaatatcatcttgtttgttttagcctgccttttcaacctatggagatctttttgatacctgattctgttccccagcccatttgctatccttttcagcattgtgtgatttaaaatttttcatcttccaaatgattgataacagtgtgggataaggtaggaccaagttccccgcttggcattatttagcactctaggtgcagtcatttgacctgtaaggaatctacagaaccgtcactagattgatatttcctttttttttttcttttgagacagtctcgctctgtcgcccaggctggagtgcagtggcaccatttcagctcactgcaagctccgcctcctgggttcacgccattttcctgcctcagcctcctgagtagctggggctataggcgcccgccaacacgcccagctaatttttttgtattttttagtagagacggagtttcactgtgttagccaggatggtctcgatcttctgacctcatgatccacccacctcggccttccaaagtgctgggattacaggcgtgagccactgtgcctggccgtagattgatatttctgtcaaattcacaaggttattatatgtaactttgttaaaactttcttgaaatcaagtaaaattcaatcagacaaagtttatttgaaattacatgtcctcagctttcagttgacatgtggttaatttgttcattcattcatttatttatttattaaacagataatctataaacatctatatgacaggtactgtcctaggtgctgagaatagagtgtgaacaaaatagacaggatctcagcttgtggatccataagcaaccaaaaacataaacaagataatataaaatagctgtaaaagctatgaagaaatgaaatgagatggggactaatcaggaaaggcctcaatgaagaggtgccagctgagctagggcaggagtgttgagaagaagggaacaatgagaagatctggggaatgaacagtcctgcagagggatgagcacgtgcagaggtcctgagatacaggtgagcttggcatattcaaagaactgaagggcagccagtgggcgaaaacatggttatagctttcagttacttgaaaaatattcgttatcacttttttcctagaaagcatctaacttcatgcttaaaatttgactttatttgctcatttaactaggaaaaaaaaggtagaccagaattgcaagggaattagcatatttccccaggaacaaagtattctgaaaacaaaacaacagaaaatactggaaattatgcattttcaagattgataagaatgctcttgttttcccaagcatacattttttccctgaagtagatacagtggaacccatctatattgtaatgggacatacgttattgttctgaatgctttaatatctagtattttagaatgtcttttatactggatagtagtgtaaaatgccttgagacatgcagttggtttttagacttaagacctcttgatgattgcagacttactcttttttcagtagagcatagtggaaactaaagagttttttagatgaatatctggagtaatttaattaccattttaattgttctgtatttgcagataattggtgatgtgagtttttgactgacttgagattaaaatgtgctaaacccttacctgataactctcattagagcaatatatgctggaagcagagggctcttgttatggactaagtgtttatgtcccccacaaagtgttgaaatcctaaccccagtgtaatggtattaggaggtagggcctttggaaagtaattagggcatgagggctctgccctcatggatgggattcatgctgttataaaagggaccccagagagttctcctgcccttttctcaccatgtgaggatagacagggaagtcagctgtctgcaatctggaagaaggccctcaccaaactcggctgtgttggtaccctgatcttagatttccagattccagaactgtgaggaataaatgtttgtcatttaaggcacccagcctgtgtaatctgtaatagcagttcagactaagacagccccatattactcactctccatctgagagtgagccgagcacatagcattcttggcatcagtagcacaagggtatgaagggaaatgcttgaagataactggaatgtatagtagaaatgtgattcctgtttatctctgagtgttaactttcagaacataggaaattgagatgctcccttaaacattcttttagatagcaatttagggaggcaagctgaacttaaatcttttaggaaattggacagagtcatagcccattgggtttagaggtagtataagaaaggttgctgacattatttggctaaagtgaatggagaacagagtaaaccaagaagatagtgttcatgtacatcatcagcacaatactgagtaagctgaaatatagaaaaataatgtatgcttactattattggaatgtgagtgacataagtaaatttcataaagggaatataagtcaccactcaaatagttgtttctttcctttccttaagatacaagtgttccatatcttacgggtgagtacaatattggctgatgtgatacggaaaattctgtcaagttcggagacagccatagtgttgaaagttctgagtgctttcaacactatcaaatagtgctcatattctttcattgtcagattccatgacccaagtgtgtctgtaggtgaaggtctcccacccccaccccacccactgatcactcagtaagcaagcaggctgatgtctcagtgcctacagtgagcagtgttaactgactcctgtacttgcttgtctgaggacagacaggtgtgctagataattaacattttttggaaacaaaattattacattatcctaaaaataaatcaacatactgggaacacatgcaggacttttgtattactacgcaagaaaagataagcctactatattcatataatatattatgaagtctgttagatgaccttaaatttgttcatttttcttatttgacaagagttttaaatccctatgtatttacagatttggcagacttggtatgttttcttcaagctatcataaacaagcaaatggctcagaaaaattcccagctaggtaattttatctcaaatatctgcttaatttcaaaggcaacttgagttagccctgtgcaaactcaaaacactgtgtgtaaatatatgtgtaataattttttttctacgtaccacatgtatcttctaagtagcataatgttgcttttaaagatgtactgtttgtttttttacttttaattttctatgtgaacaaatttgacatgtacttttaaaaattaaaatatcttcaagtttctattcatatataatatttcattttaggcaacaattgaacttctgaaaagttgatgagacgttgaacttctgtaagctaaattatttttagatgtcttgaaagaactctaagaagatgaataatcataccaatttttttcatgattttagtaatctctttatcatgtttcttaaagcagtttacatctatgtataatttgtgaggcccaggatagaatgtctctgagtctgatactccagagtagcatactcagctctacagggaaaacttttccataggaaacatcagaaaaggaaaggtatgacagcacatgtttattaaacatattacataatatatgtctcctcctgacaggcaagcgttagaacctttattagacattgtcatcttaatataatgtaatgtccacaaatacattctctaatagacaagaaatgatacatgagttttaggtttccagactaacaacccaaaatctatggcttaagtggctttgtataaatacatggccaataacggcatattgccgggacttggagcagaggtaagagtgtggggagaggatcagccttgaagactcccttgtgggtgagtgggagggtagaggggtggatgaaggtggtaaaggatagatgggaagaggccaggaggtggggaagggaggggtcgtaaactttggttctggaggagcccttagagatcgtgtcgtctgacatcatcattgcacagaaggggaagcaagataaaaatgtttatgtgcctggctcgtggtcacgtagctagtggccaagcaggacctagaatgcagatttctgactcccagcacactttacacactgggagtttgctaagagtagctgagaaatacacacagtggcttggcagggagagagaggctgtgaagacttaacacaggtgaggggtgttcaggccgagggtagggcaagctcctgtgtgaagatcagggtttaccacccctggaggacaaaggtagtgagaacccagcacagaggtcaggactgtagtcaaatagattagcattcaggacagagtccagtctaagagcgggaaatcgccatatcacactagtgatgataataattactctttctttctccctttctgtctttctccctttctctctctctgtctcctctcttttcttgtgaatcatagttgttaataaacaagctaaatctatatagtgcgaaataaacatattcacatattctcaaaaaaaattactacttgttggatgcctattgtgcattagacattaggctagacactttattgcagcataatcatttaattgtcataataatccctttggaaaggtgtggtggttcagtttttgcagatgggggtgctgattgatattcagagagttaaataatttacttgaagtcagcagagtgtattagaaactattcattactttgggaccagaggggcagaaggaaatccaaaggaagagaagtatgcagatgtgttcagatacacactttgatgataactattgatgtatgtacatctctcttggctatgctataggaataccttaagtaattcagtggcaatataccttcttgctagtattttaatagtatagatcggttaatgaattatcttagaaacattatacttggtgtattctgttgctttatggtttcattttaggttgagtattaagggaacacagtattttaatcgggactctgccagtgcttttatctacaggcctgttgccatttttgtcttctgtgaaatttttgtcacaagaaaggcgagattatgttttttcctagcagattgagttggtgtagtatattcttggttatcaaaatacttacatagatttgagattttgaattggtaaatattcatgtggtgtttaaaagcatgatacatattgcacaatcttaatcccattaaattggatgctgtgtctatacacacgcaggacctaggaggacacgtcaaactgtaaactgcttgtgattgtggataactttgttctttgcttcttgtgtttttcagtttcctatcaggcatatattaactttttttaaaaaaggttatttttaataacctgaaaaaaaaactgatttgctgaaggtcaatagtttgctctgagagaggacaccatgatttgaactggtctgccttagccaaatctcatttgatttctgcagtgctatgttgccctcccagaatcacagataaaagtggtgggcagccgaggtgcagtggaggtagaggctgggacaaggtgcatcccggtgagtgcctggtacagggaaggagcagcatggtcatggtgtgataattggaggccacctctcctagcacagcagataacagaaggaattcccacctaaccgccatactcgctcctaagcagctgaataaagatgtctctgatatgtggctgaacctctgtatgtggtttagtgctcacaggcagccgatactgagaggaaaaaccttgggttcctaaaacttttaaaacattgaatacgagccagtaagcagtcattggtatactgcagttattgtaccagagttaactgatgctgtagaagtgaggccaccacatttatcaaatctaaaagcaattcatgggaggatggtgaaaaatggaaaaccgcaacctgatgaggaatcgtgaaatatctacgtgtggatgtttagccttgtactccacctctatggggaagggaaggaaagcgttattcattgagcatctcacaatgttccagatattagatgcttgccaatcctcgcaaattctacgaaggaaatactctcacttcctgtggatcaggacattgaagctcagaaagagctcatttgctgtggatcacatagctagtaaatggattcacacccagatatgcctgaattcagagtcaagtggaagaggaattagacttaaatctgagtggccccagcagcaaggctaggatcagtgagtgtaaaggagagatcggttaatttcatagactgatccaaaagaactttcttgtaataagtgctgttcccgaaatcaagcaaagtaccttaaacacagatacacatacacaaacagctttactaagatttaatttacatactgtaatattcacctgttctaagcatacaactacaaagtaccttttaaggtagtacatttcctgtcattagaaatgtttgtgcagaaagggctggaaaatctcccagatagagtagaggaatgttgtgtttccatctctatgaaagccagtgttgagtaactcaaaagcagtgtccatactgtgatgtgctgagtggctgtttacttaagtgttttaaatgtcgctggatgtaaaggaaaggaaagttccaaaaggtgttccagttgggcttttcatcttaaatttagatcaacgagatgagctcttcagcttcggaaacacccaggcctttcattctggctgcatactacagttgcagaggaacttttcaacaattcaggtgtagattcaagggcctaccctaggtccactaagttggtacctccgggggtgtggcctagcattacattagtttctgaggccaccccgcattattctagggtgcagctgtgctgaaaaccactttctttggctgaggagaggctcaagtgtgccagagggtcatggagggtcaaagttacaaaccaatcccattctgccggtgacctgtcttttctgcatggtcaaatcagccacatccaagttacttctagttcgccagccattgctgctgtgccatgtctggctctttgaagatgtctgacagtgttggcagttaaccagagacagttttgtgacttaataaccagatcaactttgtatgtaattcatgtccaccagacatttttgcagagctttaggatggagaggaccttgaggaaagaattaatgtaaactgcatcaccttagctgatcatcattcctgcttttagaacaatttgaacaattacactcacatttgaaaattttgtgcatctgttcttcagttgtgcaggtcacaatgtataggcccacatcaaaggatcaatgctttcagatttgtcttctatgtggaacttgtatggttaaatgattataatgtagtaaagtgaaaatctagtctgggagctagagggtgtcagaactgatggtcctggggatcctttgaaacctttctgagcttgtttctttgtctgtaaaatgtgaccaacaattcctgccttgcagtatcactctaaggattcagctaaagaatatgtgtgataaagtcttacaactatgtatttattgcaccccttccatgtgctgggtagtatactagtccctggggaaacaaacgtgaatgaattatgatccctgccctggagaatcttacagctttagtgaaggagatagactcaaaaccagataattgtacgagagtgtagaggggcagaaatgcacaggatactctgggagcatcaagggaggattaaaaggactgggttattggtgtagagatttccaggaaggcttaccataggcactgatggcaggcaaagacaggtaattaacaaggtaaattggagaaaactggatactttaggcagaggaaatgcaatgggcaaaagcctgtggatgagaacctggtagagggacgatgtgttacaaatgctgatggtgttttattcaattcttgctttcccctgggagaaatgacttttgggtacagtgcatcaaggaagattcagaaggtaaaggtggtgagagatgtaggttaaaaagtcatcgtctgttttcttagtttgcctgatttcttagtttgcctgatttcttagtttgcctgctacacaaagtgaagcagaatgcagttgagtgatttatgtccatcataaaaaaaaaaactgactaaaaataaatcttagttcaggccagatgtagtacatgtttaccacttgaggtgaacatcgaagcatagtggcacttactggaagtatctctcagagaaaggaggctgattttataaagaaagtctttggagctcaggaagtctgaaagctaagagttggtccacagagcactgaagataagcttgttgagcctcacagtaatttttgtctgtcccaatttttaggcagcaaaaccacagcagcatctcatcaagactattgttaatgcaggtgtctccattggtttatgtgtcttatccttaccctgtttccttcacaactgtaccatcttaggaatcaggaatcacaaagccaggtatccaatggtgatttcagttctttgccatggcgactggaggccagaggggtcagggaatgtcaggggtgcataattcttgtgctgtaggctttcctgccatacgttatcaagtgtactctacagcatcctgataacagcctctgccctgggaaacagactgtgaccatgcatttctagtccagcatatcctatcagaagaccaaatggcttcatcaaaaacagagtgacaacctcttctctttgcctcttctgctgactctgttaacaggcagcattggggcaggagagcctgcaggcctttcacggctgcttgagttctcacctgtttgtctgagctctgattcctctgccctgtaagcgtaaaggagatgtgctgagtggaaagacctctaaacaggcagccaggaagccagatttcaggtccatctctgcctctaactggcagctttgccttgggtaaatcatcagtgggcaatagtttctctcctgtaaaaggaaaagattgggtttagattgtttctgaagttctctctagatttaacctggaaggagttgaaattgctaaccttactcttaactgcaccattgcccagtccccagctgtcctcacctctgccccaccctttcattgccactgtctccttcatacttccctttccacctgacctgtccctgccaactccattctttcatgcctgcctctctgtatctggagggaatcctttggtgcccaagcagggttagattaccagatacgcagactaaacatgtgtttggggcaccagaaaagcagacaccgtgctcaaatattttttttaaaaaataatttgatatttgctgcttaaagaaataaagccgtgatcatgagaaaaagcagaccttagctggactttcttatacttattttatggtttattatttaaatttgatttctgtttggaggaacgctataatctttgcagtacgtcgtgcctctgaaggcttcgtcttcttcctcctcctaaacttgttgaactcagcctttccaccgaagcctcacagaggtagggagatgctgctttgctctacccttttctctgtactggcctcatgtgtgctgcttttagtatagtaacacatttctctatagcactttctaggtgagcatctccatgctgggggctaggccctggggcagaagtaggccagggagagaggcacaaggtgtgagacacactcttcctcctccagagtttataattgaaacatatgttttctccacaacaattaaatgccagaaatggccatacctatttgaaggcgtgcagaccagtctctggaagatgctcctgcagcagggaccttgaagagaagatggaggaaagtttaaccgtattaacaaagtgtgcatatctgaatagcctgctactttatttctaagccctaaatcccatgattgtggactgttggctgtttcccattttcagagctgccccaaaccagtttctcccagactcaggcattctctctgtgtcttcatatctcttctgaactgacttttgtcctttgagcctgccctctctgataagctgccgtagccactgagaagaatgaccaagttgagtccctgagcccacagaataataaaaggatgttttctttttctttttttctttttttttttttgagactgagtctcgctctgtcgccctggctggagtgcggtgacaccatcttggctcactgcaagctccgcctcctaggtccacgccattctcctgcctcagcctcccgagtagctgggactacagggcccggctaattttttgtatttttagtagagatgggttttcaccatgtttagccaggatggtcttgatctcctgacctcgtgatccacccgcctcagcctcccaaagtgctgggattacaggcgtgagccaccgtgcccagccaataaaaggatgttttctaatgggttcagtctggttgcctagggggaacatttggcttttgcatagactgtaataatccccatttctttattttcatagtctggttaatcccatgtcattgcctttgaagttaaataaattgattgcttaatgtgcacggggcactgtgctaagtgtggacatgtatgggctcactaaatccccaccacaacctctgaggtgagtgctgttgtttcccacttattgagaaagagggaaacagagatgttaggtaacacacctgacatcacacagctaataaatggcagagccaggattcttcgctctggcagtgtgactcctgtgtctcttctcttcatcattgcactgtatgttctctgagggtagagttgtgggtgtgctggagacagcatggggaaagtagtagcactctccatttgagttgttggactgattttgagtttctttctttcacagtgaaagttgtttgaattgttaatgagaggaaattttagaaaatgcttcacctttaatatattaggttatatctcttctctgtaacggcatcttttcaattctcttcatcactttttttgtttacctagtatgtgatcaaaattaaagttgtctgctgtggctgccttttcaatgaggtacacagtatcacattgccacatgtaatttccactcaggtgacactgttctcactgctgagagaaatggcaggattagcagaaagggtggtattagatattttatctcccttaatctacaagcaaacatggttacacatattggaatatgtcttttcaggattctggtggactcggttggtttattttaaggatgagagtttcctccagaaggttaagcattattacatctgctgctttaccacacctacttttggggtgtttgctgatgttcataactagcaataactgtgattcataaaaaggaatctcttatttttatgaacatttcaatctggtgtcttgagttgagcccagaaactttatagctggctctgagtttatttctcccaaaacataaatgtatttttgagatcctcttaatacctctggtatctgatattcacacatcattttatttaatgattctagaggcttggaaggctgctaaaagtcattgttttcgcctttgagaataattaccatcctggaatccccagtttagcctgagaccacctaacttccccctactcaggattcaagccagttctgtccaaggacaaaccagagagggcctaaagaattaaagtgggtggggcaggatgaaaacactaatagtagagagagctttctgagctatctggaaggatcgtcctcaccctctcccaatacttctgtcaaagttaaaaacatttcccccttagtttggctccttcgggaatccccaggcccagttgcagttttcattgcagctgtaagtgaccatctgaccactggtgaattcaagaaagttggaccttcaggctctttttggagttaatggagcatcctgtagtttaacagatgtgaaactgtttttagagatatcagctgcctgctggtctggttcctgggctgtgccttttcggttcagcccaggggaaagggaggaaggaaataaaatgaaatgagttcattcacttttcttccttaaaaggactgcaggaatacaggaggacaggggcatctgaactcagtgaattaacttgttcttctgtctgctccaggttatttcctttggttcttgctgacatgctttacctggagctctattggccactcctgcactgcacaggtattaggaccagactctgtaaggctgcagggagggatgtaaacaccttagcatccagagtcatgacttagtagaaaacacgtcagttttattatgagacctaagtttgagtcccagtgccactactattaattagctgggtaatattgggcaatcttggagttgaactttttgaacagttttttccctaacttgaagttggtaataacatttactttacaggattgttgaatggttgtgaggatgaattaaaatgttgaccgcgttaaagtcattttgtaagccatccagtatccttgctgttatagttctatgcacagctgattttttagttgcaggcaaacgaatttttacatggaagtacttgattttggaggttttaaataacccttttataaaggattgatagtttaaaatagttggttgtaaaaatgaaaaggaacttggaaagaaatgtcatgctgcccttcagatttatttcagcacacataaaagaagcctcttaagagttaagttttcacctgtgtcatttggcttagaaaatagtttgaagaaacttttcaaggggctaatgctctacaagggtcaaaaacctatttccatgtgctaagacatcaataatatttttaatagggctgtttctcttttgaatatatgttaattgtttccctctaagaattcacacagaaattggatatcatattttggactgcctcccaagacttttatgggatggaatatggtcaaatactcattcatgaacaaataaaaccaaacagatttgtttccctctcaccacatttttgcacatatatctttaataaatattcactgaaagctgtgagctatacaaagcaaggaaaactacccactattgaagtttgagggagccaagtgaataacccctctttccacaccagttagaaagataaaggagtcaggctggtagattgcaaaatatcatctttattactgatgatgcactttggagaatatggctttgggtctgcagccaagtaggcctccagaaattttatccctgaattagataaaactacccaccttttcttggcatgccagaataatggaagctggtaccctgcaggggaaagctgctttcccccagcaggagaggagtccagaattcgtgacctttgcagacaggcaaatctcaaagaggacgaagaggaggaattagtgagggggcagcaaggaaggcccggtgtattgtaaggaattctctcttggcgatgtaacatgaagagagtgagtaagtgtcctcttacctcaacacctgcagtagggtcttcaaaggtagctgagacctgacccctgcttaccagggacattgaatggggaaggaagagaagacctctctacaattgtatttgaacagttgtccttcttcgcagctttagctaaggctgtaaatgcaagtgggagcacatttttatggggcagccgcattgttccctggtgttttaactgccccccaactgctgtttacttctcacatctgaatcttctttcaagcatcacttttaggcttaaaaaaatccctatttgactaaagaaaatgagcggaacaattcctctttataaaatgctaaacagaacaagacatctggtactgtacacactgtagcccaaaggtgaattttaccctcaatataagcagagtatgctgtatgtcaacagtcagctcaaacagaagctcgagcatcgctgtagagccgctatcatcactgaagggaattcatcattatccctgttagtaatttcatagctttggaaactggtttatagtacttaactgaaacaaccccaaaatcccacccctgactctgccttttctattttccccaacttctgttccctttctaaagaacaagattttgtggaatttaaagtagactgtgactggccaggttgctgcttgctcacaatgcctgtcctgtgtgttggctttctcagccaaacttttgggagccagttgtcacccaggacccaaggctggcattctttggaaaaacctgcctgtgtgttgtgccaagttgtgttagccactccatgttattcttagatgggctctggagtatgaccagcctgtgtgcatgcatttgtagtaggcactggataagaactggagtaatgactacagaagtgaacggtcacagctctaacctgctgagtcatctcagctcagccttgctagcaaggcctcccaggctgcatatagtttgcttttcctgttcgttgcattccaacctgtcaacggctattttctgaaggtctgtgggggctcatgtagaaaaggaataggtctgggtggaggccaagaatctgaatttgtatcatgtaccctagctcatcttaattcaagtgttagtctgtaagaaacagaagaatgggtaactcaactcctccaaacaaatctgtcagcatttactcatgcaggaaggctattttcatgtatcacgttcagaacacaaagggtcccaaagggcttcccatctatctttcaggtgttgggcttcctgtcttccactgtgtcttttttttttttttttttttttttttgatactgagtctcactcagttgcccaggctggagtgcagtggtgtgatcttggctcactgcaacctccgcctcccgggttcaggcgattctcctgcctagcctcctgagtagctgggattacaggcacagaccaccacacctggctaatttttgtatatttagtagagacggggttttgccatgttggccaggctggtcttgaactcctgacctcagatgatccacccacctaacctcacaaagtgctgggattacaagtgcgagccaccatgtccggccagtcagttgttttaaatcgtgtattgcctatgagcagatgaggaagaggaatcacactgtctattgagattactgacaacctttctaagcctcattttctcagagttttagcctcaaaagggacattgatcaatttgtagtctgatttccttcttttctcagtttacaaagaacttagaggaattatttcatgagtcccccaaaattagtcatttcctactttgtgaccccacagcattttgttcatactccatattttaagtaaacactgttttgtaattaatgtgtttatatgtcacttctttccaccatcaccaccagcccccttgcgccaactgatttcttcaagagattgaaccaggtctaatttatgtttgtctcccaccaacccagtgacagatagatgaatcatgttgcctggagaggttaagggatttgcctagagtagcagccctgaaatgtgagtggctttcataactcccagccatgtacttaccactcgtatgttgccagaaatgtttttaaatgatgtgaattcatgcaaatgagttaggacacaactttcccattatgttcctctacactagctcatttataaaacattcataatagtgatgatgatgatgatgatgatgtcattaccacccacccaactgtatcattttaaggatcaacctaaataatatttgtgaaagctttgaaactggcaaagccaccttatgcaggtatatagattgctattactctagtctgttgttatttctgtgtaatttacaaagtatttcatattcatcatctcacttctcgttacacctctgtgaaataggtggtctcattgtcatttcatagacacaagaactgaggctgagcgagactaagtatttcaaccataatcacaaatggatgaaagaagactagaacccagccagccctcttgctttcttccagtacagccactagatcaaggctgcagagtccctcaggggtgttgttatcatcatcatctgttgaatctgttgcatcttctgttgtgtgtttaggtcctcaggtccctaaagccctcctgggtgagcccaggaaagagacaacttcatgagaaatgagagtgaggcccttctaagaccagttatgtatgtgtgttgaaatgctagtcaggtttttcattttatcaaaatgcagggcttagacacagaatgctttataagacaaagcaagtttgattttgaattggccgaccattgaccatgttggaccagcagcagcagcatgtggatatgtgggtccaggcaggaggggctaacctctccatggcttctgtctcaatggggagttccttactgtgactctcagaggaaatgaaggatgataaatccagctgctgcttcctgtttctataatttggggatttatttttttaaagggtagaatgctttatttttaaaccagtggaaaataccctcaacgtgttccttgttagtatttccttgaaatctagatgcactcatttgagctttaaaggagtgggtgtgtttgcgtgtgtgtgtgtgtctgtgtgtctgtgtgtgtgtctgaaattcccatgatgctgcctgagatggctcgctctctttcagtttttcaacaacaataacaacagaatgaaaaccaattaaggcagatttcactgggcaggaagctctatgtgagattgatgacagtatctgatttagaggaggcctgtaatttatatctgtggtattactatctctctgggtatgcttgtgcaattcaggtctggtttttcttctgcttgtgattgtgtcattagtaataaagtcccgaggcatttaggaaacacactgccttctcacatatcattgtttacagacagtagctgtttggtatagatgattaggatgccatttttggagtttgattatgtagcccctgactccataactaaaaccaataggtagaaatatattttaccagtgccattttttttttcatttcctaatttaagagacagaggatgtatatggggttccaatggtacatcgttcaggagcagcataggaaatttatctggcaaaatagaattataagaatttagtagggccaggcacggtggctcacgcctgtaatcccagcactttgggaggccgaggcgggcggatcatgaggtcaggagatcgagaccatcctggctaacacggtgaaaccccgtctctactaaaaatacaaaaacttagccaagcgtggtggcgggcgcctgtagtcccagctacttaggaggctgaggcaagagaatggcatgaacccaggaggcggagcttgcagtgagccgagatcatgccactgcacttcagtctgggcaacagagcaagactccgtctcaaaaaaaaaaaaaaaaaagaattcagtaaatataccaaatcccctcactgagtaagaatcttggctctaatttaagtcccttagcccctcctttcatgttcttaaaatcatagctaaggtactattcttcttatagtgggtgatcagtacatattttgtacttacgaaccagtaggcctaagtgagttgtttattcttttaagaattatggttacactttaatgaattcagaataaaaaataaatcttcacagcctaaatttagtgaagagattataccgaatatttggtctgactttgttaacaactttttgaaggtaagatttaaaaactttgagactatgacacttactggaggactgttccagcacactggatgttgtagaagtctggaattctcatctccattctgccatttccttgtaacaagtttcttggctataaaataaagttgatattatttgtttgtctcatagtagtttgtgaggatcagattagttggaatccatggaattgtcttttaaaaagtgagattatgataaagaccttaggtaatattgttattaaatgacagttgggttgttgtttcattttttaagactttactccttgtgcccttaggcagcctttgactaccagcattttgtcaccttcactttaagggttccttctagtgattttttttaatttgtagaagcaaatttaatttaatttgagttaatctctagtttaaaataagctgagggggcaggtatgggcttcatagtgtcagtcagatctgggtttgaatcctggtccaccttgtattagctgtgtgatctcggtcgaattactcaaactttcaaaacctgttttctctcagtaaaactgaagcagtaataccactgctcaggatggataggacaatttaataggctcaagtatgtaagtgcttggttattcaggaggggtaattttcttcctgtcttcccctgcctattagcagtagcctcagtgttgaatggcaagatacagcccaagattttcctgtaaatatgccagcagtgcacagctcctcccctctctacctcatctttgtccctgtataccatggtcaaggaaatgagaagtaaactagccgctgtaggtcactgacactctccttagaaatgctaaatatttcttttcccaccttcttttcagtgtaatctgacctgagttctctgaatgcttgaccttcccagggagtttcagcgggtgagaaagcctgacactgcttggattacttgaatatatacagagctactcactcatatgtccatgcatttttggggtttttttttttttagttatatagtttgtggaattattttgcaagttacctttttccctttagacttttcaaaaaagaaccttttaaaattttatgacgggataagcaatatggtggttagcaagattaatgtttaccagtttgctgaagggaaaatcaaacaacatatgtccaaactctgtttaagaatttccatgggattctgaattccttaatctctgtagttttatgaagtcatagcaacatgccgcatacttgagttatagctccttgtcgaaatgtgtttgtataatttgactttatgttcaaaataagaaacaagtagccgtaagaaaaacatcttggtactctctcaccctgctacttccaacttttacccctctactcctttcctatcctgaaaaatacaccctcccatcatacctgcctcccccgcttgctgttgtaccagccttttgtttcatccccagctgagatttgagaggtgaatattcactttcccacatacccttgcacacgtgagccagactttttcaccgaaagtgctcaggccaaagtgtcaggtgactctcagctgccagatccagcggtcacttttgccccttaacgtgcgtgacttgcttttgacacctgcaatgctgcttaccactctcttcctgaaggggttgcctcttttggcttctaggccaacattctcttcatagttcttgtcctctgacccacccttcttcctctcctctgctgaatgcttttcttctcccagttccctaaatgctagtgatcccctggattctgccattggccttttttctctgtgtatgctctccttggattatctcatcctgcatatgtggattagtcacaaatctgtaaatcccagatctttctcttaggattcaggacaaccaactactagataccttgacttaaatttattatgccactaccagctattccaactgaaaaattgaattgagtggaaatcatgttgactatagagtagttttctccttcatctccctgcctccagtctttcctcccttcaatcttgcttctacattcctggtagaattctttttaaaacggaatggtgacctcattgcctcacttgttaaaacccttcaggggttccttactgtccctttgtaattaggatcttacaatattgaactttccctgagttgtaccctggaaaatctccccatccttcaattttccaaccctcaccccccacccccaccctttggtgttctgggaaaccacaaaggactatcttgttctccaatattctgagattagacccatctctgtccttcctgactcccagatgacttccttgtttacctgcctctatagaactccagaccctttccttttctttgagacagccctcattagtgttttattccagtagcttgaagaaaatcacctccttaattgtctggtgcattttggctctcacaagtcttaccctgttaatttgttacagttatcattctatcatgttatgtttgtttataatataatctctacattgtattatttataataaattacaatatattgttcataaattgttagtataaaatactattttatgtttatacttccactttaagtccttagtgtttataaaatacttgtatttataaacaaggatgaattataaaataagtctgtccaaatctatttctagatgcttttaagaggtgttttttagtagttggaggttttattaattatgttaccaactaaactgctgagacacccaaatagaatgacttaaataagatagatgtttatttcctccttacagaacagtccagatatgagcagccagcaactggcaggatagcactcctgtgctacacacgtgatttctaaggttgtcctgctgtccccatttctagcccgcaggaaaaaaggaaaaggaaggccaagtcaagtagccttgtcttgtagccttgtctttatgaaggttaccaggaaattagttgaactgcttcttacatcctgttggtccctcctcattaggtggccacatctggctgcaaatgaggctgggaaatgttatctctagatgggcacctttgcacctagctaaactgggtggtgatggtggcaggtgtatgttactaaataatgattttgggggcacacttagtagttatcatagaaatggaagactattttgattaaaaagtcaacttgggaggaaatgagtgattaaaaaacatctgggcctaccctataagcttcagtacttgccatatgtaagtaacaggactcaatacttctttcttttttccttctagaaaagtatgccatgcagagttaagagtatgtaaatttaaaagacagtttgtagctcttactctcaaccagtgcatttgtggtgaaaatgggtggcataggatacatgtgcatattacaaacaaatgcttgcaacatggaattctctctacacttttttgtctcattacttatattttcagattcagtacaacttgtggtatcagtttatcaccatcttcgaaatattttctgaaagatgatatattttctaagtggaagaattattcctttcctgctctcttgtattcctcactctcaaatgtcttagataatttgggtcaatttcctggctgatgtcccctggcctactagtaatggaatgaatacatgcttgccgacatgcagatcctctcaggccatggtacagggcagcctctaaccatgagcagcttcagctgtttcctgctttatgcagtacggatactgtcatgttgtacatatattctgatacggaaaagtgtgggaaatgctgttttaatggtttatgccaatttcatctctttgtactccaaattttttactagaaaataattgtaatatgtaacatcctaccatggtaaaaggtcagtccccttggtaaagaagtaaaaattatcttgctatgttatccactttggatggactgcaactgtaaaatatctaagatatgatgttgtgtccggaattggtgggttcttggtcttactgacttcaagaatgaagggctggccaactgctccgagtgcggggcccaccaagcccacgcccacccggaactccagctggcccgcaagcacagcacgcagccttggttcccgctcacgcctctgcctccacacctccctgcaagctgagggagtgggctccagccttggccagcccagaaaggggctcccacagtgcattggtgggctgaagtgctcctcaagtgccaccaaagtgggagcccaggcagaggaggtgccgagagcaagcaagggctttgaggactgccagcacacaatgtgactacagattatttgcctaaaaatatctatacttacgtttatatgtcagccatacataatggcatcagacctttctagcccatgtggcctataattagggtgacagtaacacttggttttcctggaaacgtccctggtttttgtttactattactgcttgttgctggtctcagttatcacagtttttttttttttttgcatttatacactttattgtctttttaaaaattttttacatatagtgaagatggggtcttactatgttcccaggctagtctcgaactcctgggctcaagcaatcctcccaaagtgctaggattacaggcgtgagtcactgcacggggccgtgtcattttagatattagcactgcttaccctaaataattctgggcagaatggtggtagtggtccatgctccgtcttttccaaactacttaagataagtatgggtggatctttaagctcttggagggcaaggactctatctatcttgctctactgtgtgtgtgtgtgtgtgtgtgtgtgtgtggtgtgtgtgtatgtgtgtggtgtgttcagcacctagcacattacctaagctaaacatttgaaaatgtaaatgattatgagcttgatggcttcatgacaacacagatttggtaaagtctatgatgggcaagatactttgttgccaactacaaatcctaaatacctaacagagtgtagcgtttaggaatgaatagattaatgattggtcacctcagtcttatatatttcttagcatttgcagtctctatctaaagatattgtggtccatcaacacattagacaatcctacaattacagttgtaacatgttgtatataaagtcacacaaacaagcaactgtttcttgggtataatgatccgtgtttactgttttttgattttatgaggaaaaaagatggcatttaattactccaataatgatcacatcgtagatagataaattctatcacttgtaagatttagaccttaatttgtaaccaatgtatgatattttaggctggaattcccagtggatgtgccaggaatggctactggatggctgaaatattcactcctttgggcagggctggagaccctttgcctgactgtattcgccctcttcagtttaccccagggcatatataaatgtcctttcctctgtgggccataaagtgaaacagattgggaaacactgttaatgacctctacaaccaaaatagcaggtgcttaaataaatgcagtggcacccttgacatttgagtatgcaaaataatttttcaaaaatgttatcttgggccattttttgagagttaaatagatgtgctttatcagaaagtaaatatccaagattatcaaagtcaaagaccataatcttcaaagaagcaattcatctaaaataagtaacaacatactgaattagaaagcatgttctcacatgaagttcacaaaaaagtctcacaaaaaaagagagaaagatagtatgtttgtttatattttggaccttcccaccacaggaaggtttaagcgtgtttatgaactgcaggctgctcaattgcgattcagtcctacatctctactaatgctttattgcagggggaaatgttagaaattatagcatcatgacagtggctatctactaaaattctgccagttaagataatttggggaaagggaagaaaccattaattccaagcacaccttagtttgtgaagggcttccagttaaatgtcctatcagatctgcttttctaaagatcatttgttattttcataagagctgcacaaatagatgctaagtacttagaaacagaattaaataaatcaaatgtgaataaaacatttgtttgttttatcaaatcctttgaaatagaacaaaagttatatttagccaaatttaccaatttatcactaaatcgaaaataaggacttgtttgtattacttcgaaaggccaaccctttaggggaatttttatttagctctaaaatgttttttaatgtcaataatgaattccactgcaatagcgattatattgccaaaggtcattaatgatttttaagtcttcattacgctttaatgagattgagattaagatctctgtaatatttgactgatgtatagtttaactctgtgtctcctcatcttttgattttcttgcttttctgttctctcttttcttcgttgattttttttttcttctcaaagccttcatgatctttatttttcccctgtcaccactacatttcaaatcctgggttttcctcaggggccgccaccttccccaaatttttctggacatttaaatccaattttgtggaattttcagggtaggaacattcaatgagcgggcctaccatgtgttcaacattagactgggtggtgtatgtaccttgtcacagtggggttttatttccatttcattgataaggaaaatgaaggcccaagtttacacagtgatgtgaaacattatctgtgttcctattgtacaggtaaaaggtggaaataggggtgaaaactcaagcaagctaactacttaagccacattcttatccagtatactaccaacttaagaactgaatttctagtttaaattagctctataatagagactctaggctatttgtgtttaaattattccatctgttagatatctttatacaggtgcaaactatttgccctaattagcccattaatctatccattttattcaataccttttctaccactcacaacctagttttaactacctacatatatcctttgcctggagtcatgcaatagctgctttcctgatcttatatcttccctcactaatctgtatgctaagcccagagtaatctttaaaagggacaaatttaattttcatcaacctccaatctgcagctgaaaacacaccagtgacttaaaactgcccttagtttgatgacatcaaactatgcttctaagcatcatctcacactgcatgttcctgtgactcttcaagctttgggcactagccttctttcagttctctggtcattctttgttcccctctctccacagggcctttgcacattctgggccaccatactcctatactctttcttcacacctcccttccatcacgatttcctcagaaaattcctccctgatcttgccagctggaggaaacaccccattatgcactttcatagtaccatgcaagcaggggaaggtccaagcttcctgggatctgaaatttttgtaatttgaggggctgtctttaagaaaaataaaattagagatacaaatatgagtatagggccttggaagcggtcagtgcgaggatagggtcctgacccttaacctttcactgcatggcaaatctacctcagcctgtacctcttgttggtagctcttcacattgacaattcaatttatatacacaactcggtgaatatttctttcccctacactatgcactgtgtgagagaggaaatatgtctgaatttactccccaagctttctccaggaatttgcatagtgttaacacttgagtatacagtatatatttcttgggtaaaggaataaatgagcaaatgaataattagaagaagacttagagttaatgcttataatgcccgtataaaattgtccgaattttttggaacccaaagccaagtggagaacatctgggttccatggctcataccatttcatcatgaaagacaaacttctcagtaccaggtggtaaagatgaatgttgataggtttatttatataaagcaccttattccacacaatgaataataaccagcagctgttactcagtgcttaccatgtgctgggcacttgctcaacacttgcacatggtattctgccttaacacatatggcattcaccactaactgcagagttactctcagtcagaatttctgcctccatggtccatgcaatgcagaagggcagaaaaccccatgcaggacaaggaaaaggaggcctgaggtgctggcaccttcactgtctcaagggtcctccctctctggagctccttcctctctgccattttatatcaccttttatgtgctaaaatggtgtttgtttgccactgccccagagatgatactggcttatcacctgccctctgcttagttcttggtattatctcctagtgagggtatgcccaagcttacctttgtctttgttttcctgtagagtgcttaattatgagtcaaactacatgcaggtggtctatccgaatgagttagcatcagaatgacctgttaaaaagagttctaatatgttgcccagctggacattgaaaaatgcctgttagagttgttgatcattttgactttggtataattaatagtgaccttttctcactgccagtatttggttcaggttgggtgccttctgagcacccttctggaatgctgtacagttgtgagtgattcattctgttaacaaatctttattaagtgcctaatctgtgctgtgccctgaggatacgcagataaaagaaactgtcctcccattaggtggaggcattgaaacccaagtggaggaagacagggagacagaactgacagttctgcaagtatcatgagcagccattgtctgactttgcattcatttctggtcttactggctagaatctcctaataaactaccaagtaatccttttaactgaataagctacctatccaaggattagaatttgtatctgagtgtttttctctcatactaactttgagaactttttgagggttagtgaggtaagcaccagagcaagatactcaggttcttttccagcaatctgtaccaaaccaggaataaggactgacaggctcccagctgtctgtcaccagagcagatatttatgggtttatgatcagaggttcttttggtcccaaaaagtaactggaaaagaatgtggcaacttcctgggaccatggaaagctgcttgggtgtcagggatatgctatgccaggtatatgctagaagaaatactattaaatgtcagtaaacttaaaaggaaaatggtcaagtttaatctaagatgtccattttgcagatggaaagaagcagggaatttaaaaatgcaagcaaagctcccattacaaatcctactaactgtctcataaactggatgaagttaggcgataaagttgaaccaaattcttcactcagtttgggatgactttctctggagcctttattaaggtctcttagctgccagactgttttagggactaatgaaactattgtcattatcccttgctctttttatgtttcctctaagttgctttctcagtaaggacagcttttaattttttaaaaaattatttccctttttaatccccagaaccctatagcaaaaactccataattatttgttaaagtttctagtagagggtacactaagtggggtctatagatactgaagctcttgtgaaattctgctggcctgagttcatgatttaagggaatgctggtgatagcttgtagaagaaactgagattgtatggaataaaatgtggaagccattgattttagagcctcttttttattgttctgtgaataaaatctcatttgtaagccctcaaatgtgggccttgacttttagaattgagagctagaagtaaaaacaaattcacagcagtgtactaacacatttttgttaattcctaagatattttgctttagacctattaacatatttagagttatgttccttagttctgaggcaaatttgctctgtgaatagcactacactaggaagaaatcctaaaagagacattaacatgtaatttgtgtaaagttctttttatatttcacaagttatgaattttctatagtccttttaagtgttaaatggatttataaaaagcttttggtggttagcaaaatgggtggtttttgcctaatgtgaaatctgagattgataagttttatataaggagtgtttttttaaatcttgagattttttatgtaaaaaaattgtttcagttatttttgatatctaaaccaaaatagcattagaaaggagctattttaaaagtttaatttcttatcataatcttttaagagggagtgacaccagtgacttacgtttcgtttctatatagaattatatcagctatagagtatattgtatacttgtaatacccataactattaacacttaaataatacagtaatacagaggcctattgggaaaaaaaaaaaaaaaaaaactaaatcattcctttttcccctattgcttctgaagcattttttattttctttaactgtataaatttttgataactgatttgggtgtgctgtgtgagtatctgtgtgtacatacacatatgtgcttacgtgtctgttgagtgttagggaaggcttgttgtagagatggtgtagctcattataaactttagtttgttctcatttgatttatttcaatgaaagatttgagaatttgatcctcgtaagtctcttgcatgttctccatttgcccaggttgaccaagagggctaacttttttccctgcagaaagaaagtgaaagttgatatttgattgggtagttaattcatgcctacatgaaaaattacaggccagatgtggtggctcatgcctgtaatcccaacactttgggaggccaaggcggatgaatcacttgagtccaggagttcaagaccagcctaggcaacatggtgaaaccctgtccctacaaaaaatacaaaaaattagctgggctactcgggaggctgaggtaggagaatcacctgagcccaggaggtcaaggctgcagtgagccaagatcacgccactgcactctagcctggacaactggagtgagaccctatttcaaaaaaaacaacaaaaaagaaaaactaagtataattgagtgttatattgattacattaatcaagccatttgcttctttatacattaaattcttatttaaataatatttcaaagccatttggcttccttcttttaataggggtactaagacctcctagtgcagataaacttttaaaggttttttttgtttgtttgttttgttttgttttgttttgttttttgagagagagagagtcttgctctgttgcccaggttggagtgcaatggcacaatctcagctcactacaacctccgcctcccaacttcaagcaattcttcttcctcagcctcctgagcagctgggattccaggcatctgccaccaagcccggctaatttttaaatttttagtagagtcatggtttcacatgttggtcaggctggtcttgaactcctgacctcaggtgatctgtcctcctcagcctcccaaagtgctgggattacaagcgtgagccactgcacccggccaacttttaaagttttaatttaggtgattatatttttctgttttaatgctagggtttcttttattgcttataacaatctcatgaatatatgttttctagcagtcaccaagctacccacatttaccctggctaacaaatgggaacaaagagcaagatttgaatccaggtctcttgggcatcggagttgtgctctttctagtatcatttgccacctcttcatataattttttttttgggggagatggagttttgctcttgttacccaggccagggtgcagtggggcgatcttggctcgctgaaacctccgcctctcaggttcaagctatgctcgtgcttcagcctcccaagtagctgggattacaggtgctcgccaccacacctggctaattttttgtatttttactagagaccgggtttcatcatgttggccaggctggtctcgagctcctgacctcaggtgatccacctgccttggcctcccaaagtgctgggattacagacatgagccactgcgtctggccaataattttgacttaaatacatctaaaagaataaataaaattaaatgccacatatttatcattagtcatttattccaggattactctatgtgcgtggtgctacatgctagttcaaaattcaacgaattggtctagtcatcttcagtaaagactaagacagacttttctcctcaatgattctttttttcttttttaaattcagattcagcaaacatctttgggggcttactttgtgccagaccctaaaccaggtgttcctaatacgttacactgtgaggtggtttttattattaagattttaccaatgaggcatgaatgttagagaggtaataatataagcaatcatttaaaaacatacttgaacttagaatgtagtatagcatgaatagttacaataggctacaatcatatctaccttcactatcctatttctgttgaaaggcagtttaggcagtaaaataaacaaaggttgagatctggtttctttattttaacagctttatggagataaaatttacataccatacaatttactcatttgaagtatataattcagtgttttttagtgtaatcacagaattgtccaacaaccatgtcttctgatttttgaactgttactgattttttttcattactactaaccatacatttgaataagaaaacaggatcataattctaaaagggttatattcaaccctgttgttttcagatttagttttgttcaaccaaagtccaataactttcccttttcagttctactacaaaaagcttccttgacttccatgagaaatgtttgcttacaggaatgttaagctgattttcatgtgtgccattgacaaggagaagctttggaatgtgaaatccacttccgcataatgtaattatttaagtcttttgcaatagatgtactataaaagagaaatcaaagaatatatgcgattaatacttactaaatatatgtttttcaagttaaaaaacaaaaatcccttgataaccatttatagccattctgagtcctgattcactaaggagatcaaacctcaagatatggataggatgcagagaaaccaggtgctgatcccttctctcattggcttaagttcacattagaaagaatcgtattgttatgatggccatacttcccaaagcaatatgtagatacagtgctattcctatcaaactaccagtgtcatttttcacagaattagaaaaaaacgattctaaaattcatatggaacccaaaaaaagccaaatcaccaaagcaatcctaaacacaaagaataaagctggagatatcacattatgtgacttcaaactatactacaagactacagtaaccaaaacagcatggtactgatacaaaagcagacacacagaccactggaacaggacagagtccacaaaattacacacatacaaccacctgatctttgtgacaaagtcgacagtaacaaacaatggggaatggactccctattcaataaatggtgctggaataactggctagccttatgcagaagattgaaactggaccccgtcctttcaccatatacaaaaactaactcacgatggattaaaggacttaaaggtaagacctaaaacaataaaaactctgaagaaaacctaaaaaatactattctggatgttggccttggcaaagaatttatgactaagtccccaaaggcaattgcaacaaaaacaaaaattgacaagtgggacctaattaaactaaagagcttctgcacagcaaattaaactgtcaacagtaaacagacagcatacagaatgggagaaaatatttgcaaactatgcatctgacaaaggtctaatatctagaatctataaggaacttaaatcagcaagcaaaaaacaatcccattaagaaatgggcaaaggacatgaacaaacacttctcaaaagaagacatacatgcagccaacaaatatatgaaaaaatgctcagcatcactaatcattagagaaatgcaaatcaaaaagtcagtgagataccctctcacaccagaatggctattattaaaaagtcaaaaaacaccagatgctggcaaggttgcagagaaaagaaaacacttacgcactgctggtggggatgtaaattagttcagccactgtggaaagcagtgtgtagacttctcaaaaaagttaaaacagaactataattcaacccagcaatctctattgtgtatatacccaaaggaaaacaaatcattctacaaaaaagatgtgtacttgtatgttcattgcagcactattcacaatagcaaagacatgtaatcaaccaagatgcccgttgacagtggactggattttttttttaatatggtacatatacaccatggaatactatgcaaccatagaaaagaatatatcatgttttttgcagcaacatggatgcagctgcaggccattatcctaggcatagtaatacagaaacataaaaccaaataccacatgttctcacttataagtgggagctaaacactgaatacacatggatacaaagaagggaacaatagacacaggggcctgcttaataggggagagaaaggaggggagttgggttggaaggctccctattaggtactatactcattaccttgattgggggtccccaacccctgggccacggactgctgctgattcatggcctgttaggaaccgggtcgcacagcaccaggtgagcagtgggagagtgagcaaagcttcatctgtatttacagccactccccattgttgacattactgccttagctctgcctcttgtcagatcagcagcagcattagattctcgtaggagtgtgaaccctattgtgaactgtgaattcaagggatctaggttctgctatccttgtgagaatctaatgtccgatgatttgtcactgtcttccatcactcccagatgggaccgtctagttgcaggaaaagctcagggatcgcgctgattccacattatggtgagttgtataattatttcattatatattacagtgtaataataacagaaataaagtgcataacaaatgtgatgcacttgagttagcccgaaaccatccccctcccccgtccatggaaaaattgtcttccatgaaaccagtccttggtgccaaaatggttggggactgctgaccttggtgatgggatcattcatacatcaagccttagcaactagtttacccatgttacaaacctgcacatgtacaccctgaacctaaaataagtcactagaggatcataatgtacttaatatactatattatataaatatgtgttaaatatgctttatacacatacacactcagtatatatgaaaagctacttttgttttcaaagtgcttgtgcatctttaattcagtcgatggttgaaatacccccctggtaggaagggcatatgtcattatccccatttttggtgggtaaaatggtataacagatgcattaattcaagtcctgtggctgacattgctggaaagtactggctttcttccttatggcctgggcactttcttaagcctatacttaacatccatgctttggtttccatactttggcttacccgtgagatgtgatatctgtacaggggtataccagaccactaactgggatagcattaaagttatttgtagtttctctaacgcatcatttatctcatgctatgcctttgcccttgctatttcttcagtcaaaattgttttccctctccccaccacctcatgtcttacccttccttcatctctcagctcaaaaccacacctctgtgaagttctcccagttactacatgcagacttgggcttgccccgttctgtgcatctgctatactttgtgttaacttcatattacttcgtattaaggtgatagcaatgcccttactattaggttggtgcaacttttgccattaaaagtagtggcaaaaactgcaatcactttcacaccaacctaatatgttgtaattgtacacttactgcttatcatcctgcattagactgggatctccttgagggcaaggatctatattagatcatctctgcattcccctccatggtgcttggcacggggctggtagctttcttgaattcctagtgaatgtcaggaagggatggtggtgattacataatgtcattgctttgtcacctctaagccaaggacaacagtgaggagttgcctccttcaatagccaacccttagccaataacacaggcattggatgatgcgtggtagagaaaaagatttagagatgaaagattctgttagcactctcacttaattagctcagagaggtcatttaagctttttgagcctcaggtttcctcatactgttgggcagtagtaatgcctagaccactgggttattatgaaaataaatagagatcttgtataggaaagtagcttgcaaaccgaaaagcactgcaaacatgagaaataaagaagaaaaggtaatctggtaggaagaacatgtgctttggccttaggtgggattttaaatccagtctctgctactaattatttaatgtccacaacttccgtgagtctatttcttcccctctcaagggtaaataacaacactttggctgcttagagtaatgttgtgaagtttaaataggattcaggcaatgttccactgtgttccacctgtgttcagctttttccacccagagctttcagatattgtatgttcctacctctgcaccttcttttctatggcagaatcagtcctttgtactccagagaaagcaggcacctactctcaggccagggaaataaatagtgaggggagaccaccagaggaagagacaggcttccctggcatgtaatcccagccagccgggatgtgccttgggacggggcggaggcgcagcctcaatgtcatgtcacagcacattcctaggacagctgtttctgcggcagcttcttttaccatttcctttgaaactttttattgaagtggaagcctgagtgtacagatcacattttataaattcaacacacccatgtaaccagatcattcattcttgttgctgcctagtattctattttgtaaatataccacatcttttattctacagttgataggcatttggatagcttacaatttagagctaatacaaatggtgctgctatgagcattctcatacatgtttttggatgaatatatacccgtgtttcttacaggtatatacctagcagtggaattgcagggtcataaagtgtgcttatgctcaattttagtagataatactaaaacatttcccagaatttcccaacattgacacactcaccagaagtatttgcattccagttgctccagcatccctaccagcacttagtattatctgtcattttaattttaggaattctggtggattttataatttcatacatttggaaatagagccattctcttagcccccaaaagcttaaactaaacttttgtacattcattttcaggaatgtgctctctataaaactgggaagttgtatcagatgtaaagcccctagtacagtgcttgccacgtggaaggaaaatgacaagtgatagccactattactgtcaccattatcatcaccactaaatgccatctgtgttcttcaagggtgagagtagggcatggtggattacaaaggtgaataagacatattctctgcctacaaggagctcaagatctagtggaagagaccaagattagaaacagattttgtttttgtttttgagacgggagtcttgctctgtttcccaggctggagtgccatggcatgatctcgccgcactgcaacctccgccacccggtttcgagcaattcttcctgcctcagcctcctgagtagctgggattacaggcgcctggcaccaagccccgctaatttttgtatttttggtggagacggggtttcaccatgttggccaggctggtctcaaactcctgacctcaggtgatctgcccacctcggcctcccaaagtgctgggattatagacgtgagccaccatgcccggcctacaaacacattattattagacaacatgatagcaatttgaaggaaaaggtagtgcttgagctgggacttaataaggaaaagttcaatagaaagaaaaaagaaaaatgggctggagaaaacagcaagggcacaaaacttctggtggggggtggcagagtagacaatgtgctggaagagaggagctcatctgaggttggagtggtcatgtgctgtctgttattcagtgttaccattcttgcggggagtctggggccggagctggtgactgtgtgtgaagttacagtactctgtactctgttgctatgcccactgccactacctttgaacttttcttttcccactgggaaggtggacagcctcttctatttcctgggatcaaagcctgtcctgagtacaaggtgcttgaaaactaccattgacacttcaacagctgcaaaataacactggttgcaagaatccaacaatgtctctgctgtgtggtcctttaactgtttatttttatgctgggacctggcttagagtgttcattcttgcatagatccaggttgctttgtggtagcaattcaggttaataaaatgctcctctgcccaataccatctgtagatgttaataaatgttctcaaggaatttttaggatgctgaagatgatgatcaagatctcaaaatcatttcattgattaagtacctactatgtgtcaggcattggatacataggacaaagaaggaagtgggcatagtgcatatcttcattgaattggtaatccaatgggagatcagacaagtaaatacagtgtgataagggctgtgatgggcggaggtacagagtattgtgggaacacatggaagaaacacctcacccatactaggagatcagggaaggctttctggaaaaggctgcagaaacctgatagcctagtgaagaggagtagggaggaagtaatcaaggcagaggaaacaaagtgttggagaggctgaacacaagggagagaatggcttgttagagaaactggcagaagttactggcctggaacagagagagcctgaagagtttttaccaagggacccatggcaagatggaaaagggattaaaggaggtaaagactggcagcagaaagaccagttgtaataatcatggtgtaaaagacaaataaccaatgtcctcagtacactgactttcaaaattcacttatctctcaatctgccaagccagacatcctggcctccctagaaccagatacaattacagtcacatgtctcttcatggggataccttctgagaaatgtattgttaggcaatttcattgttgtgtaaatatcagagtgtacttacacaaagctagatggtgtgtgtgtgtatatgcatgtatgtatgtattcatatggaaaaccaaattcccaacatcattactgaatatcagtcctttcccctacttcaggagtccccgggccccaggctgcagactggtacctgtcgagagctgttaggaactgggcttcacggcagtaggtgagcggcgggagagtgagcattactgcctgagctccgttttgtgtcagatcagcagcagcattagattctcatagtagcatgaatcctatcatgaactgctcatgtgagggatctaggttgtgcacaccttgtgagaatctaatgcctgatgatccaaccaagatgaaacagtttcatcccaaaaccatctctccccccaacccccatttctggaaaaattgtcttctacaaaacttgtctgtggtgccaaaaaggttgaggaccgctgccctacttgatctgtaatgccagtgattagtgctctgtatcaggtttctatgtacttcattataaaatggagtctcactctgtcacccaggctggagtgcagtggtgtgatcttggctcactgcaacctcctcctcctgggttcaagcaatttttctgcctcagcctcccaagtagctgggattaaagcgtgaaccactatgcctggctaatttttgtatttttagtagagatggggtttcaccatattcgccaggctggtctcaaactccgcctcaaatgatccacccacctcggcctcccaaagtgctgggattataggcatgagccaccatctcgtatcttatgggaccaccatcatatatgcagtccattgttgaccaaaacaccattatgcagttcatgactctttttaaaaagtaaagaaaaatcctatttgaaagaactattacatgcaaaaaaatctattgttcctattactcatgcagatggccctttaaagccatggtccccaggtatgactgttacgttccttgccagaaataaacctgtgcaaggtgtactctctagtctctgtatgtgaagtaagagtcattctgtgcttgatgctgtgttttgtgcattctagataggaactgaagagctcaaaatgacatgaggttgagctgtttctcatttaggttagcttgctgtgattccagtagcttttcttcctgcttatccaagccattcatgaaagcaaaacccacacaagatacaggagctcagaataaaaggagttcaagtgggcgtgttatctcccacttcccctactaaggtacaaagttatttttctttttttcacttccttggtaattttttttttttttttttttttttacaaagactggttaccaggcatttcatacttaagccctgaagtctgggaatgtgatttctaacaattttatgtttggagttcttagacttgtgtttacctgcttacataagagataattttgcttacaaaactaactacagatgtgatcattgctgtagtattcattgtattttattaaaaaatattatgaacctactctgtgcagtactaggtatgtggaagggtttcggaaaaaaaaaaaaaaaaaaaaagacctggtccctgccttcagaaacttaatttaaaacagagcagaatcaaagtactaatgccacctttcttcattgtgtcatccaaggaagacacaagtaatcagtcacagcactgtttcctactgaaaccagaatcagcctcagaatcctcctcaacacagcattccagacaacccatgaatagataattcatcttcctggttgggtgtggtggctcacacctgtaatcccagcactttgggaggccaaggtgggcagatcacaaggtcaggagttcgagaccagcctggccaatatggtgaaaccctgtctctactaaaaatacaaaaattaggtgggtgtggtggtggatgcctgtagtcccagctactcgggaggctgaggcaggagaatcgcttgaaccaaggaggcagaggttgcagtgagctgagatcgcgccactgcactctagcctgggtgacagagtgaggctctgtctcaaaaataaataaataaataaaaatattaaaaattcatcttccatccttaatttaaaaaaatacatgcattcccaaaactcttgggtacttgccttgatttttattgcttggtcttttgctagtttttaaagaaataacatgatttctttctttaaaaaagacaaagcaatataaatatggaaacccaagaacctctcaagaaatgaaaatatggtcatgtggtttttcaagaagttgaaacattcagttcatgcacataattagagaagcccattcccattacttgccactagaaacactgtttttcttggttacttccaggatgattgtccttgtcctttattatttgtataaactagttccgtgctataaagctgtcagctgatagtgaataataaccacattttcaagtttcctggcaccggggcttcattcatggctgctcgggtcacctgctttggtagagatcgtatgtcttcctggtgctgacttattcagcatcaccatcattgattatttcatggccacctgagtcttgagctgtcttctcaatccacatgctttccataggactgcatcaaaggccagagtttcagctatatatattgataaatcccaagtgtgtatagtaagactcctcctaaacgctagacccttagtttcaactgttcatggacacttccaccagagtgattggagctaacgtaaacagctaacaaacacttgtggccagaggatgtgctaagagcgttacaatcattacttaatttaacctttccaacaacccttagaagttttcatccctattatacagatgggaaatacacaaggcttaaggaatcaaccattagtaagtgttagaactaagtctggaacataagactatccaaagtttaacggtatttaatggtatacacagacctttcaattttggcttatacaaaataagagtcatcccactccttgacctccaaatttcagtcttaacctttaatgagtccacaacaaatgccatcctgctgtcataccctccttcaaggtccactaagtaaccactatggacttggtgcagtctgtcataatttcttacctagaatgcaattcttactcattctttccctcttcccttgcactaggagagaaaagctgtatattccccttttagtttattttctactacatttatattggataaaaagataggacctgaatgagaaaactttagttaggagcaggcatagggtttttctcatttactcttttcatttgcatctctagaataatgtcttttgtcttcttgttttctaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagccaccaaccaagaccaagatgggcggacaacaaacgacatttcctttgggacatctgctgtgacacctgacatacctctcagagccacatatcctcgcacagatttcgcacttccaaatcaggaggcaaagaaagagaagaaagatccaacaggtcgaaaaacaaacttggattttcagcaatatgtatttattaatcaaatgtgttaccatctggcccttccgtggtattctaagtactttccatacctagctcttatacatactattattctcatggtcagtagcaacttttggttcaaatatcccaaaacatgctcaaaagtagaacattttgtttcaatattaggaaagtgctttgaatccccttggacgacaaaagcgttgtctgagacagcatgcgaagactcagaggaaaacaagcagagaataacaggtgcccagactctaccaaagcatgtttctaccagcagtgatgaagggagccccagtgccagtacaccaatgatcaataaaactggctttaaattttcagctgagaagcctgtgattgaagttcccagcatgacaatcctggataaaaaggatggagagcaggccaaagccctgtttgagaaagtgaggaagttccgtgcccatgtggaagatagtgacttgatctataaactctatgtggtccaaacagttatcaaaacagccaagttcatttttattctctgctatacagcgaactttgtcaacgcaatcagctttgaacacgtctgcaagcccaaagttgagcatctgattggttatgaggtatttgagtgcacccacaatatggcttacatgttgaaaaagcttctcatcagttacatatccattatttgtgtttatggctttatctgcctctacactctcttctggttattcaggatacctttgaaggaatattctttcgaaaaagtcagagaagagagcagttttagtgacattccagatgtcaaaaacgattttgcgttccttcttcacatggtagaccagtatgaccagctatattccaagcgttttggtgtgttcttgtcagaagttagtgaaaataaacttagggaaattagtttgaaccatgagtggacatttgaaaaactcaggcagcacatttcacgcaacgcccaggacaagcaggagttgcatctgttcatgctgtcgggggtgcccgatgctgtctttgacctcacagacctggatgtgctaaagcttgaactaattccagaagctaaaattcctgctaagatttctcaaatgactaacctccaagagctccacctctgccactgccctgcaaaagttgaacagactgcttttagctttcttcgcgatcacttgagatgccttcacgtgaagttcactgatgtggctgaaattcctgcctgggtgtatttgctcaaaaaccttcgagagttgtacttaataggcaatttgaactctgaaaacaataagatgataggacttgaatctctccgagagttgcggcaccttaagattctccacgtgaagagcaatttgaccaaagttccctccaacattacagatgtggctccacatcttacaaagttagtcattcataatgacggcactaaactcttggtactgaacagccttaagaaaatgatgaatgtcgctgagctggaactccagaactgtgagctagagagaatcccacatgctattttcagcctctctaatttacaggaactggatttaaagtccaataacattcgcacaattgaggaaatcatcagtttccagcatttaaaacgactgacttgtttaaaattatggcataacaaaattgttactattcctccctctattacccatgtcaaaaacttggagtcactttatttctctaacaacaagctcgaatccttaccagtggcagtatttagtttacagaaactcagatgcttagatgtgagctacaacaacatttcaatgattccaatagaaataggattgcttcagaacctgcagcatttgcatatcactgggaacaaagtggacattctgccaaaacaattgtttaaatgcataaagttgaggactttgaatctgggacagaactgcatcacctcactcccagagaaagttggtcagctctcccagctcactcagctggagctgaaggggaactgcttggaccgcctgccagcccagctgggccagtgtcggatgctcaagaaaagcgggcttgttgtggaagatcacctttttgataccctgccactcgaagtcaaagaggcattgaatcaagacataaatattccctttgcaaatgggatttaaactaagataatatatgcacagtgatgtgcaggaacaacttcctagattgcaagtgctcacgtacaagttattacaagataatgcattttaggagtagatacatcttttaaaataaaacagagaggatgcatagaaggctgatagaagacataactgaatgttcaatgtttgtagggttttaagtcattcatttccaaatcatttttttttttcttttggggaaagggaaggaaaaattataatcactaatcttggttctttttaaattgtttgtaacttggatgctgccgctactgaatgtttacaaattgcttgcctgctaaagtaaatgattaaattgacattttcttactat

SEQ ID NO: 38428 - DNA, 7506 bp, Homo sapiens
aacgggatggggagctggaccaggtgaggaagtagggggctgggaatccgggactgtgggggcaagttgacggctcccagggtcgtcggggctgagccgagagggtggttagaatttctatattttggggtccctccctccgtatggggtaagactcagtgcagggagagcccagcctatgaaaccgcctgggaggtctgcaggatcaaggctttccagtcggccggagccagcgggcgcccccggaggttttgtatggtgccttagtagtcggcccctttggaaccagatgaaatggtctttttgagtttatgctttattattattattgtttatttatttatttttctgagacggaattttgctctgaattccaggctggagtgcaatggcgcgatctcagctcactgcagcctccgcctcccgggttcaagcgattcttctgcctcagcctcccgagtaggtgggattacaggcgcgcgccaccatgcccagctaatttttgtatttagtagagactgggtttcaccatgttggtcaggctggtctcgaagtcctgacctcgtgatccgcccgcctcggcctcccaaagtgctcggattacgggtgtgagccaccgcgcccggcctatgcattattattattattattattattattattattattattattatttattattattattattattattattatttcgtttaaggatatttattattgtccctggactcccggagtgcctccaaaggacaggggagtgcatatgtgatttcgattccttcctcacttcccggatttgatgtcagagaagtctgacatcagtctgaagtcggcccttggtggtcagccttatcgcttggtccaactccgctgtctttgtgcttaatgtagtatgacaccgtattttataaaatatctacatttcttaagcctctggctcttggggcgactttgggtagaacttacaagttcctcctttgggttctcttagtgttttgttccgggtattaaagctcacatcacactgtattacagttagttgtttatttgccctcacagcagattatgagcttacagaaagcctggcctacattttactctttttggatttcttcctcatcaagagactgctgcagtgcctgtcatgtaagagactcataagtattgaaaaaaaaaatgagttaacaggtggtaggttggatggagtatgtgattttccatagagaagagagttaaatgagttgctcaagagaaccttcttagagatgaaacaggagtagaattcaaatcaattgacttccagcctgtggctcttgctatgagatcaggctttgaagttatggaacaatgaaagtagtatcttgccactcttttccccagccttgctgtttccaacacaggtgtctaaatgtcaaaggtgggctcaagacttctcgagattctagagctggagcagccaatctgctaatgttggtgttgcatggggagatgcaaagcaaggtcccctgaaacactggcgttctccacagcacccttctcagcttttgtatgagcccagtttgtcctgggtagccacctggacaacagatcagttaaagactactgagacagtcagggaaggacttcctaagttgggcctctgatttcttttctctcccacttcccctaggctagggtgagaaaataggtttatcgagctgttgtgtcaaccttgagttcttatcttggagaagtcactcctgacccaggcagaaagttgagaggaaggaatgacaatggtccttgtcgcatgggaggcacacatatgatgggcacagacccagagtctggaaaacaagcagagtgcaaagtgggcagctaagccttgagtgaactcaggatatagaagtggagaaggatccatcaggagtgcctccttggtaaaagctgtttattttatttttatatttacagatggggtctcattatgtcagccaggctggtcttgaactcctggcctcaagcaattcttctgccttggcctctcaaagtgctgggattacaggcatgagccactgtgcccagcacagaaggtagttttaaacaaaagtgaaaaagaagatggacattgctgagcaggtgtttgttgagtacctaataagggccaggaccttgggcttatggagggagattgaacaaggcctggctcttgatctgcccaagtttagctggggaggcaaaaggaattcattaagacgacggtaaccatggtgacacacagtggttctcagccttcaccaaccatcagaatcaccctgggaagcttgtttaaaatacagattcccaggctgggcacggtagctcacgtttgtaatcccagcactttgggaggctgaggcaggcagatcatgaggtcaggagttcgagaccagcctgaccaacatggtgaaaccctgtctctactgaaaatacgaaaattagccgggtgtggtgctgcgcacctgtaatcccagtacccaggaggctaaggtgggagaatcacttgaacccgggaggcagaggttgcagtgagctgagatcgcgccactgcactccagtctgggcgacagagcaagattctgtctcaaaaaaaaaacaaaacaaaacaaaacaaaaaacacagattcccaggcctcacacgggacctacttgtgttgggggtggggttgggacactatggcaaatactgcagtgttctgaggagggaagactttatcaaagggatggtttgagctgcattttgaaggatgggagtgatttggatatgtggacaggttggggaatcaacagtcctagttgactggatgactgctggatgatgtcctggttgacttcaggagtgtatttggttggactgtagaaatggtatgtgcaaggttttgggagttgaggcaggaaaggcattttgaaaatgtgagtagaatggtcaggttggaacactgggtttgaatgggagtggagtgaagcaatggcctttgcagtttacaaagcttgctgtcatgttcctgccccctcccttctccttcctcccacctcccttctctcttccctttcttcttcctctcccatttcttttctcccttcacctaaacataacatctcattccatccttacgtctgtttgtttgttttgagacagtctccctctgtagcccaggctggagtgcagtggcacaatctcggctcactgcaacctctgcctcccaggtcctggttcaagcaattctcctgcctcagcctcccatgtagctggaattacaggcacgtgccaccatgcccagctaatttttgtatttttagttgagacggggtttcaccatgttggccaggttgatcttgaactcctgacctcgtgatccacctgcctcagcctcccaaagtactgggattacaggcatgagctgttgcgcccggcaaatttatttatttatttatttatttatttatttatttatttattttttattttatttttttttgagatggagtcttgctcttttgcccaggcttgagtgcagtggcacgatcttggctcactgcaacctcagcctcccgggttcaggcagttctccctgcctcagcctcccgagtagctgggattacaggtgcccaccacaacgcccagctaattttttttttttgagagagagtttcactgttgttgcccgtgctggagtgcaatggcacgatcttggctcaccgcaacctccacctttcaggttcaaatgattctgcctcagcctccagagtagccgggattacaggcacgtaccaccatgcctgactaatttgtatttttagtagaggtgggagtttctccattttggtcaggctggtctcgaactcccgacctcaggtgatctgcccacctcagcctcctaaagtgctgggattacaggcttgagccaccacgcccagcatgcccagctaatttttgtaatttttagtagagacggggtttcgccatgttggccaggccagttttgaacgcctgacctaaggtgattcagccgccttggcctcccaaagtgctgggattacaggcatgagccaccatgcctggccttccttatgtcaacattattaagtggatattattattctttgtatttgaaggtggaaacctgaggctctggccatggttgtgtagctcgtaagattctatgaggagtctgtaatcatcctactcggtattcctgagtgtgggaaagaagctaggctggggttagggggttgtagaattagcagggtggctgatcaaaccatctaaggcaagatggcgtgggtggttaaagcatagccttgagccagagagattgggctcaaccaaatccagctttattacttactaactgtaagaccttgggcaagttgcttaatcttgctaagcctcagtgtcctcacttataacaggggagcagtaatacccacctcatgggattgttgtgaggatcaatgaggtgtacctggtgcagagcagtcgctcaccacctggaagctattgtaattagccttcccaggtctctgggctgtggctgtgcacttgcatttcattcttcagcgccgtgctttccagaacagtccattctggctgggcttttcttttttaggatgaccttaaaggtgctgaaaggatgccaccagtaaatgtttattgaaaacctactatgtgctcggcatagcccaggaactagtgacctatgcctgatggaaaggagatttggagtgggagatgtttggtggctatggcttatcctcaccaggtgccatgtgaagaggacagataatggaagtggggagggaaagggcccttcattaccaagaactgagatgagttcagtcctacttggtggttggtagatgactgacatggtctcttagggtcccttctgagcccaggaaatggtagtgggggccctggcaagcatggatccctcctactctgtggctgagggttgatggggcttctgtccatctcttttcccaggtgacagcggcatggacatatgccccaggctttcctgctggggtccatccatgagcctgcaggtgccctcatggagccccagccctgccctggaagcttggctgagagcttcctggaggaggagcttcggctcaatgctgagctgagccagctgcagttttcggagcctgtgggcatcatctacaatcccgtggagtatgcatgggagccacatcgcaactacgtgactcgctactgccagggccccaaggaagtactcttcctgggcatgaaccctggaccttttggcatggcccagactggggtaaagggtttggcttccccagtgggtggagtggggggttctaggtggatgcttggctgggtgtgctgtggagaaggagcatgtgcatggctgtagacatgtgtaggtcctcccgccccattctgtctcaacacatatactggctcctgtggtccgaggccctctcccagcgtctctgcccgtaattaaccaagcacattaatggtagtttcgttttccctgtgagctggccagtaattgcctctgagagcccttccttccgccagccccatccttactttactggatctcccctgtccctgaagtgtggttggggtcagaagagggactaggactgctgggtcctcagaagagactggttgacaggggtgggtatgtaagagatgcagggcgttctgggaacctgggttctgtttcctagctaaggcgaggttcaaaacagagcctggctccagtgcctgcccgcttttctttcagggctcaggatgagtgactgcccccagtgggggtgcttggcaggtgggggaggggaagaggcttcagggcagaaggctcaatcgcttttattgaccccaactgggtgatgaaaggtgatcaatgatgatcgatggaaatgacagcctgaggcttggggctgagagggcatccagacagcagtggtcagcccatccttgtgcctcctttaaccctggctgcctttctgtctcagaccatctgtctgtccccagtactaaccatcaaaccctgtgtagggctagatatctcaatgtagtccctgtacttagtcccaaaggctagttgggctagagggaaacaaattcttctggaccacggttcacaatgaagaactggaaaaagacagacaggctcaaaccatagggccaagaatccttgtctcaggcctttgggtgaaggtaggggtagggggtgcaggctggatcctcatgtaaggtataaagaagtcagttggtccagagcccgggcctcaggtctccagtttgaagcctttcatgtctctctccttcctcacaggtgccctttggggaagtaagcatggtccgggactggttgggcattgtggggcctgtgctgacccctccccaagagcatcctaaacgaccagtgctgggactggagtgcccacagtcagaagtgagtggtgcccgattctggggctttttccggaacctctgtggacagcctgaggtcttcttccatcactgttttgtccacaatctatgccctctgcttttcctggctcccagcgggcgcaaccttactcctgctgagctgcctgccaagcagcgagaacagcttcttgggatctgtgatgcagccctctgccggcaggtgcagctgctgggggtgcggctggtggtgggagttgggcgactggcagagcagcgggcacgacgggctctggcaggcctgatgccagaggtccaggtggaagggctcctgcatccctctccccgtaacccacaggccaacaagggctgggaggcagtggccaaggaaagattgaatgagctggggctgctgccactgctgttgaaatgagtgcccttggggccttgcatgggacacattcaagacctcgaagtcattcttggccaagcagatgacaacacatctcctggactggagcaaaaggtccttctgtgcaccctggtcgctgggaaacgtattctttgatctgttgaactgtcttccaacctgccatggcagttttgacactactcctgtttgccctcctgattcctgctttctttaccttttaacattgcccctttcaggggaccccactttgtagggaatctgcagaaggtgtgcttttgcacttgcagactgctctacctcagtgtttccttgggagactttattcagctgagagtgccctagacagtaacttctaaggtcacgtttactatttcagaggaaatatcttgccaggatacctacccatccttatagaacagttacctttagctgacccctttcctcacagggaccaagacaaagcatgggacatgaaattaagagtgaacttcttatgggaggctgcagctggatcagaggaaaaatccagtgtgacagagtgcaagtcagaagacctggcttttcatcccagctttgaaacttggaactttttgattgacaaattaataaacctctctatgcctcaggc

SEQ ID NO: 38429 - DNA, 2029 bp, Homo sapiens
atggcggacctccggaaaccgtagattccgggcggtcggagccgccgggagctgtagttctcccgcggctcagagaagtaggcagagagcggacctggcggccgggcagcatggcggggctggagctcttgtcggaccagggctaccgggtggacgggcggcgcgccggggagctgcgcaagatccaggcgcggatgggcgtgttcgcgcaggctgacggctcggcctacattgagcagggcaacaccaaggcactggctgtggtctacggcccgcacgaggcgagtgggcgcgcgggatggggaatcgtgtggccgtgggagctgcggggcagccgggctgagcgctggctcggggacttgaggggcaacggccggcgcgcctcagtctacacagccgatgctcagcaccgcatctcactcggagtaaacgcaagtccttagtgtgctgcgcggtggtcctgcctttctcatcggcctctgtccctgcgccctccttcctctttgcggctcttcaacgtgctaggcactcccccactcgctccctctcctttcagctctactccgacgtcactccttcccagacgaccttattatccacgcggtacttctcgccctacaataaaccctttgttttgtgcacctacaatctcaaatgcctattttgcttaagcattttcccctttgtttcctcgctggaacataagcttcctaaagaaaggaactttacataaaactatctggtttcattactgtgcttccagcgctgtaactgcctggccagcgaaggtattgaaagagtgtttgcttagcgcatgagtgtgggagctctgctttccaggcggagggaaccagaagggcgaagaccacggtggtgaaaacaagcaaggcacttatgcagagcagaaagactgctggtggggaaagaggggataactccaaatcaggttgagggttcccggggaggtgaggacttagggttttgtagagtagggaaatgatttgggatcttatttcatatgtaatgtgaaacctttgtaaggtagttaggatttgagtgtgtaggtgagacagaagcagcgttgatgtttgtaaacttgggttggcagggaatggggcaaggatggacacaaggaagccaattaaaaggtgccagagggcgacacatgcaagacagagagcgcaaaacagggggctttgttttggaggtaacgcagttgccccttgctgaggcattgaaagtggagggagaggcagacccacagaggacagtggagtgtgagctggaaggagtgggcctggctcatgtgtctgtcctcttccagatccggggctcccgggctcgagccctgccggacagggccctagtgaactgtcaatatagttcagcgaccttcagcacaggtgagcgcaagcgacggccacatggggaccgtaagtcctgtgagatgggcctgcagctccgccagactttcgaagcagccatcctcacacagctgcacccacgctcccagattgatatctatgtgcaggtgagccagctgcagccgtcaatccagggagggaagggtgtgatggggttggggagggagtctgatagactgacaccctgggttccctgcaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttgagatggatgcccggctgcacgaggaccacctggagcgggtgttggaggctgctgcccaggctgcccgagatgtgcacaccctcttagatcgagtggtccggcagcatgtgcgtgaggcctctatcttgctgggggactgaccacccagccacccatgtccagaataaaaccctcctctgcccacac

SEQ ID NO: 38430 - DNA, 34064 bp, Homo sapiens
gctgccgtatcccaggctaagcgccgcgcgcaaagccgtgcggagattggaggccgcgcgggtccctggtctgggccatgtctggctgtgatgctcgggagggagactgttgttcccggagatgcggcgcgcaggtaggggcggggccaccggtgcccggtattcccaggaggagaggcccaggcgggacccggcggctggagctgggcgcagggtagcgggccgggcgtttagctgcggggcggggtttcgggcctggccgttcgctaccccggcgcaccgcgaccttggcgttcggaagcaaggctgcgaggccccaggagatcagtggtctcgggcggggcgctccgatggcgggagctgggcgccaaacgttggaaagaagcaaataactgagagaggagagcgtttaggtgacctcaccgggtatttatcaggaaggcaggccagagaaggaatcgtgaagcaccgaagtggagctggggcgaagaccgcgccccccaagcttcttttctgcgccctgacgaccagttaggcgtttggggggacgtttggcactcgggagacgtttgccgaaccggagctgtgcctcagctgccagcgctttgcctttgagcagttgctccttgcctatctccgtttagatgaattgtgggatgatcatgggaacgattcttccttaagccgaagtcaaagggaaatccaccctcacgctgcatgtagttttcggtcatttacacaaaccaacagttttatggagcgccttctacacgctcagagatagggatacgtaagataaatggcccagggtctggagaactagacgaataagcagtttcagcacaatatgataaaccccacctaagaggcagggaaacccctcaaaattagtttccttattccccctatcttattcctcctatctatatctttcttagggttgaaaatcctaattaaaaagtagtaactcgcgggagatttcattgctaaacatttgtcaaccactttcttgtttgaataagtgacttccccaaattagcaaagacgactctgaaaatagaatgctgcataggcaagattggatgagagagagaagatcttggagacaggacaggtaactggagatcgttcctgggcaagtgtgtatggagaagtgtccgtaccctcaatcagtaaatcttagtgtaatgtcatcagaatgagcatcaaagagagccttaagggacccgagaataaactaggattctcaaaccaaacatggcccacagacagcttggtggacaggcatgttttttttttgctgcactcaatgttcatgaaaaatttgagccaacctttttttttttttttttttttttttgacacgttttgctcttgttgcccaggctggagtgcagtggcgtgatctcagctcactgcaacttctgcctccttggttcaagcgattttcctgcctcagcctcccaagtagctgggattacaggcgcatgtcaccacacccagttaatttttgtatttttagtagagactgggtttcaccatgttggccaggctggtctcgaactcgttatctcaggtgatccacccccctaagctgcccaaagtgctgggattacaggtgtaagccaccacgccctgccaagccaacatttcaaaatccagaatcatttcagcttcttttaaaacctcagaacacatggtgacattgggcccttattttttcatgggatctggattgcggttactagtgaacaccacctttacagagggtgctggccaggttaccacagcttccactactcacactggatttgcatatctagttaaatacatgagcccctctagatatttgtatttgtctggttttgtacaaatacataaaaacagcaataagaaaagttttaagaagtcataaaatttcattgtagttttagggggtcatgggcaatggaaagagacagtctctttggccttaaggaaggggaatgttcaactgtaagtgattaattcaacgaatatttagtgagcgcctactatgtgccaggcattgtggatttataagtgcaagctgcatctggttccttctcccctagaacatgctgtacagtggaagagacaaattagcaaagagacaaagatggtatgacaacatgacatagtttgacatatgacgatatgacttagatgggaaagttcaaggtagtttaggagtatacacttgaatgggttagagaatacctcaggaaacagtgaaagtatctactgaggcctaaaggatcaggaagacataaccacatgcaatgaaagtaaggatattccaagtaggggaagtagcatgtacacaatctcagggttgtccttgattacagacatggtgtgttcccatattaagtttggtgttctggaacataaagtaggggccagagacttgagatgaagctaaagagaaaagctagtgagaggtaaagccgctgggcttctgggtcggatggggacttggagaacttttctgtctagctaaaggattgtaaatgcaccaatcggcgctctgtgtctagctaaaggtttgtaaacccaccaatcagctctttgtaaaatggaccaatcagcaggatgtgggtggggccaaataagggaataaaagctggccaccagagccagcagcggcaacccccctcggtcaccttccaggctgtggaagctttgttttttcgctcttcacaataaatcttgctgctgctcactctatgggtccgcactacctttatgagctgtaacactccctgcgaaggtctgcggcttcattcctgaagtcagcgagaccatgaacccaccgggaggaacgaacaacctgcgtgccacctttaagagctgtaacactcactgtgaaagtctgcagcttcactcctgaagtcagcaagaccacgaacccaccagaaggaagaaactctgaacatctgaacgaacaaactccgtacacaccatctttaagaactgtaacactcaccgcaagggtccgcggcttcattcttgaagtcagtgagaccaagaacccacgggaaggaaccaattctggacaaactaggaccagacctaaagggcctgttaagcaaatcttagatttttaaactaagggcaatgagataatcagcaggatgactgaagaaggcctggggattgctggctagagttaaaaagaccagaggcatggagacagactaggaagccgtggcaggcatccaagcaagagatgctgtaggtctgagtgagggagtaaaatcaggaggtcttggttattgattagatgtgtgtagtgagaaaagaagtcaagaatgacttttaggcttctgatctagtgattggggcctggtggtccaccagaaagagaatacaggaggaagaaacagtttatgatgggtgtgttgtggacatgttgagtttgaggtacagcctcagcatgtggtactatacactgagtgtatttagcagggttctctagagggacagaactaatggaatatatatataaagggaagtttattaagcattaactcacgtgaacccaagatcccgcaataggccgtttgcaggctgaggagcgaggagagccagtctgagttccaaaactgaagaacttggagtccagtgttcaagtcgggaagcatccagcacgggagaaagatgtaggctaggccagtctcccttttcacatttttctgcctgcttgtattctagccatgctggcagctgattagattgtgctcatccagattaagggtgggcctgcctttcccagcccactgactcaaaatgttaatcctcctttggcagcaccctcacagacacacctaggatcaatactttgtatccttcaatccagtcaagttgacactcagtattaaccatcacactgggtattgctttcaagctaggagagagaactggattggagataaagatttggaagacttgctcaccaaaaccttcgctctcaagacctgtgtatttatattattctgtctttgatagacactcttttctgaacacatattataaaagatattatatatcttttctgaacactctgtagcccattcaataatttttattatcatttgcagtaacatccccaagtgacttatgtttcatgtactttcttcttgtattctaaagattcttcaggcatcaagtgtattattttcgggtcagactcagcttatgacaataatctctgacctggttttacagctctgaaattaaatccctactgactggcccttgaactgattttttctaacatcagcaaaagtcaaggagtgtttccctaaaaaagaaagcatttactcagaaaccgtatattgaagtccaggctgaaaaatgcaaacatgagtaagttgttcctatttttcagaaacttgggcagttgcaaatgcatatttataattaatatataccagtaatgggcagtggggcatggggggaaaggatgaagttccattaggggatgacaaagtattttgcaagtatagagggaggggaaggtcatttcatacagtgactcatggaagacttcatggagaatatggcattttagattggccagatggaaaccaaaaagaagatactagggccagcatatgccctgttttaagaggtagcactacacaacactgatcgtttttgctatgtgggagtattatgggcccattgtttagttttgcttttttaagggaaactggaaactcagattttatatgaaatctcttgattttaaaatttaggctcagactctttctaagcattgcgtagaccaaataaacaacttcctgtgagcctgaagcagtccacaaaataccataacctctgatacaggactttttttaatgtaagagatatgatgttaatgcaaccaacgtttattgagcaaagcactgtggtaggtatagctataccaagagcccattctctgcttagttgcagagaaaaaccaggtagggactacttctatttttttaattttaccttaactatcacagtgtcctatatatgttgacactgaacaaatattttttctttgatatttctgcagcacaagtacatccagtaccttgccctttttttttccttgacctcatcactgctgttcatctttaccgccccctcactctaacatcccattcccatggtcatatccttctctgcccaacccctacccttttaccatacacttttttgggtatattcaactatatgaattagtgtgtctacaagtattctggtgtcttactgcagctggcctctgagtagcatgtgacagtcctctggggagtttccttttacattcccctaagtagctgttccagaacctcatcatttcacctcatcctttaccccacacctgtttcaaaggtgaccttgcctccaaaatcacaaagaaactgaaagctattaggtgtgaacttcttaatgtcttcctctttccacatgcagtataatgtaaaggttaaggaccaggatctagaatcagactgcctgggttcaaattctggctctgcctcttgctatcttggtggccttggacaagttacttaatctctcttagtacaatagggttgttataaggataaagtaaagtattccatataaaggctttagaaaaatgcctggcacaaaataagcactctataaagaaatgttagcaattcttattatcagtggtattattacatatttaatattacattgttaatattattacatacttacctgcatctttacctttcctcccattcctgtttttctaatgccagcttctctatctcgacaaaggctgacctcttagacctctgctttcctgtatgtttaatctttccctgtctcctcatgttacccgttagcatgtaacagaaaactgtcttaattaaccagtttttcccttctttttccctgtctagcccttctttatagcaacactattgaaagagtcattagaactccatgcctccaagtttcatttacttctaaatgaaagtgagtgaagctcactgcgatcttgcttccacacccagtctattgaaacagttgttacttaaggtcgtggttgacctaatttacatatggagttggcctagccaaacctttagccaggatgaaccctgccacccatttctttgggctggcattgagcagctgaacattgctggagaatattgcacaactttgttgtctggccttgcttcatgatttcaacctcaaatcgtcacttactgctgcccaacagcccatctttgtttctctagtagttcggtgttccactcccaaagatgactgttttataccttttattctcttgtcaagcctctcataccctgttgccatactcagctgatgactttgtttatactgaagacaatagaagtcattaggtaatgaacttcctcaccttcctaccacaaaacctaccaatctgctggaatgtgaacccagcttctctcatttcatgaaaggcaagaagcccagttcctccactagagctcaggatctccaagccctctcaccttctataattatttctctccttctccccgtgtctcctattaggaatcatttcctttctggtaagactgttgtcatcagctttcaagcccttccacatcttgcccctacaaatttatcttccgccaccctcagcacttcctcactctgctctagccaactgatcttccgcctgtgaagtacttgctcacttcagagccttcacacctgctgtttcctctgcctggagtacttgcctctctcaacacaaaaccttgcacacacacacgtactcattcatcacacactggcttagttcatgtcttttaggtcctagattaaatgccacctgctcagagaggccttccttgactgcgttaatcaaagttgatccctgccgtttttctccaagtcccatgtttctttcctgcttggcactttttacagtttatttatgtattctgtttactttttaaaaactcctccccagagtgtgaattcttttaggtcaggccctgggaattcaggtccagtttatagctgaattcccagggcctagaagagtgttcagcacatggtaatgtttctgacccacatcccagggaacgatatcatccactcagctactcagctgaccacacacttgggagtctttgaagccttcgtttgtctccttcagttttctcaccccaagtccttcatcttccaaatgcatcttcacagtcccttccttccagcttcctttttaaactctttcagcagcctccctgctcttctgggcttttgctttcttgaccactgcctttcagcctctttcgtttactgacactgtgcaaatgtttccaaaacagactcttatcacatatcttacgtttcaaactctttggtggttttcaatcatccatgaaatataggtcaaagccctgtgcatagcatagaagaccctttagactcagcctcccttttacctccatcctgcagaacctaatttataaccacttccagctactaagcattctttctgactgaaatgccctttctcctcttcacctacccagcatatactcccaccgtccttcattaagacagatataagaaataccaacatagaacagactactggtgttaattcagaagtctggagatcactgatccagattattaatagaaggagactgatgcccagaaagtatcactgacttgccttagggcacacagctagtggggtccaagctaaaaacaggctccatgtcttctgatttctagtcaacacttgactgatgaggaggaggagggtttttaagtgtggtgaaggtagaagagagagctggggcattcaagtaaagaaaaccaagatgcatagagagacaagtgcaacaagtgtgcagaatgaaacgaagaccaaggacagagagaaagtatgactcatctttactgtgcctgcattcagtcccttcctgagcccagtgtcaggaaaataagtgaaagactttgaaacaaacaaaaagagtatttactgggtatcttggagttattattatgctattttacaactctcagttgtggaatcctggcagttaacgcaggtgattgttgttcatggaaatgcaagttgtgttcaatggagattcattttattgttaacctgtggacagtatccagttttgctaagtcaggattcctcgttacttatattatgtatgttttgaattctccttttgaatcagttgtaacatcttactagtttccccatttattgatgagttactaatctcatgcatgttattttatacttgtatgagagtcttccaggaaaacctgtatctgaggaatatatgcctatatttgcttaagttgaaagaaaagatgggggaggggattagagccattgttggctgtgagtagtatctcggagacaagccaggctgatttccttaaaataactagattgaaaaattggaaaaattaataccaaatcaaaacttgttagacattaatgattttgatatatacaaaatgctgttaaatgtgtttcctcctcactgtagaacctctactataaatagttgattgtaatcaatctttagatacacatttcaaaattattattataactgaaaaccagatctaacaataataggaaagtaatattgacattcaggagagaactagataccaattgaacctttccttcttgtcaattcttgttaaaatatatgttctggtagttactttcttctggacagtttaaatgacttcattttcaccaagtatatctctgttggtgcctgctaagtgataatctctttgaaattttaattttatgggtctcaaggattgaaaatgtattaacagcagctgccttgtcattgttattgctttagcttgaagctggctaattgctgtaatatcgcagcactggaaaagacaaaagagaaaggggagacctgtaataaaagaccattttctgtaatgtgtgctatttgctgtgcaaattgatggttttaagggttggaagactgcaggagtcttcccattagctgtactttaaaatgtagttaaaatatcacttatatccctaaataaggaagtagcaaattatacaggcataggtaatttgggctagatttcttaaggacggatataagaaataccaacatagtttttccttaataactcctgtaatattcccttcctgaggagatgtcaccctaactgctgttagggggttttgggcaagaactctttctggctacttcctgccgaaaagggacatcaagtggggaacaacagctagggctcctcctggggttgatctaagggtcctcggaagaatggcacgtccacgtgtggttcggtttgcagcaccatttggattgattgcttctaggcaagaggaaatgatttgagttatagtattgagtatgcaaggtccaaatattaatacaagacatataagtaggagtggacttaataaaggagctaaccaattccataaagaagactagaattcattaaagaggaattgtagccacccggggctgaagcctgcgtgttcttgtagcctcttaatgattttgatttgatctttaggtagctgtagattttcctctgctttactagaggtgttaatccagaagcagcatgtttcatttataagtgcacaggtacctcctacttcagctgtgaggacgtctaagccccgtctattctgtgctgctactgtggtgaaagagtctgtagattgctgtcgtgcctctatggtacctacagttgccttccacccttgttgcatcataatagaaatagtaagtactgatctttcaaggagagggaagcccgtaatccagactagacctctggctatagaatttcccattcatggtttttctaagatgggattgtcatgtgcatgccctccccagtctgctctttcagttaaatctccctatgagggcatagaaatgatagatctctttctctggtgtattcaagatagtgtagtctctagaaaagagcctcaattagggatgactccagatgatgctgccatcttggtagaatttaaaaataataagtcaggaactagtgctactatagtacaagttcccttccaatgccttgggaggattaaatgtatccaggagccacaaaaaaaaaagtagccctgttccttgaagagacagttctaaattgtggcttgtgagagacaccggcagatttttctgatatcttagaagtttcccttctttacatataataggggcatccttgggataaggatatccatatttacaatatttacgatgccatttggaattcgacatgtcaagtgagaagcgtccacctgacaaatggagtttcgaaaaattagagacataatatgccctggccagtatctcagatgatcctgtggcaagggctgtcagtccagatgcctccagtttgcccacagatctgtaagccgctactattagcaaacatgatacaacggtctggaattccatgagggggcatgtttggaaaggcccatctgttattctttacaatatagtcaaggtggttacttagagcatgccactcccatcggggcttccaaccagaatgagaggctagattctgaaagccccccaactagggcttctaatccttttagatcacccttgttgcactctcctccctaaatatttgaactaacatcaattacaagtatgatgttacaatatttgagatctcccaagcatggtccttcctcgctgcttttaaagcagagagaggcatttgctgttactcagtcttgtcccagcctgaggatgtgaagcttatcttcaggcagagtgttctccggcactgggagcagagtgttgctcccataccatgtccaatttatgcctgctaggtctttaagggtaaaggtaaagccaataaagggaatcctaaaacagtgaattctgggtcattgtaagtttccttagcgtcactgaactgagcaaaccacttaggacagacccaacaattagtcttgttgtacaaatggaccatggcagatattgcaggagctaaagggtgtgatgtattactaagtccgataaaaagtcctaatagactgagtgatagtaaaacgctcatgtttacttccttttcataactgttattcctgctatgaggataataattaagcagaatgctacagtaattgagattatctgtctgatattccaccctgagggtgctacagcatatagtcctactgcaaatagtagagtgagtaaaacaattcctgcaagggtggcgtagtaaataatttccatcaaaaagaagttctaatatttggcagcgaatctcaaaaggagaggtggaaatggcaagaagtatttggtgaggtaggggtgagactaagataagtagttttcattcagttacttttgtgattttcagcttaagatctcctctttctttatattgatattcaaggcattcctctgggttgtcaggggttgctccctcaggtctccaggctttgactccaatataatgtatccaggagtcgattcctgtaacttttattgcctaggggcttgaaagaagaacagtgtaaggtccttcccagcctgggcttagggagggagagagagaagggagagcctttacaagtaccaaatctcctgggttaaacagaggtggtccagtttcctggggttgggcttttgctagtcgcttcctgttggaactgagccagagaggttacatgcttaactagctcagaggtttcccaatctaacagaaaatcattggtaagaaaaggccatctgtacagcatctcaaaagggctaagacctaattttgaaggggtatttcttattcgttaaggccatgggaataagagtgacccaaggaaggtgagtttcttgggataattttcagaggtgtctcttgataatatcattagttttctccacctttcctgagaattggggtctccaagcacaatggagatgatattctatgcctagtgcttttgagaccccttgtgtgacagctgccttaaacaagggcccattgtcactttgaaggtacttcggtagaccaaagcaggaagttatttcattaactaacatttttattacctcagaggctctttgtggatggcatggaaatgcttctacccagttagtgaaggtgtctacccataccagcaggtattgaatgccctttgtctttgacatgtgggtgaagtctatttgccagtcttcccctggataacttcctgttctttgggtttgaggaggaaggagtcacattttcaggggattatttttaagacagacttcacaggtattaataacttgcttgactgtttttggtaagttctctcctgaaaacaatctctgggcacgttgataagttttatcctttcccaagtgaaaaccttggtgaaggattttaaggattttccattggctggaggctggcaagtggtgtttgccatcctctgactgtagccatcctgaggactaaaaggtataccctcgagacaaagtggtccattctatttctgtaggggagtactgaggtttaatttctcttatggagccttcccagattagaggggtgtgaagtgtgttgatgtcttgaggcttccttgccactgatttagctgcctgatcagctaatctgtatccttcggctacctcatctgttcccttttgatgtcccttgcaatgcatcactgctatttattgtgtaagaaaaactgaggataataacctgttaatttcctggtgatattttacaggcggtccattggtggtaaggaaatgcctttccttccaaatggcagcatgagcatggagaaccagaaaagcatacttggagtcagtgtaaatgttagctctctttcctttgcttaatgtgattgcttttgtaagagctattagctcagctaattgagcacttgtgcctggagggagagatgcacttttggtgacgtcatttagagtgaccattgcatatgcatactccttgttctacaaaagagctcccatctgtggagagggtccagtctgagttctctagggaagtttccccagtatcttcccttgctgcataggtctgtactatgacttgttcataatcatgcacagtttccccagtttccttggggaagaaggtggctggatttagatgagaacaagtctttaattggatgttggaaccttctaacagcagggcctgatatgtaaggagtcggctgttagcccaaaggctcccctgtagagtgcagtagtcctgccatgttatgtggggtgtaaacagttaaatcatttcccaggattataaacagttaaatcatttcccaggattagtttggaggcttctgggaccagtagagccactgaggcaatggcttggagacatgctggccatcctttagccaccaaatcatgttccttacttaggtaacccattgactgttgagctggtcctcgggcctgtgttaaaactcccagggacattcccttcttttctgacacatacagattgaaggccttccctacaggaaggctgagggctggcaccttgagcaaggcttgctttagctggttgaaggccttttgagcttcaggttcccaggttaaaagatgagttttagctccctgagtttcttttatgaggttatataatggacgggctatttcaccatacccaggtatccatagtctacaaaatcctgtaatgccccaaaatcctcttagttgcttgagggtttgggggtgagggaaggaggaaataggcttaatcctctcttcccctaatactctggtccccttggacagtactaatcctagatacttcactgaggttttgcagagctgggccttggattttgaaaccttatatcctctgttagctgagaagttgagaagagcttcggtgccttcctgagaagcttcctcagttggggcacagagcagaatatcatcaactaatgcaagaccctaacttgaggatgagagaactcagaaatgtcttgtgacagtgcctgtccaaacagatgaggactatctcaaaatccctgaggcagcaccgtccatgttaactgggcagtctggacggaaggaaatcctcaaaggcaaacaggtgttgagaatcaggatgtaatggtatgcagaaaaaggcatcctttaaatctaggactgtaaaccatttagttccctcaggtatttgagttaacagggtatagggattaggtaccactggatgcattggaactacagcttcattaatgaggcaaaggtcctgaactagtctctattccccactgggcttctgcactcctaatattggggtgttgcaggggctattaaagggtttgaggaggccctgcatctttaggttattaataacggcttctagccctttcctagcctctgggctcaggggatactgtctctggttaggaaaagaagtgagatccttaagatagatctggactggcctagtggttatagctcgacctatccttccttgagttgcccacacttgtagtttaatgttagcttccatcgggggagacaaagagtttgtcctggggctgtatggatgctggcccccatgcaagctagactatctcttcctaataaaggagcaggactttcagccatgattttaaaagcatgtgtaaatagtaggtccccccatctgcaggtaagaggttgagaaaaatatcaggttagaatttttcctgagacaccccttatagtcatactatgggaagaggggaggcctggattagaggagaagagagagactggctccagtatccagaaggagatctaccttccttccttcctttgatttccagaatcacccaaggttcctgtgctgtaatggcagtctgagtcgctggagctaggggtttgagcccccgggacccatcagtcttgctggaccatctgtgagactggttctgaacccagtgacctccgtctctgggggcagatctgtctccagtggtctccgccacaggctggacagggtcgaggtggctttgtcttgctacctggacattctttcttaaaatgccctgatttgccacatcgataacagctagtggatgcaccttggggattctggactttgcaagcttgcaccactgctactagagcctctgttgttttcctgtattttcctttccttttattgggcttcctcctgatccctattgtaaaagaccgaagtggctttcttaggaggttttctagggtactatctggccctatagcttgcttttatagtttccttttaatattgggagctacctgtgtaataaacttgtccttgagaatgagctgtcccttgattgaatcgggataaataggtatgttttattagtgcctctctcagcctttccataaaggctgtgggattctcgtttggtctttggtctatcatggacagtttagagtaattgagaggtttggccctggttttccatgggccctctaatacacaccttaaaagtgcttccttttccattcatttcctgagttactggtgttccagtcagggttgtctaccagaactgcttcctttcctagtaggaatggagtttccacttcttcctcaccttccctatctcctctttgtctcctcggtttgctacaggaggcatgttgctcatctccatatttttctgctgcctgcagaactttctgcttttcagcttcagtgagggtctgacgtagcagcaacgtaacatccctctatgtgaggtcaaatacctgagttaaattttggaaaatttctatatacctacctgggttgtcagaaaatcggcctaagtctccctttatttgcttaaggttctgtaatgaaagggaacttgaaccctcatggcaccattcccatcaagcacttcctgcagcagtaagagtgaaatggggagagtaggatatactggaaatggtggagctagaggagctgatggtacaattggagggggactggaagcattgggacattcaatagctgtctcagattgctcctttggaacctactttagctctgggaaaggcctatgggcttgcctgccatggctggtaaaagaactgggtcagttgtccaggacttgtaaaggtctgggtttcacagggcaaagaaagtctatacataggggacctcagtccatttgcccttctgtctatagaaaagatctaactgttggatgacattaaaatcaaggctccaccaagcaggccaggtttgtccatctccaagatgataagaaggccatgcccttgtgcaatagactatgaggcattttttcttcaaagtctcagggttgaagcagtcccagtgttttaaaatccactccaggggaccacatgctaaagatgatctgttacccgtttagaaagagaagtgagaataaaagtgtccttttagtctccttcctttctgtatatgacccagggtggagaagaaaacagtgggggcgtcccccaactattttccctcgctagttcctaggtcccacctccctgttaaatgtgctgcccatgactgtaggtgtgaccctccaagccatggcaccagaggaactagacttttgggcctagtcgcacttccccaagcagctctagtcctctgcttatatttcccttcaacctcctagacttctgcgacctgtgtacctccctaaaaaaaacagatctcaagaaaaactacgtaattgggcaaggcccctttaatggagggggtatgctagattgaactctatatcctgctattatggcccatgctaaagcatttacccttagaaaaatggttccggttaacttctggacttaaaatccccttactagctcagtactaccttaatcagagacagaataggtgccttaaaggaacgtaggaaccaaacggccattttcctgctgatgggacaatattgagactaaaatttggccacagaagacatttaactcctatctgttgaaagcagaattttcctgttcacagaagaggcttagagcccgatttctagtggtgcaaaaggaagctgcagtgttaccataaaagaaaaaaaaatgtgcctcatgaagatttctgtttccactaggtggcactgttggtttagaaatactatttgctcgaggccgggctcagtggctcacgcctgtaatcccagcactttgggaggccgaggcaggtggatcactaggtcaggagattgagaccatcctggcttgtaatcccagcactttgggaggccgaggcaggtggatcactaggtcaggagattgagaccatcctggctaacacggtgaaacccccatctctactaaaaatacaaacaattagctgggcgcggtggcgggcgcctgtagtcccagctactcgggaggctgaggcaggagaatggcgtgaacccgggaggcggagcttgcagtgagccgagatcacgtcactgcactccagcctgggcgaaagagcgagactctgcctcaaaaaaaaaaaaaaaaaaaaaaaaaaaaaaccaaagaaagaaatactatgtgctcgccagagtagtagtagagagacctggaaatgccatgcactctccagaccaagggcagagagagagacgctcactctgggtgggagcggggaggagggggaggaaaggaaccctctgttcctagaagattgcaacagcattcctgagctaaactcctggttactaaattcccgcacatcagagagagagagagactgtggatagaaaaagaaggagagttttgtgacaggatagctggggattctctgccaaaacccgaaatgggctgttggaggctgggtccgacccagaggcctttgaataacgccagggtgtgtcctggccagaactttcccagcctcacgcgatggtaaggtttccccgtgaaaggaaactgattcgaaacacggccgacactcccaatgacccgtgggtattgaggggggttctccgtgttctccaccagcaagcctaacatctgaggccttagaatggcagtcgtgataagcatatttttaaccagctgaaggatgcctgttgattgatttgatttgattttaaaatagaggccaagagcccctcagaatgatagaacagattttaagcttgctcctatactcaccatccgatgaatgttgtacctcggattcttggccaacacaccaaaatgatatggctctgataactgaaggaacaccagggccctttgtctcgcaccaatttagataaataacatggacacacgtggagtggttttaaggaatggagagtttaataagaaagaagaaagaagctcccctgtacagagatggagggtggctccaagcagagagagaaaaccccaagtggagcgggaaaacagtcggttctattaggaggctggaggaggtggtgtctgattttcatagggcccaggggattggtttgaccaggtatgtcactcaggtagcccacgaaaaaaactagccttcccaccctagccttttaatattcaaatacaggccaccatgatgttctgcacacgtgaagatatctggggtggccatgatgcttgacacacatggtgacaagaagagggtgggaatcaccatattggatggacccggtttctaatggctggcatttgcacatcaaagcttgctatcctggccctttaagctgcttttctgctagaaaagaaatgtttttggagctgcattattaaaagaaaaaaaaaaaccttactaagctgcattattaaaagaaaacaaaaccttaccaaccttaccctctctgtctaaaataatttcttaataactcctataatagttttgctattttaattcaagaattttcagctctttaaaatgaaaaggaaactgacattgtgtcagatttcatgctgactgcattatgtccattgtatctcattttaatcctcacagcattttcattgtgtggataagtaaactgacacccaaagtcatgtaggcaataaatccagtaatgtggattagacttttaagtcagctaactccaagtctaagttgaatcagaacttttagaaatttctagattctcaagtttttaattttatattttgaagtttactccatcagtcatcatttgtaatacttaaaatgagtaagtagaacattagcactaaatctggggaaaaacaccacaatttcaagtattcagctaagtagctgagaattcaacctgttaaataatgatcgctttttgaactcaaagatgtttttccccctttacccagtgaccggatctgtaaaggcatgcttccttgttgtgattttctccacagtgaatctcattttgttcactgttaccttgaaggtagacctcagtggggtctccagtttatgtggggatttttcattaggtttcctggaattgatcaggccctgggttttgtctcatgcttctagtggcttacatggctatcaaaattgaagttcaaggtcaccagagttttgcaataccttcaggaacattctggctttggcgctcacttctctcccaggtagtctcattttcctttgttgttgttgttgttgctttattatgcttttaagttctgggatacgtgtgcagaacttacaggtttgttacttaggtatacacgtgccatggtggtttgctgcacccctcaactcatcatctatgttaggtatttctcctaatgctatcccttctctagccccccatctgctgacaggccctggtgtgtgattttcccctccctgtgtccatgtgttctcattgttcaaatcccatttatgagtgagaacatgcagtgtttggttttctgctcctgtgttagtttgctgagaatgatggtttccagcttcatccatgtccctgcaaaggacgtgagctcatccttttttatggctgcatagtattccattgtgtatatgtgtcacattttctttatccattctatcattgatgggtatttgggttggttccaagtctttgctattgtaaatagtgctgcagtaaacatacgtatgtgtctttatagtagaatcccagtaatgggattgctaggtcaaatggtatttctggttctagatccttgaggaatcgccacactgtcttccacaatggttgaactaatttacactcccaccaacagtgtaaaagcattcctatttctccacatcctctccagcatctattgtttcctgactttttaatgatcgccattccaactggtgtgagagtctcattctcattttttatggcccctgtgaaactttactttcttgccagctcaacaacttattttgaaatattttaaaaaataatttattcagcatttgtacttatttttaagataaggattgtatattatactgcccaaaatggaattcattgtatttcttcttcatttatttatttatttatttatttttgttttcattaatttaaaccacaaaaaagcaggagaaaatggtgtgggctcttttttctaaagaagtaatcattggacttataaaaataacacttgatatttatctgtctgtatacacacacatacactcataaacacgtatcttcataaaatgggttaagcaagtattaattgaggttgtttcttagtgttttttgtaatttgcttcactttattttctataatgagtatatattgctttttcaataagagaaactaaaatcattgtgggaaaaaggacttttttggaataaaaatacaattgaaccaacacacagagtatgtgttgaacatgtaactatcataatatctcatgtatatatcatcaaacctagttaaataaggtgttttgtgtaaataaatcttctggagagactgttccttcagcatgagattctattttctttcagccatttcagttgatgctttgtaatgtatactaggcatttccccaccttgtttttgcagcctgttccttagtgttggactatatggccctataccgaatactcccaggttgccaaataatgtagtagatccactttctaaacattaaaaacaaaatatgtttgtaatagttttttccttcactgtactctttctatagtatgttttcttaaactttcttaaattggcttcttattagaaacaccagctggaatagttacttgataaaatgatgtctgttttaaaaatcattaccttctttttaaggacaaggagcatccaagatacctgatcccagaactttgcaaacagttttaccatttaggctgggtcactgggactggaggaggaattagcttgaagcatgggtaagtttctggcagcctttattactgggaactctccatttgagtagaccacagcaagtctaatgtgttatatccaaagaacaactgatgatcagttttatgtgatactgaaggtctttagtttctaaatggacaagtggacatttgtgtaactgaatggaagcaatgtacaaaagctgcagatatgtcaaatagctaaagactgaagatccacaatttcaaatcacaataacttaatactcagtttttgagtaccagagttaaataacatgctaccaagtatgttcatatacctgagattctagaggatcctctctaggtagataggatttgtttcaaaggttcaggtactttggtttttgaaacagagtcttgctctgtcacccaggctggagtgcagtggggcgatcatggctcactgcagccttgacttcccaggcttaaacaatcctcctacctcatcctcctgggcagctgggactacaggcatgtgcgaccacgcctggctaattttttctggggttttttttttttttttttttgtagagactgggtctcactaagttgcatgggctggtctcaaactcctaggctcaagcaacccacctgccttgacctcccagatacatatttcaaagtcacttaaatacagatgactaatcattaaaaatcctaataattattttttattgaatcaaaagaacggcagtatgctttctaagcacctgtatcattaatgaatatagtgcctgctaatctgtattcctcagaggacaaaacaagatgtactggacttaaattgaagcagaaaggataaatagtattcaattgctcattgtatttatttagtgtcatttattcaagaagatgaagaaataaagtaagtattagtaactgtgagtaagaagtaacttgctatcaatgaaattaagattatagaatctcattcaaggatttccaatacaggattaatctttttttcctcctgaaatgtgttaggaatattattgtctggaggttgtgtgttaaattgagtgatgttgatttattacttcattctaattcactttctttaacaaaattggattattaaaatatttatgtgctgttgaatatatatagtcatgcccccaaggaggctgcattgcatattaaggaatggaatgtaaaatataatcagaacattgggaacaaaagggattcaatggtacaccacaagatgatgccattataattttatctgctttaaattactgagttaactcatgaaattttcattgaacattgggaaatgacaagaggttcctctgttaacaactggcacagttagggataaaagtatgctctcagtctagtaagattatgttccatatggtagatcaataaatccatctgtgcctcctctcttaccatcagcctagttgctaatgtgtaaatacagcattgctcaagctttcacattattttgccaaaactttcaagatggcctattcacagcaaatcctacgataacaacatttattcttgtttcatgtatccatttagaagttgagtcccagtaatatagtttcccaactgtattatttataataaatcatattctaaatgctgtctttagttaactgctttttatttgcatgttcagaaatagtttgtgtatgtataaaataaagctttctaccaaatgagctaaaataaccatttccaactggctctttaaaaaaactagcaaagttaaaaataggtgaatgcaggactcaagatgaaatatttttgatcaaaaagacataaaggactatgttctttctagtagaattttactaatccatgcactaccattttatgtgaccaccataaaccactcattggcgcatcttttaaaattaaatgggcttttatagcactaaaatcagctcataggaaattttcatcatatatgtgaaatgctttatccttagttcttaatgggtgtggaggtcatggaaggaaagagccacagtcacatggcactgtatttggaatcttattaaatttgtgctttacatagtaaaatgaatattttgtagtaaaatgttggtttttttccctaatatttaaatgacttaataagtcactagcattatcagcaatactattctcatgttgttagtgaaagtttggctctttgatgcttagggcaaataaatttggaataaaatgcaaacgcaataaattatgtttccagaataatacagacaataagctctttgggaacataaaatgatttactaattccaagatttgactggaccattccagcttatgctacaagtatgtggtaccaaaaattaagtcagaagaaggaaataaatgaccaagaaaataatagtaatcaaggcaattccaggatactcaatagctactgtgtttaggttgggtcgctatcattcaaatttataatttcctgttttcacagagtaatattgacaggtgtcagagagactgatcctgttgcatgtgattaggactacaattaataaagtcacattgtagacaaaataattgaggcactataagatttaaattattttttaactgaccagaaagcaaataaaaatagaagcaactgaacatagatgtattttgacctcttggggtttggcccttgcttaccacagtgaaaatgcaggagtacagagaagtatattccaaaatttagtaacttgaaattcaaaatgctttctgtttgtggcttaaagcaccaagtagatatttcactttaatatttggcatgtttctattctaaaaagctctgtcatttttatatttttatccagatatctctttctttgtaggtgtaaatatatttttctaaaacatttggctaatcttttaattacccaaagttcatcaaagtctaaattaatttccattttacaaagacatttacaacataccaagtcacttgaataaacagagtacccttggttttcctactttatagatgggttttacttaccagcagaccattttgtactttatttgagtctattcccaggactgcataaatttctccccacataagaagacccacaagtccacttatctgtggaggtgagtggaccatgtaccatcctagagcttcttccatgttacacaaggacacaagatttggatcactggtattcacaaagagcccttgttaatagtatgatcccaacccattctcactggttgcagaggaatgtccctttatgttatccttatgttgcagaactcggaaacaatagccacttcatgaaagcaaatgctcgcgtgcagctaacagtgcattggatttccactcacattatcagacatttgttttctagactttatcagtggaaccttaaagaaactttgatttcaccttagatttttatcggttccaagcctacaggtttattagcaacctgaacttcagcagcttggtatataggccatcatcctcatttacactatgaaatgtttgatatttgttcaatatccctgtgtctgtgccttactagcagaaactagagcatgcaggtactggcattttcttggtttgcatatatgcagtagctcattaatactctctggcagcaactgaaactggtaagttatcaaagatatccagcgagaagagaaaaaacctgatatgtgagccaagggacgtttgtttagttgttgttgagggtggagggaatttagagaagatttgaaattaatttccaaatcaaatttgagagcaccttgtggtaaatggtagtctatagcatctcccttagtccaacatcctgtaacaaagagatcttcacatgtagccattctgatattttgaactctttgtagttgttttagctttattactaaatttttttccaagatatgtatgcttttcaaatgggaagcatgtgattctatccaaaaagtagcccagtgttaatacagtaatttaagaaactgtccagcagaggtctctgaacttcatggtttaagaagagcatttcaaacaataaatcaaacctgattctttgcatgacagaaatatacttctattgagcatattttccagattggattttagaataactgtatttcacataggttaaactctgcttattcatgtttaaagacgctgaaaacttatgttttcagatttttattcccctaacaggataaaagcctggttaccaccaactttgcactataaaaagaataaatatatatgaaacgtagaagacaaaagcaacaactaatattctacaatgccaccagcactacaaaggcattgatgtagtttggctttctttctatgcagccaaaatccataattaaatcaagcaactggctgtattgcttgatttataaagaacatgcatgattggactgcaaacttttctttgtgcaaaagcaggaaataaataaataccaatttgtatgttttgtgttgccagcgatgaaatctacattgctccttcaggagtgcaaaaggaacgaattcaggtatggtaatgggattctttaacctcagtgtcttttcttcttaattactgttttatgaaatggaattaattttaagagaaaacattcattttatcatagcaatttgaataactaatcagcaaacatttattgagtaattattaaatgttttgtaaggtggtagatatcttccatacaaccggtgtatgttttgaaatctcattcaacctatagggggcaaaagtgaatagtgcaatcttaaatcacagtaaagagcaattataactttgcagctttataacactacgatctttatcaggctggtggaataatcagattgatggtctcagatgaaccaaattaattcatatttcctaatagcaaagttattctaatttcaggatttcaagttatgaaactttgtttcaaattttgagaagtcttattctgtgttaatgccagaataataccccaaatctagttaaagcaaacacataattatttaacttctaatgcaagaaaaaaaagaaaagctgctttgttaataaaacatttgtattgtagttttttaataaatcctggcagataaaagctacagaaatacgcatgctttactgtatgtggatcagatacccatcaacagtagactggcgaaagaaaatgtggtacatatataccatggattagtatgcagccataataaagaacaagatcatgtcctttgcagcaacatgagtggagctggaaaccattatcctaagtgaattaatgcaggaacagaaaaatcaaataccgcatgttctcacttacagtgggagctaaacattgagtacatacagtcacaaagaagggagcaatacacactgggacctactggagggtggagggtgggaggaaagtgaggatggaaaaactgctgtcagttactatgcttattacatgggtgacaaaataatctgtacaccagactcttgtaacatgcaatttacctatgtaacaaacctccacatgtacccctggacctaaaataaaagttaaaaaaaaaaagaaaaacctgtagatctacataatttcttaagctttaagaagaatataccttattgagattaacctttctgagtaccatctaaatttctcaagggttagaaaaattactcaaaattttgcttttatctaacaaaatgtggggaaaaaaattttaacacccatctttggaatgtcgatttctttatatagactttctgaaatacagttgtgaaattatagggcaaagttgagaagctaaattgttgaaatgacagcagtaacatcattacataaatagtaattttccatatcattttttgtcttcaaattttttttaatttttgggatttgtattaaacttctgagaatatttttactagtagaaatcactgttttatttctcaaaattgctaaattattttgagaaactataattatatatttaaaatgtaagttaaatatatgcatatattagcactctatgtatatgtatactaaatatacacacaagtatgtatactatagataaactttcttgtattcttatgtatatgtacacaagaaaaggaacatttctaattgatattttacaagccttctttttttctttttttcccctctataaatagcctgaagacatgtttgtttgtgatataaatgaaaaggacataagtggaccttcgccatcgaagaagctaaaaaaaagccagtgtactcctcttttcatgaatgcttacacaatgagaggtatgcagaaaatatattcaacataaagaatatttgcagagtaggctcctctaaataatggtaattattatttcagttaacatttcttggatacccaccatgtgcaagaacttgaagtgcatgaacttactcagttctcacatcaacctatgaggaaggtccattattccacttaccctcctgcctactaccaacttattccatgccaggaaaaataagcccataaccatatgtaaatataagtataactatatggactttttttctttaaaagctataattcagtcttcattgagcatgcggctttcttcttcctccttcaggagcaggtgcagtgattcatacccactctaaagctgctgtgatggccacacttctctttccaggacgggagtttaaaattacacatcaagagatgataaaaggaataaagaaatgtacttccggagggtattataggtatttttttttcctttttcttaaataatttgaaaagaattcttccttctctttgataaatagaatactgatcattttatgcatataatgagatgtcgtgggatctgtgttaaataatactccatttaatattacacttctagacctattctcatgacacgaatgggatgtcttccctcctctcccgcccctaccccagccatggtaaattattagtaatatgaataatgaaatgtttgtttaaactgaaaaaaatcttgactgagatctctatcatgatggaaagattatgttcctgtattgaggcagccaaagatatcttcaacttcactttgtcttcagaaatttgaccagtgactacagtttatacttcatggtgatttaatttagtatttctggaatattttcatatttatgtaagtttttttaataaagtagatctctatatttttagaatttttcagtgtttaaggtgaaatggatagtaagtatagattaccattctagatcagtttaaataaattcatcagtccacaaaagtgtagtaattcttcataattctagaatataacggcaggaagaaacatgttctcagtgttcagggacaagctaagcatttcatttgagtttattagcattctcattcctgaaccttcactcttaatttcctaaagggcttgattctaccttgccttgtttagaggaaaacggtgccagttttactaaagtgttattaccacaatatcatattcttactgcatgtaatggaatgtgcatgtttaaactagtgcactgagaaattgatttgatttcagttaatatttattgtgtgcttaaagcattcctcaggactgtgaaacacctgtttacaaaagttaaatatttaaattaagagaagtgtacatactgaggaaagtagagccccagattgcctcttccatatctggggctgaaggagaggccttatgggtactatcagtttcatatgaatgttattgttttggtgaggaaataaaaataggtcagaagaatcagtttttctgaaaagagtttggaaaaagtaaggtagaggaacagggcataagagagagtctttgcaattttgtggagaggccaagcatggtggccctttgcaattctgttggagtctagctgggaaatgagtaatagagtcattaacacagctcaggaggcagtgttattttatctgaatttgaagagaatcctgagtctaatcaaaagaaaggcaatgaaagctggatgaggtaagaaaggatggagtttaaaattctctactgtatttttttaagtttatcttttatataaagaacagctttaaaatacagtcacttgtcactgtggatggggatatgttctgcgaaatgtgtcactaggtgatttcatcattgtgtgaacagcagagtgcatacacaaacctaaatggtatagcctactgcacacccagggtatatggtatagcctaatgctcctaggctacaagcctgcatagcaggttactgtacaaagtactgtaggcaattgcaacacaatggtaggtatttgtgtatctaaacatagaaaaggtttggtaaaaaaaaaatatgatgtaaaaggtaaaaagtggcacacctgtctaaggccctgaccatgaacggagcttgcagaactggaagttgttctgggtgaataagtgagtgagtggtgagtaaatgtgaaggcctaggacattacactactatagactttataagcattgtatgtttaggctacacgaaatttattgaaaacatttcttaataataacctcagcttactgtaacttttttagtttatcaagcttttactttttttttttaacttttggactcttgtaatagtaccttaaaacacacattgtacagctatacaaaaatattttctttatatctttattctataagcttttttctattttaattttttttaactttttaaattttttttgttaaaatctgagacacaaacacatatattagcctaggagtacacagggtcagggtcatcaatatcactgccttccacctccacaccttgtctcagtggaaggtcttcaggggcaagtaacatgcatggagctgtcatctcctgtgataactaacagtgccttcttccggaatacctcctgaaggacctgcccgaggctgctttacagttaactttttaaaaaccatataagtagaaggagtacaccctaaaatagtgttttaaaattatagagtaataaatacataaactactaacatagtcattatcatcacgtattacatactgtaataattgtatgtgctgtacttttatacagctagcagcacagtaggtttgtttacaccagcatcaccacagacatttgcataatatgttgtgctgtgaccctatgacagctatgcggtcattaggcgataggagttgttgagagccaaaaaggccaaagggatcgtgatcaactcagcattccactggaggctatatgatcaaacagcaaactgtttatcatgaatgcaggatgtgagcaaactcacactgcgcctgccaccaaaaggtttgctgagggacatcactccctggcaccgggctccttgaagttatccattgagaaatctagagcctattgttcaaaggatgcagtcttgcaagcctgctgtgaaccaaagtggccgactgacaattgcccgacaattgccccccatttctcgttatctcttttaccaataaatacggagggctgtgtacagctcggggcccttgtccactagaggcaaggtgcccccgacctcttcttccaaacgtactctcttgtttttatcttttattcccacgttcgccccctttgttcagtccaccaggtctgtgcaggtataatggagtttttcagctccattataatcttataggaccaccatcatatctgtggtctgacattgatgtatatgtatatacctatatatgtgtatatatatacctttatatgtatagttatatgtatatatatacacctatatatgtatagttatatatacatgtataactatacatatataatatacatatatagttatataggtatatatatacatatatagttatacatgtatacctatacatatataggtatacattatataggtatatataatatatataatatacatgtatactatgtatacatatattatagttgtataatgtatacatatacataactttatattataattgtactccctttcagaagcaatgtctctatggtacagtgaaaacaatactctttgagggtcaaagggctatcctggctctctttctcatttaacttgtctggatcagtgtcatgtttgtaaagtgggaggactggcttgaattcgctttcagttcttactttgctgtgaaattattttgctcctgaaaatatttctgactattgagtgcatgctagagaaaaatatgtttatggttctctcggccaatattaggaaagatttgagactagcaattcattccttcaatatttaaggatacttttttcttttttttttgagactaagtctggctctgtcgccaaggctagagtgtagtgtctcgatcttgtcttatgcaacctccgcctcccaggctcaagccattctctcacctcagtcttccgagtaggtgggactacaggcatgcaccaccatacctggctgatttttgtattttttgtacagatggggtttcaccatgttggccaggctggttttaaattcatgagctcaaacagtccatctgccttggcttcccaaagtgctgggattatagctatgagccaatgcacctagccatagttaaggatagtctataattacctctgttttacttaagtgaagtgatgggcaactctatactcttaatgataatggttggccaagttatcagtcacatgatgactacttagtctgtgcttgccctacagtagcaattgcagaatactttagctagaacttttttttttaagtttttagcactatagaagtagtgaaaaagcagatgttacattaacaaaacaagagaaattcatgtaaaaaggaaagcttatctgagtttttgcaagaatagacttaattttgccagtgacaattatgtgtttaaatattacattctgatttcatcacatgtatttcctgagaggacagtggaagtaaaagaagttctaatgctacagatttgagaatgttctgaaagcgtcgtacctttaagagttatctccagaacattcttgctgtcctagtgccacaaaccatgcttgtgttttttgatttgcctatctcagatactttgggattctgcagaaatgaaatacagtgattttgtattaattgggaaattcttaatatataattcaatttttaatcttttctatgcttctgattctgaaatatatcatttgccatctccttgtataaatattatgattgtccctgcttcaaggaaacatttatatgatcttgatgatttctttgttaggttttggtatattttacaaatttccaccacttaggcttaggattagaccaagcctgccacattcccaaggtaccttttgatagagatgtttatacaaggtacacagaataacacgcaacatcctgttcataatttggagtggcttttcagacacaaacagcatgtctaactggttacttgaaaaaattacatgttgtatacatatcaatgcttgatttgttttaatggaaaaaaatggcttgttttgtcttacagatatgatgatatgttagtggtacccattattgagaatacacctgaggagaaagacctcaaagatagaatggctcatgcaatgaatgaatacccagactcctgtgcagtactggtcagacgtcatggagtatatgtgtggggggaaacatgggagaaggccaaaaccatgtgagtgtaaatcagagaacatggggaacaagttaccacccgctaaatgtgaaggaaaacaaagtatgtcagttggtttaaatttaaattgtttatcattatttgtagatactttatttttattatgtatccattcatgaagaagtattgattggatgagctgttgtttggcaaggctctaggaatgttgatagaggaagaagacacagatcccaagttacaaaagttctatttcagaaagtgacatctagtttaaaaaaaatgtaaatttatgtaggcagtatattttaaactctcttttatttcctgagaggtatgtaatattgttgcatgacttaatatgattcctttctgtgttttaaaaatgttgagggaaaaatagaattttggcctagaattgagagaaaatacatactaggaacaaagcagagttaactgcaagagaggagaaatgtgattctttaggattggagaactctgtttcgataaacactggttctttttgctttttcttttacaggtgtgagtgttatgactatttatttgatattgccgtatcaatgaagaaagtaggacttgatccttcacagctcccagttggagaaaatggaattgtctaagccaaaagaaagtctaattatatacagagataaagctaaacgtaattattatttaaatgaaagctatttttttaaatgaattgaaatttttcatgatgctactaatttgccactaaatactgcaaatggtcaccctgaatctcttctgacattggatgttatttgcttatattcttataattttaaatgagggcacagtgaaatgaaaattttatactctatgtttctgtttatttttaaatccttaacagcaaaatatttgcctttaatttcttttttatatatactctcagagaattcctcttaatttttaaagatgctggtgataataaaattcattagaaaatttcctcattgtggaatgagcattctcttgttttaatgttggtgtcagaaaataaatatgaaacattaagtcc

SEQ ID NO: 38431 - DNA, 56286 bp, Homo sapiens
gcgtcctgggccacgcctcccggcgcaccgacgcgcctctccggttactaagcggccttggatacctggccgcgggatgctgggcggcgtcaggtgagcggtggtcgctgggcctcaggtaaagggcgccaacagtggtgggccggctggggcgttggtgcggcctgggagctggcgagggactcgccgcactcttcgaggccgctgggccggtcatagaacatccagggtcccccggggtgaagtaaactgtgggcgcggacgtagcccgggttcctggcgccccggctgggcgcccatctccacggcctcgggtggtgcaggtgtttagtcgttccgctgactatgaaagagcatgggacgaggaatcgtacagtcttaatctctcttctgtcgtggctgcgacccctcggtattcatgtgggaaaatactgatttgactggtaatgttattgaagagaaagcgagagaatggtttggcagcgttacccaaatatttgttatttttatagttttaaaggccttatactattattaaggaaatgcatttctggctaagtctgacagtacaggaacgcagacctgctactctcaccaggggctgaactaacagaacaaaaaaagatagatgtatcacggtggtgggaccatggagggggcagtttttcaactggacaaaatgatgttaaagtgcttaaagaaggataaatatgtgaaagtagccaggaaaattctaaaattaatgctaataagggagattagctctccagaaccaccagatattataacataaaggtatagcaattaaactagcatagaagatgggtgcagcagtgtgggcccgtagtcctggctacttggtaggctgaggcggcaggatcccttgagcccaggagtcagagaccagcatgggtatcaaaaggaaaccctgtctctgaaaataaataaattaatttaaaaagtttgggactcagcaggagcttacaggtagataaaatatattagaactcagaataagagcgatttatatatagggatttattatataggcgaggtggtactgtatttcaaatcagcattgaagagatgaattggggtcaggcagcttttttagcaatttagaaaataattaaaccagtcgagcgaggtggctcacacctgtaatcccagcactttgggaggccaaagcgggtggatcacttgaggtcaggagttccagaccagcctggccaacctggtgaaacaccgtctctactatggcgcgcgcctgtaatcccagctactggggaggctgaggcaggagaattgcttgaacttgggaggcggaggttgcagcgagccgagattgcaccactgcactccagcctgggtgacagagcaagactatgctttgaaaaagaaggaaaaaaaaaaggaatgaagcccattttgagcaccacaataatttccaaatggactaaaatttaaatgttaaaaaattacatcacgaattagccgggtgtgtttgggcgcctgtagtcccagccgcttgggaggctgaggcacgagaatctcttgaatctgggaggcagaggttgtggtgagccgagatcgtgccactgcactccagcttaggccacagagcagactctctcaaaaaaaaaaaaaaattacatcatgaagtactgaagtaaagcattgttgaatttatttataatcttagaatgacaaaaaactcttctaagtgtttcatgtcatccagaagccaggaaggaaaagattcatacttttaactctataaaatttaaaatctatatggcctgcaaaattcaaccaaaccaaaaaaactaccagaagccaaataaacttatgaaaatgtttgtttaatgatcaattagaaaattatgaaacccgactgggtgcagtggctcatgccagtaaaccagcactttgggaggttgaggtaggaggatcacttgaggtcaggagttcaagggcaacatagcgagaccttgcttctacaaaaaatttaaaaattagctggacactggtgcgcgcctgtagtcccagctacccatgaggttgaagtgggatgattgcttgagcctgggaggtcaaggctacagtgagttgtgattgcagcactgcactcccagcctgggtcacagagtgggacttttatctcaaataataataataagaagaagtttttaaaaagaaaaatttaaagagaaaaatgatcaagagtacctggacaagaaaatcagaagaaatacaagtggcaaaaatctatagcaagagacaactatctcactaacttcaaagtggaaattaaaacagtaatgaggggggttttttggccctttattggcaaacatgacaaagactggaaataggattgtgtggaaacagaagggtgttagtggaaatataaatgagtataactttttggagggcaatttggaaatgatttactcagccattcaatagataagaatctctacaaatatgcaaattgcagaaaaacatgttgtttaacattgatgtttttagtattgttttagaaaatatttgataaaagatgtcagccagtagatgactggttaaataaattatggtagatccataaaatgaatactgtgtagctgtttttgttgttgttgttgtttaaagacagggtcttgctgtgttctccaggctggagtgcagagtggcgtgattgtggctcactgcagccttaacctcttgggctcaagcaatcctttcacctcagcctcccgaatagctgggactacagatatgtgccaccatgccctgctaattttttttgtagagatgtggttttatcatgttatccaggctggtctggaactgctgagctcaagcgatcctcccacctcagcctctcaaagtgctggagttacaggcgtgagccactgcacccagccctgtgtagctgtttaaaagaatatggtagatccatgtgtactgacaaagaaagatgtcaaatatacaaggttaggtgaaacaggtgtttcagaataatgcatatggtaagatcctatttcataaaataaaactgtaagttaatatatgtataaaaagaatctcgagctgggtgcagtggctcacacctgtaatcccagcactttgggaggccaaggcaggtggatcatgaggtcaggagtttgagaccagcctgaccaacatggtgaaaccccgtctctactgaaaatacaaaaattagctgggcatggtgacacgtgcctgtaatcctggcaactcaggaggctgaggcaggagaatcgcttgaacccgggagatggaggttgcagtgagccaagatcacaccattgcactccaacctgggagacagagcaagactccgtctcaaaaaaaagaaaaatagaatctagaagactataccctgcgcttaacagtagttagcagtaatgaatcaggatggaaacatggtcttgggacacaagagcagggtgatggcagggcagagccataggtgtaggctgttgggaggatctgggcaagaggcagaaagcaaaagcgggtaggggagggctgggttggttttggtcttaggtttctgtgctatgcttttgcatttcactctcaacctttgagaattgtaggagtttcctagataggtttcagttgtataccctttcttgataaattagtagtagaaggcaactatttattacttttagggtctttggaatattgtttattgattttctgatcccatctttcttccataaggtaaccatggagaaagagctgcggagcaccattcttttcaatgcctacaaaaaggagatatttaccaccaacaatggctacaaatccatgcagaaaaaacttcggagtaattggaagattcagaggtgactgaccatgtatattgttttcccttctaaatgatattgtcctgctgataaagctgagaagtctttattttcttaggtaacatagattgtttaggtgggagaagctcaatttaaagattattcagaattaggtctggcgtggtggctcacacctgtaatcccagcagtttgggaggctgaggcgggcggatcacgaggtcaagagatcaagactggccggcacggtggctgacacctgtaatcccagcactttgggaggccaaggcgggtggatcatgaggtcatgggttcgagacaagcctggacaagatggtgaaaccccatcgctactaaaaattaaaaaaaaaattagcgaagtgtggtggtgggcgcctgtaatcccagctccttgggaggctgaagcagagaattgcttgaacccgggaggcagaggttgcagtgagccgagattgtgccactgcgctccagcctgggcaacagagtgagactccgtctcaaaaaaaaaaaaaaaaaaaaaagaaagatcaagaccatcctggccaacatggcgaaaccctgtctctactaaaaatacaaaaatcagctgggcatgatcgtgcgtgcctatggtcccagctgctcgggaggctgaggcaggagaatcgcttaaatccaggaggcggaggttacagtaagccgagattgcgccactgcactccagcttggtgacagagcgagactctgtctaaaaaaataaaaaaacattattcagaatgaaataaattcttattaaaacgtctcttgggcaggacgcggtggctcatgcctgtaatcccagcactttgggaggctgaagcaggcagatcactagaggtcaagagttggcgaccagcctggcctacatggcaaaacctcatctctactgaaaatacaaaaattagccagacatgatggtgcatgcctataatcccagctactaaggaggctgaggcacaagaatcccttgaacccaggaagtgaatgcctgcagtgagccgagatcatgccactgcactccagcctgggaaacagagggagactctgtcaaaaacaaaaattaaaaaaaaaatgtctttcgaaatcagcaattaggatattattaaagcagcatattattaagttgttttccaaatcacaagccaaaagattattctaattatacacatgtagctttttaagatgttagaggctttcttcatattttgactcaggtcagtactagggaaaggaaacatgagaattaaatgagaataactttgtgtatgtgcatgtttttcttaataggtgaggatatgtaatcatacaagctaatggtagggctgattgaattagtagttgcagacttccttatgctttagcatggcttgatttgaacaccttgacttactggaagtatttgaacagaggccagatgactctggggcaggcctgtagagggaattctcactttgggagagagactggaccagttacctctaaatcccttcatctctgagcctctgtggcctctgcttccaaatagttaagagactaaaataatacataaattggtttaaattatggacttcatatttgcttttaaaattgtatttccagcttaaaagatgaaatcacatctgagaagttaaatggagtgaaactgtggattacagctgggccaagggaaaaatttactgcagctgaggtaagaaatatccactaaagaaggaatatggtgaaatgattaggagtctgagctttgaaataccggatttgaatcccccttcaccacttactgtgtggccttaaggtagtcacttcatctctcttttcatcatggagttgtgatgattaactgagatactccatgtaaagtaccaaacacatagtgtgggccaattaaatattagccacacttctttttttttttttttttttttttgagacagagtctcgctctgtcgccgaggctggagtgcagtggcgcaatctcggctcactgcaacctccacctcccgggttcaagcaattctcactgcctcagcctcctgagtagctgggactacaggtgcccaccaccacgcccggctaatttttgtatttttggtgcagatggggtctcaccatattggccaggctggtctcaaactcctgaccttgtgatctgcctacctcagcctcccaaagtgctgggattacaggtgtgagccaccgagcccagccagtagccacatttctttgctatatttttgctttgaaaataggaaaattccgccaggcgcggtggctcacacctgtaatcccaacactttgggaggccgaggcaggcagatcacctgaggtcgggagttcaagaccaccctgaccaacatggagaaaccccgtctctactaaaaatacaaaattagccaggcgtggtggcgcattcctgtaatcccagctacatgagaggctgaggcaggagaatcgcttgaacctgggaggcggagcttgctgtgtgccaagatcgcgccatctcactccagcctgggcaacaagagcaaaactccatctcaaaaaaaaaaaaagaaagaaaataggaattcatttaaaataaaagtgtttattattctagttcatggaatggataaagaatgataaatgtaaggcccagaatacaaatgacaagtattggtgagaatgggaagttattggaacccttccacactgatggtgggaatgtaaaatgatgcagtcaccatgaaaaacagtatggtagttcctcaaaaatttaagcataaaattgccatatgatggctctgtgtggtggcccacgcctgtaatcccagcactttgggaggctgagaagggtggatcacttgaggtcaggagttcgagactagcctggccaacatggtgaaacctcatctctactaaaaatacaaaaattagccgggcgtgatggtgtgcgcctgtaatcccaactacttgggaggctgaggcaggagaatcacttgaacctgggaggcggagttgcagcgagcagagatcgggccactgcactccagcgttggcaacagagtgagactctttcaaaaaaaaaaaaaaaaaaaaactgccatatgatctagcaattccacttctgggtatatgcccaaaagaatggaaaaccagatctcagagatagttgcacacctatcttcctagcagcgctattcacaatagccaaaaggtggaaatagcccaagtatccatcggcagatgagtagataagatatggtatatacatacaatggaatattattcaatcttaaataggaaggtaattctgatacatgctacacatggatgaatcttgaggacattatgccaaacgaaaataaggcagacacaaaaagacaaatactgtatgatttcacttatgcaagcatgaggtacgtagagtagtcgaattcgtagagacagaaaatagaagggtggtggttgccagggcctgggggaggtggggaatggagcgttgctgcttaataggtatagagtttcagttttgcaagatgaaaacagttctgcagattgattgcctaacagtgtgagtatatttaatactgctgaactaggccaggtgcggtggctaacacctgtaatcccagcactttgggaggctgaggtgggtggatcacttgaggctaggagtttgagaccagcttggccaacatggtgaaacctcatctctactaaaaatacaaaaattagccgggcttggtggcacatgcttgtactcccagctacttgggaagtggaggtgggagaatcgcttgaacctgggaggcggaggttgcagtgagccgagattgcgccaccgcactccagcctggcgacagagaccctgtctgaaaagaaaaaacaaacaaacaaaaaactgctgaactatatacttcagaatggttaagatggtaaatttaggaaagattaggtgtgttttttcacagtcaataaaacaaaaaacccagaacatagaaagagccattttacagagaatgggaagtacctttgtgctgagagagaatatggggaatagagaggttgaggcagggcaaggccaatgtggtccttagattgaggcaggccaaggtctcctgctgttactctgggtggtgccatggggaagaggtccactggggagcatttctagtgcactttgtttctcaatttgattgcaaagtgaccttcccccgctgggaatggcatggagagggacatgattgtttgatcaggttaattgacagaaggagtagaaattaccattgggaatgtggaggtaaccagcaactcctacccactgagaccctgagggatatgtacacacagagggcagtggcctgcagagcaacactctattgcttgttgggcttcggctccatctccccatccacctagcgaagccaatgagagagttggcctgatgtttgccagggaccaaccagcctcaggaacacaggggcatccaaagagagggtcagaacctggtgcctgggccttttcccaagtggagatgggtgccaggccaagccttagtttgggcttccaggcatggtaggctgatgcatccaagagacacaagtccttcgagaggcaaatttgatgtaactttagcctaataaaacgtcctctcccagaccagtccctgacaccataccttctctttagagttggagtgaggtgggaagaaaagggaaaaaagctgttagctttttttctaggaatcagcattcctttgtgttacagttcttccaatgggctcatgcttgtgagatcactgctttccttgtcattgctgctggcctcctagactgttacccctggagagctgtgtgatgcctttttcatgttgacttccagaaacttctgtgacaggacagacatcatatgtctgatattagatgctagtatcatgctagaaactaggctgaacagtctttccttatttccacctcaactacattgacgcattacactagctttgtggtggtattcagttacgaccaggtaaccacgtggctgagacgagtattttccaaccctaacagaccagcatccacctatattacagatgccaactttgttaccctgaattgaaatgcaaagataatctaacccaccaccattaaaaaagtaaagcaatataacttcctaactttaatgtacagaaattaaaggatgatttataaaagaatatgtgtatttcaaattgtaaatgtttatgcatatatatactagaagaatatacatatttcagtttgttaatgcttggtcatacatgcattagaacacttctttatgtttgacattttgaaataaatgtttaataagtatgtagaactccgatgaatgggataggtacatatgcagactggtggaagtgatgtattggcaattcaaatcatgagccgtgttgctgtcggtgatgtgatttttccaaaatactgactaactcttggtaaagttctatttttttttttttttcctgagacggagtcttgctctgtcacccaggctggagtgcagtggagtgatctcagctcactgcaagctccgcctcccgggttcacgccattctcctgcctcagccttccgagtaggtggtactacaggtgcccaccaccacgcccggctaattttttgtatttttagtagagatggggtttcaccgtgttagccagggtgatctcgatctcctggccttgtgatccgcccgccttggcctctggtaaagttctgttaataaaaagagtataattcttctctcagtttacatggtagttgggtacctccgaattcagtatatgttaaatcgtgcaaaaaatactttgtacagtatttacatagaatttgagctgggcgcagtagcttactcctgtaatcccaggagtttgggaggccgaggcgggtggaacaccagacgtcaggagtttgagactagcctggccaacatggtgaaaccttgtctctactgaaaatacaaaaattagccaggtgtggtggcaggctcctgtagtcacaactactcaggaggctgaggcaggagaatcacttgaacccaggaggcgaagtttgcagtgagccgagatcgagccactgcagcatgggtgacagagcaagacttcatctcaaaaaaaataaagaaattggagttagattttaggctgagcttcttttgtttgtttgctttttcttttttaaacctccgtgactatctgagaagatattcaaatgctgtggaatagttctttactgtgtgggactggtctgaatattgcaggaccttaacttccctgcccttcacccgctaaaatgtccttaaacattaatattatggcattaatattttgccatattaatattaatattatggtgatccagaatacatgctagatggtttaaatgcctccactgagagccactggcctggatcatccagtctcgattacaggaaatacctcacatttgctgccacactaacagtgtgaatgcattctaagccaatttctaaaattcaagtctgcaaaattaatctttcttcctgtttttgccataaagaaataagaaacctccagtttgtaccaaatatccattcttttgttagaagggtctcacttacgtgtatagctggaaactgggtcataattcatgtaagctccttcaacttttgcccacctgtgttattgcacaccacatccttcatgtatctttttcttaaaatgccagatggccaataggacacagtagataccaataactactatatactcattgcatttaggcaacatggacaaatcccagaaccacataatcatgaaaaccaagtcccagtagaatttcccaagcaaaagctatgttctgagaatatatattgcaaactagacctggcttgctattatcagtcatagaacatagcatatatttagggctgtctgggaagaggagtttgagaggaaatcaaaaggaaggaaaaggaagatgaatttagggagagattcagtctgttgttcagggtccaggatcatgcagttataacccatttgttttgtttttctgttgttgttccaaaaaatgtttactaaggatctgttacacacctagtaacaggtcctaggactaacgctagggatcaaagtcaaatagcacatgatctctccactcaaggaaccgatagtctaggggaaatgacacaaatggaccatctaccaataatgatcaatgttctaagttccacatttctacagaaacacagaaaagaggcattggattattgggtccagaggaaatggactttgagctgatttttattttatttatttatttatttatttatttatttatttattttgagacagagtcttgctctgtcgccaggctggagtgcattggcgcattctcggctcattgcaacctccgcctcccaggttcaactgattctcctgcctcagcctcccgagtagcggggattacaggcatctgcccccacacctggctatttgtatttttagtagacacggggtttcaccatgttggccaggctggtctcgagctcctgacctcaagtgatccacccacctcagcctcccaaactgttgggattacaggcatgagccactgcaccccgccttaattttgattttgaaataattcattttttattttgttttgtttttttgttgtgtttcgtttttgagatggaatcttgctctgttgcccaggctggaatgcagtggtgcaatctcggctcactgcaacctccaccacctgggttcaagcaattcccctccctcaaccttccaagtagctggggctacgggtgcataccaccacgcctggctaatttttgcatttttagtagagacgggggtttcaccatgttggccaagctggtctcgaactcctcacctcaagtgatccgcctaccttggcctctgaagattcatttgttttatacagtgtggggaaggcagggggagaggaaaattcagggagcatacaagagcgagagggccgtgctgtggcaaatctagtctgggcagtagtttccaaagtaggatgcatgtgatgaatcagtggggtgccaaaaggaaattatgtttattattcatattttcattacccttaaaacatttcctttttgggagttgttttgaattataaagtacatattttatatagagatacatacatattgaatgtatttatatacatgttcagatttttttctgctggagtgcttgatgaagaaagttgagaaactatttgtctggaccacccaccccagattttctcaggctagaccagcaagatcaaccctagatttttctcccttccccagctttgtgaaaatgagagagcttccaggagataagcagaaaacatgcgtttctctctatggtttggttggtcaatgaccttgaacagaattcctcccaggtgtggtatgaaatgacttcatcctgatatcctctgtgggcagtcaagagaaggcattgtctaaatcagtggttcttaactaggggtgattctatttcttcttctcctgagggaacatgtggcaatctcaagagacatttttggttgccaggggaaggtaggtacaactggcatctagtaggtggagaccaggggtgctgctgaatggagaactgagtgcttcctttagttaagtttttcacttttgacttgctctctagatagtcagctttgaaattgtcaatttactttgagtattttggagctttatgctcaaagacaagcttggagatcctacatagagagtactttttatcttatatacatttatatgtaaatgccttatagatttgaaatatgtatttttcatctagttaaggtcttattcatggtatttcgggcaaaagtctttcaagtatattcatagattgcttttttcctttgtgtagtttgaaatcctgaagaaatatcttgacactggtggagatgtctttgtgatgctaggagaaggtggagaatccagatttgacaccaatattaactttttactagaagaatatggaatcatggttaataatggtaattagtattattattttcagtagaggcagtacttttctatctattatttgatatcatagccctctaggtccagtggcataatggaaaaagccctgggctgtgtgtgcgtgttttaatgttccattctcatcagcagtctgagcctcctaggcttgggctgcttccatttataaagcgagatggattggaaccaagttccagggtgcccttcaggtcaaaattggtatgagtctataatatcgaatttatttctaacctaaaatatacctccttctctttttccctcatagatgctgtggttagaaatgtatatcacaaatatttccatcctaaagaagctctagtttccagtggagtcttgaacaggtaagcatgttgaaagcagaaatatcttggcaaggcatcgtcgctcacacctgtaatcccagcactttgggaagccaaggtggatggatcattttgaggtcaggagttccaaaccagcctggccaacatggtgaaaccccatctccctgtctaaaaatacaaaaaaaattagccaggcattgtagcaggcgcctgtaatcccagctactcgggaggctgaggcaggagaatcacttgagcccgggaagcagaggttgcattgagctgagattgcaccattgtactctggcctggctgacagagcgagacttcatctcaaaaaaaaaataaagcagaaatatccttacacataactctcatttcttctacataaatcttccctcgtctcttctcatacattcttttcactgccctttcttctttcttgcctttttgttttgtgttattataatttattttactatattactactactcattcatcaaattatttttcttcatcttttgaaacttacttcacattcaatttattttttgtttatatatatatgtattttttgagacagagtcttgctctgttgctcaggctggaatgcagtggtgggaacacagttcactgcagccttgacctcccaggcttaagcaatcctcccaccttagcctcatacttgctgtactaatgaatgcagtgtgaaattctcaaattttttttgtttactagattttaatttttcttcttcaagggaaattagccgagctgcaggaaaggctgtgcctgggatcattgatgaggaaagcagtggaaacaatgcccagtgagtgtgttttctgatgccacatgaggaagatgtatcattttggagtcttctttttcaaaatgaaaagagcttttgtttctggttacaaaaataatcagaatttgaacagttcaagaggaaaaaagtagaagctctgcactgtaagtccatgctcctccccctgaaggtagtcttaatatagtatttaggcccagcatggtggctcacgcctgtaatcctagcacttttgggaggccgaggtgggtggcccacctgaggtcaggagttagagacaagtgtaaccaacatggcaaaatcccatctctactaaaaatacaaaaattagccaggcgtggtggtgtgcacctgtagtcccagctactcgggaggctgagacaggagaactgtttgaaccccggaggcggaagttgcagtgagccaagattacgccactgcactccagcctgggcaacagagcaagactccatctcaaaaaatatatagtatggtatttagatttctaggtttttttttttccatgtataaagttataggtgagtacctcttcatttttaatgactggattaaattggatatatcccagtttatctaaccaactccctattattggacatttaagtagtttataatgtttttctttaataataccacctaatgtttgtcaagcatcgactgtgtgacaggcatgtattacctcatttaatccttacaactctggaaagttagagatgagatacagagatgtaattgcccaaatgcacatgactactctgtgtcagaacttagatgcaaacataggcagtctattctagagcctgcactcttaacttctgttccgtattgttgttatagacaattttatagccgggtgtggtagctcactcctgtaattgcagcactttgggtggccaaggcgagtggatcacctgaggtcacgagtttgaaaccagcctggctaacatggcgaaaccccgtctttactaaaaatagaaaatttagctgtgcgtggtagtgggcgcctataatcccagctactggggaggttgaggcaggagaatcacttgaacctgggaggtggaggttgcattgagctgccatcgtaccattgcactctagcctgggggacagatggagacttcgtctaaaaaaaaaaaaattatatttgtcattatagataataaagcacaaatgaacatcttttttttttttttttttgagatggagtctcactctgtcacccaggctggagtgcagtggcatgatctcagctcactgcaacctccgcctcccaggttcaagtggttctcctgcctcagcctcccatgtagctgggattacaggcatctgccaccacacccagctaatttctctatttttagtagagatggggtttcaccatgttggtcaggctggtcttgaactcctgacctcaggtgatccacctgcctcggcctcccaaagtgctgggataagtgaacatctttgtatgtacagttttgtgcacttgtggtagtatttttttttttttaattgatcattcttgggtgtttctcgcagagggggatttggcagggtcataggacaatagtggagggaaggtcagcagataaacaagtgaacaaaggtctctggttttcctaggcagaggaccctgcagccttccgcagtgtttgtgtccctgggtacttgagattagggagtggtgatgactcttaacgagcatgctgccttcaggcatctgtttgacaaagcacatcttgcaccgcccttaatccatttaaccctgagtggacacagcacatgtttcagagagcacagggttgggggtaaggtcacagatcaacaggatcccaaggcagaatttttcttagtacagaacaaaatgaaaagtctcccgtgtctacttctttctacacagacacagcaaccatccgatttctcaatcttttccccacctttcccctctttctattccacaaaaccgccattgtcatcatggcccgttctcaatgagctgttgggtacacctcccagactgggtggttgccaggcagaggggctcctcacttcccagtaggggcagccgggcagaggcgcccctcacctcctggatggggcggctggccgggcggggggctgacccccccacctccctcccggacggggcggctggccgggcggggggctgacccccccacctccctcccggacggggcggctggcctggcgggggctgacccccacctccctcccggactgggtggctgccgggcggagacgctcctcacttcccagacagggtggctgccgggcggaggggctcctcacttctcagacggggcggctgccgggcggaggggctcctcacttctcagacagggcggctgggcagagacactcctcacctcccagacggggtcgtggccgggcagaggcgctcctcacatcccagacggggcggcgtggcagaggcgctccccacatctcagacgatgggcggccgggcagagatgctccgcacttcctaaatgggatggcatcctagatgggatggcggccgggcagagacgctcctcactttccagactgggcagccaggcagaggggctcctcacatcccagatgatgggcggccaggcagagacgctcctcacttcccagacggggtggcggccgggcagaggctgcactctcggcactttgggaggccaagacaggcggctgggaggtggaggttgtagcgagccgagatcacgccactgcactccagcctgggcaccgttgagcactgagtgaacaagactccgtctgcaatcccggcacctcgggaggccgaggctgggggatcactcgcggttaggagctggagaccagcccagccaacacagcgaaaccccgtctccaccaaaaaaaatacgaaaaccagacaggcgtggcggtgcgcgcctgcaatcacaggcactcggcaggctgaggcaggaaatcaggcagggaggttgcagtgagccgagatggcagcagtatagtccagcttcggctcggcatcagagggagaccgtggaaagagagggagagggagaccgtggggagagggagagggagagggagagggagtgggagtattttttagggtaaatttctcagcattgaaatttctgggtcagaggtcttccaacagatgggttaccaaatgtaatgtgttaccagatgtctctcagggaggtggtaccacttacagtccctatgagcacacacctttttcctctcttgccagcatggagtattctagtaaacatcgtatctctttcttttaatttgcatttttttaaattattagtgcataggatgacctttaaagtctattggctgattgtatttcttctgtgaacttcatgttcattgctttttggccatttttcaattgatggtttgtcttttcgcattcatttataatacctctgtactttgaaatattttacccagtaaaaattgacattcttatgtagttaaagcatgttacaaagttttagtagtgaaaataatgtggtccgggtaccgtggctcacccctataatcccaacactttgggaggctgaggcaggcagatcacttgagctcaggagttcaagaccagcttgggcaacatggcgaaaccctgtctttacaaaaaaatacaaaaatttagccggtcgttggtggctcgcacctgtattcccagctactcaggagactgaggctggagaattgcttgagcccaggaagcagaggtggcagtgagccgagattgcgccgctgcactccagcctgggtgacagatgagactctgtctcaaaaaatatgtaaataaaatgaaattaaaaaataaaataatgtgattggctgtgtgcagtggctcacacctataatcccagcactttgggaggtcgagatgggccaatgggttgaggctaagagttcaagaccagtctgggcaacatagtgggaccctgtctctacaaaaaaaaaaaaactgaaaattagccatatgtggtggcacacacccataggcccagctactctggaggctgaggcaagaggattgcttgaacccagaaggttgaggctgcagtgagccgtgatcatgccactgtactccagcctgggtgacagagcaagactatctcaaaaaaataataaaatgtggtcatagttcagaaatagttttaaaaaaataaataatacagattaaaattagaccaaaaacatatatggagggtggggattatttgtgtatagtaaaagtggcatttcaaatattagagatggatggcataattctgggtaaacatttggagaaatagtttcattttcataccacaccccaaaatgtattctggataggctaaaatttttaatattaaaaatgaaagcatatgccggacgcggtggctcacgcctgtaatcccaacactttgggaggccgaggtgggcggatcacctgagatcaggcgttcaagaccagcctgaccaacatggtgaaaccccatctatattaaaaaaaacaacaaaattagccaaggatggtggcgggcacctgtaatctcagctactcaggaagctgagacaggagaatcacttgaacctgggaggcggaggttgcatttagccgagatcacaccattgcactccggcctgggcaacaggagcgaaactccgtctcaaaaaaaaaaaaaaaaaaaaaaaattagcctgtcgtggtggtgcatgcctgtcatcccagctactcgggaggctgaggcaggagaattgcttgaacccaggaggcagaggttgccgtgagccaaaatcgcaccactgcactccagcctgggcaacagagcaagactccgtcttgaaaaaataaaataaaattaaattaaattaaattaaattttaaaagaaagcatagaagtacttaaagaagcccaggtacgatgactcatgcctgtaatcccagcattttgggagactgaggcaggcagatcacctgaggttaagagttcaggaccagcctggccaacccccatctctactaaaaaatacaaaacttagccagacgtggtggcacaagcctgtaatcccagttactcgggaggctgaggcaggagaattgcttgaacccgggaggcggagggtgcgatgagccgagattgcatcactgcactccagcctgggcgacagagcgagacaccaacgcaaaaaaaaaaaaaaaaaccttaaaaaaaataagtgaatattttaaattcttggagtagggaagacctttcttagtagaaacaaagtcaagtcataagggggaatatgtatagcaatataattcacagagttaatatttttgactgtcaagaatcaatctaggctgggcgcagtgactcacgcctgtaattccagcactttgggaggctgaggcaggcagatcacgaggtcaggagatcaggaccatcctggataacacgatgaaaccctgtctctactaaaaacaaaacaaaacaaaattagccaggcgtggtggcgggcacctgtagtcccaactactcgggaggctgaggcaggagaatggtgtgaacccgggaggcggagcttgcagtgagccgagatcacgccaccgcaatctagcctgggcgacagagcgagactccgtctcaaaaaaaaaagaaaaaaaaaaaggaatcaatctaattatttcactttgtgtcagcttatccaactggtataggtaaaagaactgtagacttggaattagaaggaattgttagaagttcctgattccctctcttacttgccaagggtgacccaaggcatagtaactgttagtgtctgtttccctatctgtgtagtggggataatgttaaccttacaaaattgttggaaaatttcagtaaggtgatatttgtgaaagtgctttgtaaagttgaaagcctagtgccctacttgttgttgcgttatgactttgtaattaattatagtgaagggaatatgtctagttgttcctttcctggattatccaggaaacagcttcctggtagactttgaggtatggactagtcctgcttcttgctttgaggtatctttgcctgttggagtctcagattctcctttatccttatttcctgttatgtcccttctcccttctctcactctgctgtagccacactgactttgtttcaatccttaaataagtgaagcttgtattcatcttagggactttacacaagctattccgtcttttaggaaaactctttctgaaacttttcactgagctaatcttattcattcacatggtttggaaagttctgttttggggatgggtgtttaagtttatacttagtcttatcaaaatgtcagtctttttttttttttttttttttttttttggagacagagtttcgcccaggctggagtgcaatggcaccatctcatctcactgcaacctccacctcctgggttcaagcaattctcctgactcccgagtagctgggattacaggtgcccgccaccacacccggctaagttttgtattttgagtagagacagggcttcaccatgttggccaggctggtcttgaactcctaacctcaggttagtctggcctagtctcattgatttttttagtagtaataaaagaaatacaggagtgtaaataatagcaaataggccggtcacagtggctcacacctgtaatcccagcagtttgggaggctgaggcgggtggatcacctgaggtcaggagtttgagactagcctgaccaacatggtgaaaccccatctttactaaaagtacaaaaagtagccgggcgtggtggtgcacacctgtaatcccagctgctcgggaggctgaggcaggggaattgcctgaacccaggaggcagaggttgcagtaagctgagatcacgccattgcactccagcctgggtgataagagcaaaactccatctcgaaaaataataataataataataatagcagatagtttttatcttgctactcaagtgtccgttctcccttatgccttgagaatcatcttccattgattgcattttgggaaaatgtgggggatagatgtgcattgacctccatatgactatttctcccacctactttttcttcctccatggacaactgcttgttttcttctgcttctggcccagagatcatgggctgtaatccaccttgctgggatactgctggagtaagggtagaaggtggagtttggagaatgtgggccaagtaccacttctctttcatagtatgacaacaaaagtcatagggtagatgagattttactgaaggaatggggaagattaacaccagagggaggccaggcccggtggtttatgcttgtaattccagcactttcggaggtcaaggtgggcggattgcctgagctcaggagttcaagaccagcctgggcaacatggtgaaaccccgtttctacaaaaaatataaaaattagtaggtgtggtggcatgcacctgtggtcccagctactcagggcactaaggcaagagaatcgcttcagcccaggagattgaggctgcagtgagccatgttcataccactgcactccagcctgggcaacaaagtgagatcctgtcttaaaaaacaaaacaaaacaaacaaaaacactagagggaaataattttaaacttaagccaaaaagaatttttgttgtctaaagaaaaagggaaattaaaatctctatgaggaacccctcatgggtgcttcccctataccccctcccccagtttctaaccttacgccctggtgttgagatctgtgtttctctccattctgagagcacttccttcaagctttgcagagctccatctttgagtaaaaccctaacccctcctacatgggttggcttcaccccagaatctgcaccccacctttgctcctctatcccacaccctctccaggagtacattgccccaggtcagaccaattcactctagataatctaagacaagtctttgttaggacagtggagagtagaggagggactccaaagcagatctgtgtagaagtgtccattatagcgtatatttatgcctctgttcatgtgacatttaactggtaacatacccatccagtgatatacattaattcttagagatagcactagccaaacctaaggaagaagaacgtatttaccagtaagatattattatgcagagcagcttgagttcagttcttggatgaggccccatcctcttcctcctccctccatcaggggcttctttagttctcccagttacagtcacttacactttcctgttaatttactttcatgttttttaaaatgctttattaaatgtgtagctagagttgtcccagtttttaagttaacaaaccaaagcttagaaaaaattttttgtttgataatgaatcaaagagtgttactcagctgagcaccgtggcacacgcctgtaatcccagcactttgggaggccaaggtgggcagatcacttgaggccaggagttcaagaccagcctggtcaacatggtaaaaccctggctctactaaaaatacaaaaattaactgggcgtgatagcaggcactgaggctgcagaacagcttaaacctgagaggcggaggttacagtgagccaagatcgcaccactgcactgcagcctgggtgactgagtgagactgtttcaaaaaagagtgttactcaagaaacattgagattattttcagaatttttgtattcatgtttttaaaatttgaatgtgtttctttaatttcttacagggctctcacctttgtgtatccttttggtgccacattgagtgtcatgaaaccagcagtggcggttctgtctacaggttctgtctgcttcccacttaacagacccattttggctttctatcactcaaaggtacagcttttcttagatatgggtatagatgttatttttattgttgaaataataaaaaccaccttaccatttccagaaggcttctatatgttttctcactggtcttcctgccagtcctgcaaagtagcatttcagctatatacattttgcttatggggaaacagtggattgtccagtaattgatgaagttaaggcctaaacctagctcttattattctaaacccgaagcttttccactgtagcatgaggctacctgtattataactttttttttttttttgagatggagtctctgttgcccaggctggagtgcagtggtgcaatctcggctcactgcaagctccacctcccgggttcacgccattctcctgcctcagcctcccgagtagctaagactacaggcacctaccaccacgcccagctaattttttgtatttttagtagagacagggtttcaccatgttagccaggatggtctcgatctcctgaccatcctgcctcgtggtccacccgccttggcctcccgaagtgctgtattataacttttaaaataacttttttttttttttgatcccatggcagcatattgatgaaaataacttttaatcctgtctgtgactatgggctgtcaccctcagtgtaaagagaatacattcaggaacagatggagttaacatattacacaaaatagcacagaattatgttgctgttagtttatactaggaaaatatatcagaaaactatttttccagttattatcctagagaccccatagaaatgtgggcacagctagtcccaggcagtgacccaacatcccactgcctttctttttctttttttttttttttttgagatggagtctcactctgttgtgcaggctggagtacagtggcatgatcttggctcactgcaacctccgcctaccaggttcaagcaattctcctgcctcagcctcccgagtagctgggattacaggtgcctgccaccaagcatggctaatttttgtatttttgggagagatggagtttcactatgttggccaggctgatctcgaactcctgacctcaagtgattcacccaccttggcttcccaaagtgctgggattacaggcatgagctctgttgcccaggctggagtgcagtggcgcaatcttggctcactgcaatctctgcctcccgcctcagccttccaagtagctgggattacaggcctgcaccaccacaccctgctaatttttgtattttaatagagatggggatttaccatgttgcccaggctggtcttaaacttctgagctcaggcaatcccccccacctcagcctcccaaagtgctgggattataggcatgagccactgtgcccagcccccactgcgttttaattcacattttgctgaatttaccttcatctgccccctaagacagaattcaccagctgatctcctaattttttttctagggacctaggtgtctctagctctgaacaatcctatttttctttgtggtacctaggaattacctttcccttcttatttaaaagctctcgggctgggcgtggtggctcacacctgcaatcccagcactttgggaggccaaggtgggtggatcacttgaggtcaggagtccaagaccagcttggccaacgtgatgaaaccccgtctctactaaaaatacaaaaattgaccaggcgtagtggctcacgcctgtaatcccagcactttgggaggccaaggcgggtggatcacgaggtcaggagattgagaccatcctggccaacatggtgaaaccccctctctactaaaattacaaaaattagctgggcgtggtgtggtggcacgcgcctgtaatcccagctactcaggaagctgaggcacgagaatcgcttgaacccaggaggttgcagtgagccgagattgtgccactgcactccagcctggaggcagagtgagactccgtctcaaagaaaaaaaaaatattgaaaaattagccaggcacggtggcaggctttgcagcatttgcttttaacctggtacaaatcagagggttttttttaccaattttttaaaaatgtatgtaatgtgtgtatttatgtctcttgacatctctggcttagtataattcttttcctggggaagttataactatgcctgttccctgtatgtgatgtagctaaaaaaaccgatttcattttgtatttttactattgaactggttttctcattacaaaagtaataatgtgctcattgttgggctgagcgtggtggctcacaactgtaatcccagcactttgggaggtcaaggcgggcaaatcacttgaggtcaggagttcgagactagcctggccaacatagtgaaaccttgtctctactaagaatacaaaaatattagcccagcatgatggtgagtgcctgtaatcccagctactccagagactgaggcaagagaatcacttgaaccctggaagcggaggttgcagtgagccaagatcatgccactgcactccagcctgggcagtggagcaagacactgtctccaaaaaaaaaaaaaaaaagtaatattgtagaaatgttacaataattgtagaaaaaatgaacaatacagagataaagcaaaagaaaaaaaattcccccatcgcactactccaagactctaagacagcccaggttgacatattattcactttctcctacttttgctttgccttatttttatttatttgcctcgtaagctttaaagtagaatagcaatataatttatagtataggtcaggcatggtgactcatgcctataatcttagcactttgggaggttaaggaggtaggatcacttgaggccaggagtttgataccagccttggcaacatagtaagacctgtctctacgaaaaagttagctgagtgtggtgttatgctcctgtagtcctggctacttgggaggctgaggcaggaggatcacttgaacccaggagttcgaggctgcagtgagccatgattgtgccactgcactccagcctgggagacagagtgagaccctatctctaaaaatgggaaaaaaattatagtatactttttttttaaccgaatgatgtgttggaagcattttcccatgttactgaaaaccctttataatatgaaatttaactgctgaagaaggttgcatcattctgaattacttttttgtgaacatttggatttatttctaattttttgtgactataactacacaactgggcatagaattttttatgtttcagactgcttttgttgcatatgttaatagtttcagcaacaatgtgtgaaagaacttatttcactaaaattcgactagcgctgtttatatcatattttcatatttatttatctgataggaaaaagtactttgtttttatttgttaaaagttacaagtattgaaaatttttcttattaaccagtcattattttatgactctctcatgcttgtgccttagttttctggttttttttttttgagacggagtctcactctgtcgcccaggctggggtgcagtggtgcgatcttgcttcactgcaacctccgcttcccagattcaagtgattctcatgcctcagcttcctgagtagttgggattacaggcatgcaccaccatgcctgactaatttttgtatttttaatagagacggagtttggccatcttggccagcctggtctcgaactcctggcctcaagtgatccacccgcctcggcctcttaaaatgctgggattacaggcatgagccactgcgcccagccttgccttagctttctttgagactgagtcttactctgttgcccaggctggagtgcagtggcgcgatctcagctcgctgcaacctcgcctcccaggttcaagcaatcctcccgccacagcctcccaggtagctgtgggagtacaggtgcgtgccaccaaccctagctaatttttgtatttctagtagagacagggttttgcctcccatgttagctaggctggtcttgaactactgatctcagggtgatctgcccaccttggcctcccaaagtgctgggattacaggcgtgagccactgcactcagcctgctttagctttctatttggatcttacttaaatacttttttttttggtacccataggtatctttaattgtacagactgtctttgagtttatcttttttccctttaaaattatgatcttcgtttataagataaacaacaataggaaaatgctgtagaatcaatttaatttttttttttttttttaatttttagagacagggtttcccaggctggagtgcatggtgcagtcatagctcattgtaacctcgagctcctgggctcaagtgattctcctgccccagcttcccaagtagctaggactacaggtatgcctcaccacacccagctaatgtagaattaatttatgttagttttcgttaaagccaaataaaaaaatatagaagtatctaaaatgagaggcaggttaaagtgtagtagttattatagttggtctttcttttttttgttttttgagatggagtctcgctctgttgcccaggctggagtacagtggcgcgatctcagctcactgcaacctccgcctcctaagttcaagcgatttccctgcctcagcctcccgagtagctgggactacaggcgcatgccaccacacctggctgatttttttttatttttagtagagacggggtttcaccatgttggccaggctggttttgaactctcaacctcaggtgatccgcctgcctcggcctcccaaagtgctgggattacaggctgatccactgcgcctggcctatagttggtatttctaaactttaaaatctgggtgtgaattggcactcttcagtatataagacagttgctagcatgattctaataagtgtctgggtactaggatacatgagatgcactttcggatttgagtatctgaccctgctttgtcatcaatagaaccaaggtgggaagctggcagtgcttggttcatgtcacatgttcagtgatcaatatttggacaaagaagaaaacagcaaaatcatggtaagctttttcttttgtcatattaatatacaatgtgtattattttcatgtcatttaaaaaaatactggtaagtttatttgctcatttaaaagcagctactcagaacccattatatgccaggcactgagaatacaaagtcgagtcaggcatagtcccagtccctgctttggaaaagtttgtaatacactgagagagagagagacaaattagtaaacccagaagggtgtttctgagcatgtcaggtggggtgggagctgagcctggagaagcggagaggaacaggctcaatagcagtatcacgtgtaaggccaaggagcttgaacttgatgctgaaagccacagggagcccttgggttttcagcagccttgagcatagccagatctgtgtttcttctttttttgttgttgttgtttatgaaagaacttctagaatgttttggaaagattcttctgtcagttgtgtggaaagtggaaaggaggaggcagcctagagccaattaggaaggtggtggtgtcaccaggcaaggagaaatggggacctgaattacgggagtcaaggtgtgagtggagaggaggggctggtaggaatgggaattaggaaaggctctgtagaggactactcactgactgatgtggcaaataaagtaaaggcattgcaattttgtcaaaaaaatgccaagggaacatgtcttacggaagatggcagagtagggaagcacatgtctgtacagcatgtgccagagctgtccattggtgattccagtgagagaaagaaacgccttataattgttatattgggagattgataaagatcttatttctgtggaatttacatgaagtttcaatgtctctagacacattatgggagatctagatattctacttttttttttttttttttttttttgacatggagtctctgtctgtcacccaggctggagtgcaatggcaccacctcagctcactgcaaccatcgcctcacgggttcaagcgattctcctgcctcagcctcctgagtagctgggattataggtgtgcgccaccacaccaggctaatttttgtatttttagtagagatgaggtttcactatgttggccaggctggtctcgaactcctgacttcaggtgatccacctgcctcagcctcccaaagtgctgggattacagcttgagccaccactcccggcctaggtattcttcttttcaaaagttttaatttcagactgtcatcacagtaaatagggattaattcaggattgtgaacaaaggttaataaattttagcttgtggttagaggttagggtgcttaaagatacattataaatttctgataataaaagttgcattatgctggtcatggcagctcatgcctgtaatcctactactttgggaggccgagacaggtggatcacctgcgatcaagaattcgaggccagcctgaccaacatggtgaaaccccatctactaaaaatacaaaaatcaaccaggcctggtggcaggcacctgtaatcccagctcctcaggaggctgagacaggagaatcgcttgaacccaggaggtggaggttgcagtgagccaagattgcgccaccgcactctaaccagggcgacggagcgagactctgtctcaaaaataaaaggtgcattagggtgaagaaaacctttgagttctcatatgattgcatcaagacaaggctggctacccttttctgaatcactggtttaatctttcttcctttatcattcttcttgatttaattctctagtcctgaccttcagctttttcaaataaccaactgtcctaattatatacttttttttttaatttaggatgttgttttccagtggctcacgacaggagacatccacctaaaccagattgatgctgaggacccagaggtagacaccgaattattagaaacttttaaatgaaaaatgagtccagcttctcagtaccacttctcacagctcaaaaggaatacatgactgtcttaactcatctgtaagacagatggaacgaaggaatgatttgggggagatgaaggccatattgtaaaaaataagtcaataaacaatatatgtaattaatcatagaattaattggagggggagcatacatacatacagtatgtatataaattagaatttaaattatgggcactctggcccagactttcaaaatgagcatctgcagaaaaatacttttttcagaaatctgaaattttctcataaagaaacaaagagtatcagaatttatgttgtaaactataattttgttgcctttagatttaacagttctaaaggcattataataatattcatcagacaagggaaagtggtgaaaccagcacagtgaaatcaccaccggctcttggaccttatacaggttctttctgaccatttttcatcctagttttctttattaaaaaaattttttattgtatttattttttgagatggagtctcgctctgtcgcccaaggctgtagtgtagtggcacaatctcagctcactgcaacctctgtctcctgggtccaagcgatccttctgcctcagcctcctgagtagctgggattacagatgtgaaccaccatgcctggctaatttttgtatttttagtagaggcagggtttcaccattttggctaggctggtctcaaactcctgacctcaagtgatccacctgtctcagcttcccaaagttctgggattacaggcgtgagccactgggcccagccttctagttttcttatctgtgaacagggaacactaatacccgtgttctctgcctcacaggatggttgtgtgggctaagttaatagatggtaatgtgtcaggcattgtatgccatatacttccacataagtcatcttatttaatcctcataactgccctgggaggcacatggtcttattctcattttatagatgaggaaactgaaatccttcaagattgcagtgtgttcaaatggcaggcaagtgcagagccaggatccaaatccaggtctcctaattcaaactgcacttactctacaattgtttctctatttcttaaactctgaaatgtcaggaaaatgatttcctggccattggtcataggaggtaggtgagaagacagtcgaagatggctgtccactgactgcttcctccctcactagggacatggcttctcagagactgatttgggttaggaaacaggagagctgcatgtctaaaatatttccttatgtggaaacattaagcatgtggatattttgcttcattatttaagtgtaatatatttaaccactctcggccgggcgcggtggctcacgcctgtaatcccagcactttgggaggccgaggcgggcggatcacgaggtcaggagatggagaccatcctggctcacacagtgaaaccccatttctactaaaaatacaaaaaaaaaaattagccgggcatggtggcaggcacctgtagtcccagctactcgggaggctgaggcgggagaatggcatgaacgcaggaggcagagcttgcagtgagccaagagcatgccactgcactccagcctgggcgacagagcgagactcgtctcaaaaaaaataaattttttatacatatatatattctatatttatatttatatatattttatatgtaaatataaatatatacatattttatgtaaatataaatatatacatatttttatgtaaatataaatatatacatatttttatgtaaatataaatatatacaaattgtgtgtaaatataaatatatacatatttttatatgtaaatataaatatatacatatttttatgtgtaaatataaatatatacatatatttaaccactctcctgttggcaggcatttatgttttcctggtcttttactagtccacagcatgtgtcatgactgagggctctcagcaatgctggagggatgtccttggctaggggagaaggactgggatctagtgtagcagtggaggaactgtctgtactggtgtcacaggtgctctggcatgtatcaggaggaaagaagcagatagggcctggatgctagggggtgggcacatgttatggtgggagcttgtggactttctttcatgatttcctctattttcttactaaaatagaaaataaggtcattgctaaaatggtgaaagggaaaaccaatttttttgttttgagacaaagtcttactgtgtcacccaggctggtgtgcagtggtttgatcacggctcactgcagtgttgacctcctggactcaggtgatcctcccacctcagcctcctaaatagctgagactacaggcacacaccaccatgctcagctaaatttttttgtatttctgtagtgacagggttttgccatattgcccaggctgatctccaactcctgggctcaagcgatccactcacctcagcctcccaaagtgttgtaggtgtgagccactgcacccagctgggaaaatcattttgatggctgaactgacaaaagggaattattgtctagaagaatgggaaagtgagtagactacggagatgtagttgattgctgagcgctcaagatcagagatcatgaaattaaaagaccagttgatagggttgtatgtttctccagctgttttcagccatgtgagtactggtgtaattggagatttggatttagccagtactggggtttagccaagtgagttttgttcctctttgcacataaattggcttatttaaggtttagtgtcagtgatcatgaacagtaaaatttcttggcaagagaatataaatgttgcagatttagacctgagacagtggagacttgacagaataaatgcttgctcttgctgtgctaaaaggaaccctcttgtggctttcagatttctgactacatgatgctgccctacacagccaccctatcaaagcggaatcgagagtgtctccaggagagtgatgagatcccaagggactttaccaccctcttcgacctgtccatcttccagctggataccacctccttccacagcgtcatcgagtcagtacctgtgggcctctgagccacactgcactccattctgagtgtttggtttggaaacatgaacctgggaacgggaattagggtcacagtaaatgtggcatgcagaacatgttctcagatctatgatgaggtcaacaaagaaactgggctgggcatgaggggttgatgtagaggaactgccagaggttattagcccctgcgtgttccagattctggaccaggcatttagcctgaccagcttgtttcattttgccccagacttctggttttagcacagagagtcccaagtcccaggaaaatggagtcccaagtccctcagtaaatggagatggtggtcacctcatttctctctgggtatctgggcaactggtaatgctattaactggcacttagaatgcaggaaaaggaatgataaatgggctgtgttctgggcactctcagtctagtgcggatgtgcaggtggaactacaagtttaaagatgaaaagatctgtaaagccgttagggaagccgtgggatgggatgaggacatcagggacagcacaagaatgggaattggccttgagacaggacctcacagctgtcagtgcttgagaggcaggagaagaagagggccaaagacagaagctggggaaaagcagttaaaagtacaggacagcgggcagcatcctgaaggcaaaggaggaggaaatgacacagaagcagaggggttcagaaagggccagggctcatcttcactgtttctaacctgaattttgctcagggagaaaattgtttagcttgtcttcctttctcacccccgtgtatccggagagcaagagccatgtcttatcaacctggaatcctcattgcctaagacccagagcccagcacatcctgggcatttgggggatgtttgtgaaattagcatgctgccattctccttgtgccttgcttatacatccactcagcaagtatttgtggcacaactacttttccaggatcttgggatgcttcagggacctcaataatgaaaatctttgcccttttgaagtttattatctagcaaaacagacaggcatcaagacatttctatatgtgtgatgtaaattaaagaatatgttagaagatgattacatacgtcaagcagagtactggggtaggggagtgccaggcacattgcattttaaatagggtgttcaggccaggcgtggtggctcacacctgtaatcctagcactttgggaggccaagatgggaagatcgcgaggtcaggcgttcgagaccagcctggccaacatggcgaaaccccgtctctactaaaaatacaaaaattagctgggcacgatggtgggcacctgtaatcccagctactcaaaggctgaggcaggagaatcgtttgaacccagaaggcagagatggcggtgagtcaagatcataccattgcactccagcctgggtgacgggaagactccatctcaaaaaaaaaaatagggtgatcaggatggcttcattgaaaaggttagatatttgaggaaaaacctgaaggaggtaaagaatttagccttgtggctatctgagggaagagtattctgggcagaggaaacagccagtcctaagactgcaagacggaggaatgcctgatacattcaaggaagagcaacaaggccatcgtggccactgcagagtgagtaggggtgagaatggtgggagatcaggcctggcctacttttttgcctctgtaaggacttccttggctttcactctgggtgaaaagaggagccactgagagttctgagcagaggtatggcataatgacttccttatatcccgaacgtcaaggagcaagaatggaggtagggcctgaagggagcggtcacagtaactcaggcatgagttacttgggaggctgaggtgggaggattgcttgggccccaaaggttaaggctgcagtgacccgctccagcctggtcaacagagagagatcttgtctccggaaaaaaaaaaaaaaaaaaaaagttgcaataactgagttgagaaagactgcgagtagattttgcaggaagagcagaagttcagtttgaggtatatggagttgagatgtcaattaggtatccagatgatgtttagtagcagttttatattttaacctggtggtcagaagagatctctgagctgcacatttaatttgggagtttgggggcacatctgtacttcatctaaagcatacatcttttcctttttttttttttttggagacagaatttcactgtttttgcccaagctggagtgcagtggcgcaatctctgctcactgcgacctctgcctcccaggctcaagcaattctcctgcctgagcctcctgagtagcaccaccatgcccagctatttttgtatttttagtagagtcggggtttcaccatgttggccaggctggtctcgaactcctaacctcaggtgatccacctacctcggcctcccaaagtgctgggattaaaggcatgagccacagcacctggacctattttcaaatctataaaatcaggatgaatcttttttcttattttttgcctttttttctttcttttcctttttttctgtttttcaggatgaatcttaacaatagatgatgtatgagtttaattagcattttttttctttcaatggaccataaattatgatgcatcttacctttggtggattcttagatttgatgaaatatggtagatagtatgtaaagccatgtgactggatgagctcacaaagtgttaaaagtgttgatagagaagaaaaaaggaccatctattgagccctggggcaccccagagtttagaatttaggaagaaacagaaaatccagctgggcacggtgactcaacgcctgtaatcccagcactttgggaggccgaggtgggtggatcacttgaggccaggagtttgagaccagcctggccaacatggtgaaaccccatctctactaaaaatagaaaaaaagtagctaggcatggtggcacacgcctgtagtcccagctactcgggagggtaaggcaggagagtcacttgaacccgggtggcagaagttgcagtgagccaagaacacaccactggactccagcctgggcaacagagcaagactccatctcagaaaaaaaaaaaaagaaaggaagaaatagaaaagccaaaagaagagatggaaaagcgccagcgagtgtgagatgaagaaaatcaagtgcatggtattctgagagccaagcaaagaaagtctgtcaagatggaaagggtaatcagcagtgtcagatacttctgatgggtcataaaaaatgagggttgagaatttatcattggatttagcaacatggaggtaactggtgatctagacagggtcttctttatgacatggtgagggtgaaagctcatttgaaattggtttaagagagaattggacatagcaaacatagatagctcttttatggtatttgctacagagaggaacagagcaggggcaagggccagggtcagtaactagctggaggaagtaaggtcaagaaggtgttttttggatggaagaagtcacaggatatttttatactggtgggaatgttccagtagagagaaaaatggataatgtaggagagagcgaggaaaatggctggcgtgaaacacaagagtaagcaagagacaatgggaaagggggtttggtaagttgtcttagctctttttctttttttttgaagacaggtttcactcttgcccaggctggtctggaactcctgggctcaagcagtcctcccacgttggcctcccaaagtgttggattatagatgtgagccaccattcccagcctggccttcgcttttatttttattatgtcatatatatatagagagagagagagagagtttttttttttttttttttttttgagatacagtctcactctttacccaggctggagtgcagaggcacgatctcggctcactgcagcctccgcctctcaggttcaagtgatcctcctacctctcagcctccatagtagctgggactacaggcgtgcaccaccacacctggctaattgttgtatttttagtagagacggggtttcaccatattggtcaggctggtctcaaactcctgacttcaagtgatccacccgcctcagcctcccaaagtgttgagattacaggcatgagccaccacgcccagcccagtcttagcttttagacagaatcatggatcattcagttggtaccctgactggggctgctgcctttctttcagagatgccctgctcagaggggaggaatctagagaggcagtctggctacagtggttttgtggcgctgcagttggctccacccagttcagacttcccagcagctttgtttacgctgtaaagggaaaatcgcctactcaagcacagatgggaaacatgggtgcagactctggtggatgagaaaagttgttgattgaagattgtggaagttctcagggcttcagtccttttgatgaaataggaaacaagatcatcagttaaaaattaccaaagaagccggacatgatggctcacgcctgtaatcccagcactttgggaggccgaagcgagcggatcacgaggtcaggagtttgagaccagcctggccagtatggtgaaaccctgtctctactaaaaacacaaaaatcagccgagcttggtggtgcgcgcctgtagtcccagctactcgggaggctgaggcagaagaatctcttgaacctgggaagcagaggttgcagtgagccgagatcgcgccactgcattccagcctgggcgacaggcagagcgagactccatctcaaaaaaaaaaaattgccaaagagatagtggagatttaggagagaaggcatatattaggcctctaggggagtgggagagggagtagacaaggtttctgtagaaggatttgccagtcccacgggaggttagaggttttggatctaactacaaaccagtagagtggtatgttttcctccaaacttgtttagctgtgtagctgccggcagagtgggcccagacatggatttaactattgtgattttgtcaagcaagtagtataaagaggaaggggcaatatcttttgtaaatgcccaggaattacttagttgcatgttttagtataaacagtaactgctataattgtggttttaattagcttattttgtaaaaccttatacatcatatccaaaagctctgttgtacgtttttgtttttttgttttgttttttatttttttgagatggagtcttgctctgtcacccaggctggagtgcagtggcgccatctcgactcactgcaagctccgcctcccgggttcacgccattcgtcggcctcagcctccccagtagctgggacaacaggcgcctgccaccacatccagctaatgttttgtatttttagtagagacagggtttcactgtgttagccaggatggtctcgatctcctgacctcgttatctgcccgcctcggcctcccaaagtgctgggattacaggcgtcagccaccgagcccggccccaacttaagttttacagacattgaacccccactttctgccaagagcctgcaaatactaccacatttactgtttacaacaattctgaaaagtagagaatagctccatagttaacttctaagaagctgaggcttgggacaatttgctctaagttaaacagctactaatcaagccctgactaacaattgtctttagctcccctctcatctccccttccttcaatattaataacaactaacatttatgtactttgcattatcatgtaacaaccacagtgaggctgttatctccattttacatctgaggacgctgaggcacagagaaattaagtgatttgcttgaaatcacacaactagttttcattgggacctgaatttgaagccaggcaattttaactctgaatcttggaagaaattatctgaaaatgtgttactgtaggaggtgagggtgcttttaagaaacagcaggaccaaagccttcagagctaccagggcgtgacatctgcatcaccccttccacaggtaacagcctggtcacaaatcctgtagctcctggctgcatgtttggctcttaacttgcttggttttgagctctggtgttctcttcctcctctgcagctcagggcttttcttagaataaaaaaagatacatctgaccactccgctagccagttgcagtctgaccagcttctgctgttttggcctaattctcccctgatatgtttaaaccagatcattatgataattcttcagtgttaaatgaaggattaattggaactgcctactgtcttagtgtcagcagagtcaaatagtggatgtttcagagacttagacaactcttgtatttgtcttacataccacagcagaggccagtagttactggcttctggtgtctatatggtaagctcagatattttcatttgctagtaacatctttcaatagtttatcttttctgagttaaaattcagttaggctttaaatatttatgtcaactacagggtgttgctctgaagtaatttcatttgtccattgggtgtttatcaatgcctgtggagtatgaggtagaggcagatggtgtggagtccctgcccttagagttcatggtctgatgggctggggcttgaaacatggagtggtgaaaacgcagtgccagaggtcaggccattcccgaaagatctagttcagcgccatttcacagatttatatttagcttttgcatctgttcttcccttggttttaagatgagtttctccagtcccttacccggttcccatcaagccatgttggctaatggtaggaggataattagggcaggtggtgagcagagtggaggaagggaagacttaatgggacaaagcctttgctccagcacagtcagctctctctggggacagaaagcggaaataaattcacagctgggatagctgaggctaggactcagcagcaggattctttgtgagcaggtagtaagaattttagtttaaaactgcccctaatcacttttgattttggggcagaccaaagtaaagattctggttggcagagattggctacgtctgagttctgatcttgcctttgtcccatcttaaccatatgatttggggaagctactgtttatcattcctgtacctcagtttcttctataagagattatccgactttccacagttgtattgaggattaaataagtttaagtgcctaacacagggttggcataatacatggcatatagcaggtgcttgataaaagttatttctcttccctctgtggagatctgctgctcagtgctaggaaagattctccccaagcacctggaaatagtggaggaggtgacagcagtgagctcatttaatcgtctttctgcagtcacagacctcactcatagaaaaaagctgccatgatctttgtccactcattggcatttggttttctagcttaactttgaagggctacaaatatatgtacaatttaaactggatgacaatattttactttgcctcttccccagaaaagtttagccagcttaaaaaattgcatacaatgcaaaaggataacatgaatgtttgagagaatgaaggcaaaggagaagccacaatagaaaaataatgcaggggtaagatgagctcagctctgtaggctcgctcctaacactgatcctctgctggagtcactctggctggcctgctattctgtgaaaatgccgggcacccttctgcctgttcttgctcttgcctctgccagggacacttttgaagataactgcgtgacttcccgcctccctcactcagggctcttctgacaagccacactccctgcctctgccccttccctgtctctttctcctctgatttgtcttttttttttttttttttaagacagagtttcgctcttgttgcccaggctggagtgcaacggcacgatctccgctcaccacaacctccgcctcctgggttcaagcaattctcctgcctcagcctcccgagtagctgggattacaggcatgcaccaccatacctggctaattttgtatttttagtagagacggggtttctccatgttagtcagactggtcttgaactcccaaccccaggtgatccgcctgcctcggcatcccaaagtgctgggattacaggcgtgagccactgcgcccagcctatttgtcttcttaatatttatcagttcctgacatcttttttttttctttttctgagacagagtcttgctctgtctcccaggctagagtgcagtggtgcagtctcggttcactgcaacctccgcctcccgggttcaagcaattctcctgcctcatcctcctgagtagctgggattacaggcacgcgccaccacgcccagctaatttttgtatttttaatagagacggggtttcaccatgttggccaggctggcctccaactcctgacctcaggtgatccacccacctcagcctcccaaagtgctgggattacaggcatgagcccctgcactcggccagttcctgacatcttactagtttttttgtttagtgtgtgcctcccctccccctacaatgtaagttccgtgatggcctgccttggcatcttcttttactgttgctgtactcctcatgtgtagaactgcctggtacatagtggatattcagtaattatttgttgagtgagcacgcagaagtgcatatcatacagatctgtttacttgccagaaacagatttcagatttgactcctatctcttaatggtgaaaagaaataaaaaaaacacaggagttgcaagattcactgtgtccatcaggcaaaacaaaaagcttatttaggagaaacctgatatgaaacttgaaagaaatgtttcttttcagttctcaatgagtaataatgtatgatacggtagagaagattcctgaaaggatcattacattatttataacaacacattttgtctctttttaatttggactttattgtattcatagctttaactttttaaaagtcaaaattggccgggcttggtggctcacgcctgtcaatcccagcactttgggaggctgaggtgggtggatcacctgaggttgggagttcgagaccagcctgaccaacatagagaacccccgtctctactaaaaatacaaaattagccgggcatggtggcgcatgcctgtaatcccagctactcgggaggctgaggcaggagaattgcttgaacccggaaggcggaggttgcggtgagccgagatcatgccattgtcctccagcctgggccacaagagcgaaactccgtctcaaaaaaaaaaggtcaaaattatttatctttcaaatcatgtattaactattatttgtaatccactatgattaagacagaatttggggctgggcacagtggctcacacctgtaatcccagcactttggaaggctgaggcgggtggatcacgaggtcaggagttcgagaccagcctgtccaacatggtgaaaccccatctctactaaaaatacaaaaatttgctaggcatggtggcacgcgtttgtagtcctagctactcgggaggttgaggcaggagcatcgcttgaacccgggaggcagaggttgcagtgagctgagattgcaccactgcactccagcctgggcgacagagtgagactctgtctcaaaaaaataaataaataaaagagaatttggctgccttaggtgagcagttaataccaatcaaaagaaaatttaagattgaagtagctgtaaagaatgatgaagaccctcattcccaggaaatcaatttccatctttggacaaatctcaataccagaaactgatttaaaaagaaaaggttgggtgcggtggctcatgcatgtaatcccatcactttgggaagctgaaacaggaggacctcttgaggccaggggttcgagaccagcctgggcaacatagtgagcccttgtccctactaaaatttttttttaaaaattagcaaggcatggtggtgcacactcgctcgtagtcctggctactcaggaggctgaggtaggatgattgctagctagagtccaggagttcaggattaaaatgagctatgatcataccactgcactccagcctgggtgacagagtcaaaatttatctcaaagtaagtgtttagattgtggtttttgtgcataaatgaaaaaaaaaaatagaagaagaagaaaaaagataaagcacataatactttaaacatattgatgcatatgagtgatatgggaagaataaattcaaatttcaaagttggaattaatataggtattattattttggaaggggaaatctcaaacctttacactaaatcaaagaaaaaaattcagaatttcaaccagtcaccaaagaaagtgaaacactgcatatctacatgagtatctgaaacagacagaaactagactaacttccatgaaattaaattccattaaaatatttcattgaaatccccttgaaatacgttaacatattctgatctaaaatgaaaaaagatttaactatgtaatctatgtaagttagaatgcatattctatttagagagttgattaagtaacattgatattattttatgaggtgttttttttttttaacttttaagttcaggggtacaagtacagatttgttacctaggtaaacttgtgtcatgggggtttgttgtacagattatttcatcacgcatgtgttaagcctagtatccattagttatttttcccgatcctctccctcctcccaacctccaaccttctataggccccagtgtgtattctcccctatgtgtctgtgtgctctcatcatttagctcccacttataaggacatgtagtaggctgggtgcggtggctcatgcctgtaatctcagcactttgggagactgaggcgggtggatcacgaggtcaggagttcaagaccagcctgaccaacatggtgaaacccatctctactaaaaatacaaaaattagctgggtgtggtggcgcgtgcctgtaatcccagctacttgggaggcttaggcaggagaatcacttgaacctggcaggcagaggttgcagtgagccgagatcgcgccactgcactccagactaggtgacagagcaagactctgtctccaaaaaaaagagagagagagaaaaaaaaaaaaaggacatgtggtatttggttttctcttcctgtattagtttgctaaggataatggcctctagcgccatccaagtccttggcaaaggacatgatctcattctttttttttgagacagaatttttgctctcttgcccaggctggagtgcaatcgcacgatctctgctcactgtaacctccgcctctttggttcaagcgattttcctgcctcagcctcagcctcctgagtagctgggattataggcgccagccaccacacccggctaatttttgtatttttagtggagacaaggtttcactatgttggccaggctggtttcgaactcttgacctcaggtgatccacccacctcggcctcccaaagtgctaagattataggggtgagccactgcgcccagccaatctcattcttttttatggctgcgtagtattcatggtatgtaccacattttctttatccagtctatcattgatgggcatttgggttgattccatgtctttgctattgtgaatagtgctgcagtgaacatatgcatgcatgtgtctttataatagaatgatttatattcctttgggtgtatacccagtaatgggattgctgggtccagtggtatttctaaaaatagtactgaaccactgtatttcatggagaacaacacagtgtggtcagttagacgtgctgagctatagtgtcttgatccctgcttttttgtttgattatgaacacagggctcacgagcagctaaatgtgaaacatgaaccactccagctcatccagcctcagtttgagacgccgctgccaacccttcagcctgcggtgagtaggtgtgcttgggagatcccactgcagagccccactgttgcccttatcttgtcagcaggcattcgctgtggtcccttccatgtgccatttgtggcactccttgtggagtcatagtgctctgtctctaaacatgcatggacaccaaatttgttaatgttctatagagacttccatgtggtatgcttccaaattgaggaatcaaggatgtggagccttctggctattaaacatttcctattctcatcttgtggggttggagggcatatatgagatttcttggataaaaaggaagaaaactttgtactgccattccaggtgtcagggcctgattcataacataattctcacagcccaggggatagttatggtcatgtgtgtaaataggttatttttcaacatttcagtccaacattcaacttgcctttaaaattaccttgtctcaccacattctgaaatgttatgagccagttagcttgatcttgcttggtagcttgaaattggccatggtgagaggatttacattacagaaaatggtaaatgctacaaaacaggccttcagttttgttttgttttgaaagtagttaaacatttacccgcataccattggttcatacctacaaaatgtgactccaggttcaatactttctacactaatctgcatctggttctccaaataacttccatccctaaaaacttatgattaaatgagaaacaagttgtacaatcaaatgttcaacacaaacctaagccccaagctttgtgtcatcgttctgagttaattagcattggtatgtcagcttggtcagtttagtggtaattagagctggttctacttggttgtttacagtgggctaataatctttcttggtatgggtctaatgggtgagggtagacgaggtgatgggagtttgggtatttcatcctcagggaagagccgagttactgttctgtaggggtttccatgtggtgtggttcccaactgaggaattaaggatgtgaacttccttattctccttgtgtcttatcactgttagttatgattttggacaagctctttcttgagagactttatttcctttaccttatcctccctcatttctaaataatgactttatttccttttaggtttttcctcccagtttccgggagttaccacctcctcctctggagctatttgatttagatgaaacgttctcctctgagaaggcacggctggctcagattaccaataagtgtaagtttggcgaactttttttttttgagacagagtttcactcttgttgcccaggctggagtgcaatggtgcgatctcggctcactgcaacctctgtctcccaggttcaagcgattctcctgtctcagcctcccgagtagctgggattacaggcatgcgccaccacgcccagctaatttttgtatttttagtagagacggggtttcatcatattggtcaggctggtctcaaactcctgacctcaggcgatcagcccgcctcggcctcccagagtgctgggattacaggcgtgagccaccatgcctggcctaagtttggccaacttttaaactttgttttctcttatgagttttatttaatcatgaatttctgagaattgctatgagagactgcttagagtttgtttagggaaaacaaaatatgaataggagtataaacttaccattcttatttatgtcatgtaaataatgttggttgttcttctcgaggctatttagttcagtgaattagaacatagtgccaagcagaaagccaaaggtctcagctttgatccctgtgagtccttagttctgacctattgagagaccatagaattaatcttgaccctggctgccacttagcaaatctcagtcagtggtcataggagcagctaaataaggaaattgagtaaggcccaaagaatgatagagacttcaaattggacaggatctgagagagagccaagtgtgcccaccttgacatgtggatgaagaaatgaggccccaggccacacagctccacggtgagtggtcctcctgacttttggtctggggctgctcctgacatgaattgcctccaacacagcaaatgggtctgcacatatatgctcagaggcataaaattaaccatccactttgaggcagtgaccccactcctggaactctaatctaaggagattatattttttttttttttgagacaaagtttcactcttgtcgcccagccttgggtgcaatagtgctatctcagctcgaggtaacctccgcctcctgagttcaagcgattctcctgcctcagcctcccaagtagctgggattacagttgcccaccgccacgcatggctaatttttgtgtttttagtagagatggggttttaccatgttggccaagctggtctaaaactccagacctcaggtgatccacccgcctcagcctcccaaagtgctgggattacaggcatgagccaccacgtccggccaacttctacactatttatttttaaaatacaataaactcgggaggctgaggtaggaggatcgcttgaacttaggaatttaagaccagtctgggcaacatagcaagaccctgtctctaaaaatatattttaaaaaaataacaatttttaaaaatagaaaaaaactataaatttgggaatagctttaatgtccactagcagagtaatggtcttaaaatgcgtcacattcatttggtaggagaatatgtagtcattataaaagaggttcacaaaggctagggaatgacacatatgacacagacagaatttaagagagaatcctgaatgaagaaagcaagatataaaactgcatgtacaagaggataccagctatgtcagtaacatctgtatgtgcccaaagcccagaaagaagtaagcaaaatggaaacagttcagtgtaaacgaagacctttactgcatctctcttctgtggcaggcattgctgtgggtcctgggcagtcaaaaatgagcaggacatagtgatgagtccaggaggaatcacagaacggtgaagaagcagctttgacttggcatttctgtttctagcaactgtcctatggaaatccttgtagaaatgcaagacaaaaaagatatagatattaattatagcattcaaaaaattggaaacagtctaatggtccatccatcattagggggattggttaaaaagagtatgaaataagcctgggtcacatagaccccatctctacaaaaaaaaaaaaaaaaattgcctgagcacggtggatcatgcctataatctgaacacttcaaaaagccaaggcaggaggatcagttgaggctgggatttcaagaccagcttggacaacataatgagaccttgtctcaaaaaaacaaaaaaaaaggctgggtgcagtggctcacgcctgtaatcccggcacattgggaggccaaggtgggcagatcacctgaggttgggagttcaagaccagcctgaccaacatggagaaaccccttctctactaaaaatacaaaattagctgggtgtggtggcgcatgcctgtaatcccagctactggggaggctgaggcaggagaatcgcttgaacccaggagttggaagttgcggtgagccgagatcgtgtcattgcactccagcctgggcaacaagagcgaaactccatctaaaaaaaaaaatttttttaagtagccaggtgcggtgacgcatttctatattcctagctacttggaaggctgaggtgggaggatcacttgggcccaagagttggaggctgcagtgagctatgatacaccttgcactccagcctgggtgacaaaggaccctgtttctgaaaaataaataaatagaaacaaaatagaatattacatacctgttaaaagaaaaatgtagcctgggtgcgatggctcacacctataatcccagcactttaggaggctgaggcaagaggatcacttgagaccagcctgggcaacactgtgagacctcttctctatagaagaataaacaaaattagccgggcatggtggctcactcctgtagtaccagctactcaggaggcccaggtgggaggattgcttgagcctaggaagtcaaggctgcagtgagctaagattgtgccactgtcctctaacctggttgacagagcgagaccctgtctcagaaaagaaaaggccaggcgcagtggctcatgcctgtaatcccagcactttgggaggccgaggcaggtggatcacaaggtcaggagtttgagaccagcctggccaagatggtaaaaccctgtctctactaaaaataaaaataaaaaattagccaggcatggtggcaggtgcctgtaatcccagctgcttgggaggctgaggcaggagaattgcttgaattcgggaggtggaggttgcagtaagccaagatcacgccactgtactccagtctgggtgacagagtgggactccatctgaaaaaacaaaaaagaaaataaaaaaaatgcagggcataaactttgattcggaatgtccataatacatcattaaatgatgaagtcaacttagaaaactattctagtttgatcccatttttgtgaaaacttacatttacacacagaagcatacatagcaataataattctaggtagttggtggcagtagaactaggatgaaacattgatacagctgtgggtttgaatgtcttagtaaaaaacatacatttctatcaaaacttaaaatgcaaatcagagggagaataaattaattacagctgggctcagtggctcatgcctataagcccagcactttgggaggccaaagcaggtggattgctggagctcacgagttcgagaccagcttgggcgacatggtgaaaccccgtctcaaatacaaaaaatcagccaggcgtggtggtacacacctgtagtccaagctacttgggaggctgaggtgggaggatggtttgagcccaggaggcagaagttgcagtgagctgaaatcatgccactgcactccagcctgggtgatagagccaaaccttgtctcaaaaaaaaaaaaaaaaaaaaaaaaggaagaaagaaattacagtataatgtgagaagggcagtaatggctgtctatcctacatgtagggctccagaggatggcttcacagagctatgttgttggtggaattatgggtgatttttttctttaattttctttctataatattgtttgttttttggggttttgttttgttttgttttgttttgagacctaattttgctcttgttgcccaggctggagtgcagtggcacgatcttggctcaccacagcctcagctcactgcaacctctgcctcccgggttcaagcgattctcctgcctcagccttcctgagtagctgggattataggcatgcaccaccacgcccggctaattttgtatttttagtagagatagggtttctccatgttggtcaggctggtctcgaactcccggcctcagatgatccacctgcctcagcctcccaaagtgctgggattacagatgtgagccaccacgtcccccaggctggagtgcaatggcgtgatctcagctcactgcaacctccgcctcccagggttaagcaattctcctacctcagcctcccgagtagctgggattacaggtgcgcaccaccatgcccggctaatttttttgtatttttagtagagacagggtttcaccatgctggccaggctggtctcgaactcctgacctcgtgatccgctcaccttggcctcccaaagtgctgggattacaggcgtgagccttcacgctcggctgttttgttttgttttgtttgagatggagtctgttctgttgcccggggtggagtgcagtggcgcaatctctgttcactgcaacctccatctccccagttgaggtgattctcctgcctcagcctcccgagtagctgggattacaggcctgcatcaccacatctggctaatttttgtatttttagtagagatggggttttgccatgttggccaggctgatcttgaacacctgacctcaagtgatctacctgcttcagccttccaaattgctgggattacaggcatgagccaccacgcccagccaatacaatattgttttagtaaatgctatttttaattacccatatgcttctctatagtcatctttgttgcattcagggaatgataatttgatttcctactgttgcacctgttctttctaatgtaggaatactagatctgaggaataggaaagccagtaccagtccagttttattctgattaggagtgcttttattataaaagcagcacattagagagctctagggtttttcagtgttgaaatcctgtagtcacattactttaggaagaggtgagtgatcttaggaaatgtggaaacatgacagggcatacctgaaacacactaagtctgtactttgggaagggcagaagttaagaattaatctaactactactccaactgtcttaggtactgaagaagacctggaattttatgtcaggaagtgtggtgatattcttggagtaaccagtaaactaccaaaggaccaacaggatgccaaacatatccttgagcacgtcttcttccaagtggtggagttcaagaaattgaaccaggtacagagcctacaaggcacagtgtagtgggagcccctccagtactggtatcttccatggactgtgcttgccatgttttatgacgttgattcagcctgtaaatatttattaagcatctactaggtgaacaaaacagacaataaaccctgtacttatggaacctatatactagctggaggatgtagacaataagcagtaaacataagtgagtcacataggatgctagaaaatggtaagtgctttggtataaaagaagtggaggctgggcgcagtggctcacgcctgtaatcccaacactttgggaggctgaggtaggcagatcacccgaggtcaggagttcgagaccagcctgaccaacatggtgaaaccccctctccactaaaaatacaaaaattagccgggcatcatggtgcgtgcctgtaatcccagccactcaggaggctgaggcagatgaatcacttgaacccagaaggcagaggttgtggtgagctgagatcgtgccgttgcactccagcctgggcaacagtgagactctgtctcaaaaaaaaacaaaaaaacaaaacaaaacaaaaaaaaaacagctgggtgtggtggctcacacctgtaatcccagcactttgggaggccgaggcaggtggttcagctgaggtcaggagtttgagaccagcctggcgaacatggtgaaactccatctctactaaaaatataaaaattaaccaggtgtggtggtgcacgcctgtaatcccagctactagggaggccgaggcaggggaatctcttgaacccaggaggcggaggttgcagtgagccaagatggcaccactgtactccagcctgggtaagagagtgagactctgtctcaaaaaaaaaacaaaaaaatagagctgggtaagagggatcaagtgtgctgagtgtggccatgatgactggtgagtattaaatagggagatcagggtgggtttcattgcaaagttgtattggagcaaagatttgaaggtgttgagagacttagccatgcagatatctgggggaggagtgtcccaggcagaggggagatgtgtgcaaagttcctaaggctgggctgtgcctggtatgcttgacgaacggcagtgatgccagtgtgacaagagaacagaggaaaggacagagcagtagaacatgaggtgatcaccttatgtaagaaatgattttctcaggccgggcaccgtggcccacacctgtaatcccagcaattgggagcccaaggcgggcagatcacaaagtcaagagattgagaccatcctggccaacatggtgaaaccccatctctactaaaaatacaaaaattagctgggcgtggtggtgcatgcctgtagtcccagctcccatactcgggaggctgagacaggagaattgcttgaacctgggaggcggaggttacagtaagccaagaccacaccactgcagtccatccagcctggcgacagagcaagactctgtctcaaaaaaaaaagaaaaagaaatcatctttctctgactgaggaccaagaacttcaaaattatccctggccttcttttttccaaggatttcaaaaattgaatgcccaaccagctttggtaaataggcattcatacactactgatggagaataagttggttccacttgtctggagatatttttataatactgttgaaaagccctaaaatgtatataccgttgacccattctaatcttcagaatttgttttaataatataattcggaatacgtacagatttatcaaccaggattctcagtgccacattattttatagaagaaaaatcttcatcaatagggaactggttaagtatcctagggtacatccataagataaaaaatgtttttaaaaatgtttggccaggaatggtggctcacgcctgtaatcccagcactttgggaggctgaggcgggtggatcacgaggtcaggagttcaagactagcctgaccaacatggtgaaccctcctctctactaaaaatacaaaaattagccaggtgtggtggcgtgcacctgtagtccctgctactcaggaggctgaggcaggagaattgcttgaacccgggagacagaggttggcagtgagccaagaacgtgccattgcactccagcctgggagacagagtgagactctatctcaaaaaaataaataaaaaataaaaataaaaatgtttaaggacttgggccaggcgctgtggctcacatctgtaatcccaacactttgggaggctgaggtgggcggatcacttgaggtcaggaattcgagaccagcctggccaacatggtgaaaccccatctctactaaaaataaaaaaatcagctgggtgtggtggcccgtgcctgtagtcccagttactcaggaggctgaggcaagagattcgcttgaacctgggaggcggaggttgcagtgagccaagattgcaccactgtactccaacctgggcaacagagtaagactcaaaaaaaaaaaagtttaaggacttgggaatacattcgtgatacagtaaatatgtggtggggagagactaaagaacagtatatagagagattctactttctttacagaatacaatacacacatagaattattttgcataataaaaaaataacataaagatatttatccttggggcccagtgcggtggctcacgcctgtaattaatcccagcactttgggaggccaaggcaggtggatcacgaggtcaggagatcgagaccatactggctaacacagtgaaaccccgtctctactaaaaatacaaaaaattagccggccgtgttggcgggtgcccatagtcccagctactcaggaggctgaggcaggagaatggtgtgaacccgggaggcagagcttgcagtgagctgagatcatgccactgcactccagcctgggtgacagagtaagactctgtcccccccaaaaaaagaagatatttatccttgggctgggcacagtggctcacgcttgcaatcccagcactttggggggccaaggtaggtgaatcatttaagcccaggagttctagtccagcctgggcaacagaaactccacatccataaaaaaatacaaaaattagccaggtgtggtggtgtgcacctgtagtcccagctacttgggaggctgaggtgggaggatcatctgagcctggggaggttgaggttgcagtgagcagtgatcatgccactgcactccatccagggtgatagagtgagaccctgtttaaaaaaaaaaaaaaaagatagtgtttaatttttattttccttctttattaaaatttctatagtgggccgggcgcggtggctcacgcctgtaatcccagcactttgggaggccgaggcaggaggatcatgaggtcaggagatcgagaccatcctggctaacatgtgaaaccccgtctccactacaaatacaaaaaaaaattagccgcgcgtggtggcgggcacctgtagtcccagctactcgggaggctggggcaggagaatggcatgaacctgggaggcagagcttgcagtgagccgagatcacgccactgcactccagcctgggtgacagagcgagactcgtctcaaaaaaaaaaaaaaaattctatagtgactgtgtcacttttgcagcaaaaaaagagtgttttgttgtttaatgtaagcaggcaaaattcaagcttaggatttcagatgctgagtggaaagaccaattaggttctgagcctctcctggaaggaagctggctgtgccggatgctcatttggcagtgttttactctccacgtctagcatggtgctggaggctggggccatagcagtgaacaagatgattgcggttcttgctgtgcctctcagagctctgtgtagtgggagacagaagtgtattggcagttaccgtggtctaagtgccatccatgaagggaacccagagatgagggttttgatgtggctgctcagcagtgaatgatgggatgggaggtcaggtaggttcccagcagtactcactctggtggcatgctaggacagacacccgaggccaatataagaagtctggtgtggtctttgcaccagtgctttcaactctgtttgttactcatcatggtgggtggtgggcagtggtcacaagccctgccatggtagggcaaaaggatcaaaatttgatccttgggttggattcagccctaaagccagatattatgtatatgtcctaattaataaagattcagaatctctaaagtccaaagcactgaagagtttacatttcaggctttatactgaaatactaaaattctgtgtcttattctctcatccaggaacatgacatcgatacaagtgaaacagcattccagaacaatttctgaagaccatgcctcttgaagctttttctgcctcctgattctctctttgtaaactattttcaaattgtttttcaactccttatcaaaattgtttatacactctttcctccatgagctctggaaggtatatgcatcttctgtaatactcagataggtataagatttttcacaaaatccttatgtaagatacattccatttttaaaaattaaatgtatggttgcatctgtctttttatacccta

SEQ ID NO: 38432 - DNA, 12050 bp, Homo sapiens
gtctgaacctctgccagtcctggagactggtgccctgagctccaaccagcgggcctcatcctacaccctcaccaccgcaacttctcacccgagcaagaagcagctcccagagagaaagaacgttcccacctgcctagccatgggagaggacgctgcacaggccgaaaagttccagcaccctgggtctgacatgcggcaggaaaagccctcgagccccagcccgatgccttcctccacaccaagccccagcctgaacctagggaacacagaggaggccatccgggacaactcacaggtgaacgcagtcacggtgctcacgctcctggacaagctggtgaacatgctagacgctgtgcaggagaaccagcacaagatggagcagcgacagatcagtttggagggctccgtgaagggcatccagaatgacctcaccaagctctccaagtaccaggcctccaccagcaacacggtgagcaagctgctggagaagtcccgcaaggtcagcgcccacacgcgcgcggtcaaagagcgcatggataggcagtgcgcacaggtgaagcggctggagaacaaccacgcccagctcctccgacgcaaccatttcaaagtgctcatcttccaggtcagttccccctatgcctccttacaggcgggctggaactccttatcattcttgatctcgctcatcctggctctcacagccatttttacatttgtcctgcctgtcagggatcacacatacaaggcactgtcccctgtctgcctgcggaaagcaaatgtgaaatcttcacacaggggtgggaatttcccaggtcactacagactaatccaaagaagatgtccccgggcttagtaggccccgggtcatttgtcagggagcacctggatgcactctgtacaggttgggaagatgtgcaggtgcgtgcaccctagtcaaattcatttgtctctttgcattaggagcttagggctctggctgcagctgttagctggacagggcaaattaattcagtggctgttcattaactcttagtggaaatgaagtgatcatgtgaggtattttgtggtttttttaaccaaaaagtcaaactatccctttatacaaaggctatcaacgttttggggaccaatcaaatagaggattgattccattagagttagccttgttcttttaagacttttttggggcaaagcaatcttgtggagttcttttctagcaaatgcactagaaaaagagagtacaaacacactagacgtgcctctccttgttcagagagaccacaactgttaagtaaaataaaaggagtgttatcagttatagtcacaaaggctagtcttaaatgtttctccttcaaacggttgccttagaataaaaaggccacttaattttttttaatgcatcaatgatgcaattaatgtagcaagaggctatctggggacagggagattgcgtggggctcttgttccgccaagtggtgggcatttgtgaatcccagggcagccctgcctaatgctggaagcccttccgcccagtggaatccagccagcacagagcccaggaagcgattgccatcctcgctccagggctgtctcgttgtgaccatatgaataggagaggatttcaaagccatggaggggagaggctataaccaacagtttgattgtgaaaggcacacagggaaagccttcatctcccaagagagatttagaaattgggatttaaaccgagggagtcttctttttcaaaatgaatctgctctgccaagttagaagccttcctacccccataaaaggaaagactcatctcgctgcttttttgtcctcctcaaattgcacttgaatattgtaaaggtttagggagcctatgtcctcctctaccttgcaggcttttgcagctgaaaacttttcagcttttaatgcaaatgcagtagcttttcatgcaccagatgaattgaaaagagatactgtaactgggcctttcttaagccatatgagatccttactttattagcctaagagatattagaaatctcagctctcaagccatttctaaattaaatactgatctccaaacaaaaccaaacatgtacagacctgtttaagtctgagacaccaaaggaaattttcctgcttccagtatgaatcaggcaaattatctcttgtcccatccctcagttaaggaggaggaaaaaagtatttatcttgtagaggaaagtcacaattcgtcaggattgggttttgttttgttttgtcatggatgttctgcagatgttggggggagggatggagaggatatgctagtagaaattcaggagaattataaatctgacattaaaaaaaaactgcttgggaacttaaaggcatatgctgttgtgagggtctgacatggtctcctgttttgtcacattgaattgacaggtgtgaaattgcagccagatatggtagaaattctccatatagtgagtaaaagctgaaacaggggtgctcaagaccaaactggaagctaagaatatccacagaaatgtgctcggactccattctgggccctttagaaaacaatccccaaggacacctttaaagagcattttaggaggcaggaaactagaggcaagtgactggacctttcttaagccgtgtaagatcctttattagcctaaaggatattagaattctcaactctcaaggcatcgcaagatgattgttttgtataaaactaatgcaagcacagtccctcagtggactctcttgttccttctaaaagtagcagtttccccagagtagtaattatgccaatggataaaataataatttgtattagagagtggtccagtatagtagttcagaagataaattttggagtcacacaaacagtagttcaaatcctagttctaccacttgctaaatatgtgatattggacacagtttgtagcttctccaaacctgtttcctcatctatacactgatgatattaataagagcaaaaaaaatcaagcacttaataaacccagcatacattggtaagcatcttatctcatttatcccgaatctacagatgaggatgttgagattcgaaaacgtttatggcttgtctgaagctagttagtaagcaagtggtgaaactgggattcaaactcatgtttaattgatttcaaagcacgtactcttgaacactaatgcttcttccctcctatctctctcatagagtgaggaatgaaagaaataacatttaaaatagttagcaaggactggcatggtataagtgctcaatgaatagaagatattactgagtggatctgaaattcatttgctcagaaagaaggctacacttttgcttggttagaaatatggtccttgggtaaaaactgacctcaccttgcccaggatcttaaaacagctccgctacacacagagaaccatgtattgtataactaccgccatgttgaaatcaacattatatctcatctccatgaaagcaaaggaatcttcccaaaagacctactcaacgaaccctccagtcacagcataatcttcacagtggagcataaggggactgcttcctagacctgtggagaatgtggagggcaaatatgtaccaggtgttactcagtgtctttaggtaatttatcattttcagcccatctgaaccctatgccagacttccccttattaaatctactgtttctaatttaagacaaaaaattatgtaaaaataagagagcgagaaaggaaaatctatcccatgacctgagcatatttggtatggtactgttgagaagagtacattttcagtttgtggaatcctgttgagcccgccgaaatctacaggtctgttttggttagtggttgaagatacttacacattttttttcttttttttctttgagacggagtctcgctctgttgccaaggctggagtgcaatggtggaatctcagctcactacaaactccacctcctgggttcaatcaattctcctgcctcagcctcccaagtagctgggattacaggcccctgccaccacgcccagctcatttttgtatttttaacagagacagggtttcaccatgttggtcaggctggtcttgaactcctgacatcaggtgatccatccgcctcagtctcccaaagtgctgggattataggcgtgagccactatgcctggccataattgcattttttaaattccaaactttgtccttaatttgtcccactcaaaacgtgacattacttctttaagtctgtactgagtgttacaacattgttatagctgttaagcatctaatttcttagcaattactttaaattataaccagtagtgtctaaaactgaagaaacattcatctctctttcagcaataaaataaatcttaaaatcctagttaaattcagcagttttctcttttaaacttttttgtaatagcttcagatcaatatttgaattcaaaatactgtgacatgacccagcataaataaaataagactcataggcattgctgatcaaaaagcaaatgctaaagaaagactgagactttgcttctaagcacagcgatcatttactaaaagaaaaaatagaatttgtacagaaaatcagttactctacacttatgaggaaattttctcttttgatttaagagactagaatttcacaggtaactggccctgaggatgcagtagcctcttacgtcctcttaggttctagtaatgattatttgaaaaagcagttgggagatgatttcaaatccagggagcaaaatgagagtactcttggacagcttacactttcgtccacataaaattgggaaactgggtgaaaaaagtagaaaggttagctatttgcagtggatacatttctggagaatggagcctataaatgtgttcaaatcttcatcctttgggttcctttgataaggtcagaattttagagagacgctaaaagtgtaacatcttcagaccatttttaaaaagcctgtactttatccaaagtcactgctttgaagactgttacattagtacagacctggaagaaatgaggatataggtaataaaagacgccttcatatgacaactcgccatgtttctatcacgctacaatgttcccatatgggatattagttttgatgtgttacttatccagtgcccttttactttatgagataaacaaaatattagttcttattgttattatttacatttagtgaatgtgagcactgtcccaggcactttaagtgaataactgattattgctggtattttttagaaagaatcattgcatactcttatgtaaaaaaaaactagactccttcagatgcagcccttccaagtaaatgctgccccttccactgctttgtaatctatatctatttgaattgaatgaatgaaaaatgttctccaatgcaactcaggtcctagagttttgattcttacataaaacaaaacacatttggtatcagtacactatggaatcaactctgtaatttgttaattctttttgtggggtttatgttaacatcacagaatcaaacatgttagagctggaaagcaccttaataattgttcagtttaacttcgttttgtgtcaaagaaacagaggccctgagaaacagtgactagcaaggtttcattttattattaataatagagattatagaattgaattgcaaaatgagtaaaaacaaacactataatcccaccttggtaaagttcatgtttactgggttttctacatcagcttttaaataattcagtgtgctttggtttttttgtttggttttgttttgtgtttatttgtaacaaagaacacctaaccagtgtgtcttaaaaaagaattgaacccttgataacactgaaaaataatgaaacttttaaatcctccagaatgtgaaagactgctcagggattataactaatgcattttattcttatgacttgctgattccaccgacagctgccttaggggtgcagttctaatcaatgactgtatccacttggcaatccatacctcagaaacacaaatcggagaaaaccatcaatgtgtaaaagagacctataaatcagaatgtcaggtgggcacagtttcattttagtaactagtatttagagattattggataaaatattccatggacacaaatttatggtcttcatatccctccaggattctactgcatcccagtgggaatatgacatcctttgttattttcttctgccaacaggaatgatgagttagtgacaggaaagcaaactgttgttttttctctccttattcaagcttttaaatgacttaccatgatttcctttctaaggagagtcatagagtcttcttttctgttaaggtgtgcatatctaggtatttagatatgtacacagaagatttgcttccatgagcttcaaaccaagaagtgtccagcatgttagcaagtttgtctgtgttgatacaaataggactattagttcactaggatcgatatgaacagcaaacaagttaaagtacaaggagaaatgctactttttcagttctttccattcatttttatgctgtgagcatatcagtcatatatgtttgaagtgtgctgttttattccccttcctttgaaaaactcctaagggttctcgtgaaaggtcagaaccgggaacacctgcatcaggggagctgaggacctttttgaaaacaaagggtaaataatcagctctcttggggcctctactgggcagaactaccaaaggaagcagtgcagcccacaagggattcctagtgccattttcaggagctacgaaccctaagtagacctagaagtaactagggcagggaagcagtgacagaattgaggatgtgtacttgatcttctctcttgaaatcgtcatcagtcttgcaacctgtaagagaaagcaaatcagaaacactacaacaggaggctgaaggcagaagtgtcaccttgcttataggcatatgaaatatcaagtgtttccacgaggtgtgtgggggagcttgagcacagggcacgtgtgcaggtgagattaggcacctcaggagagggcagttatccagcatccattatcttaagtttagactgagtttccaccaccataagagttacttcactgtcaaacaccactcacatgttttactatagaacagaaattttgaaaagtatcagtatttttctgcttccaaacaaacattatggaaaggtaagagctacatgtgcttggacattcacagatttttgtgtgaaaagaaagggcttaccttcagagtagatgccatcagaagccacaaaataaacactgttcaatatacagaacattaaatcctgtttgtgtaattaaaatgacagcagaagcatagcagttagccaagaagacatatctcacttgtttccagttgcataaagacacatccaactcattctggattatctctgttcctgctgggtttatttttatagctggcatcaaaaaagctctcatataatttccctggcattttacaaaagagttcaattgggtttcctaccttcccccaatacccattcatatacacagtgtgtatctaccacagatcatatatgattcaccttataataactttcctcaaagctgtcctcaaaagatacatgataaaagaatcgaaagagtctaaaactcaacagcaactatgcttttgtaataataaaatgtatatttaaggaaaaactgtaatattattagtttaattcctttagaagttcagttaatatgcctaccttttgttgggattaaataaagggaagttatacaacttactacctttgattaccctgagagattatactatgcaaaatgtacctcttctctggtagccaaggattatttttacagttttctgcctgaatttctgctttcctcactgaggacttttaatgacatttcactgatctcttggtttcttcctttcctgtaagcaactcctgtcaaaccttctcaaccctcttgtcaaaccccagaagtaattttgcttctagactaagcatccaagccttagctatttcagttgtctaaccctcttttagtaacacccatccactgcaaagaaaatccttccttaaaaatggagatcattgtccccattgggacttaggttctcttgatttcccaatggcaccagcagtcagcaaacttccttctagacacagagctgaacttgttcttttatagtcctcaagcctgcccaaaagaggggcaatctccattccagccactctcagggcgttcttagaaagccacctcacccaacatgcactcatttaacaagcagctgttgagctctaggtgctgggacacagcatggacaagagacaaaaatccctgccctcatggggagtacactccggggaactagaggcaaccgcaacttgaaacacgggaaagcagtgcttgtaaaaggccatgttataaataacctgtggcagtcccatgctccttttatttatttttttactttgtcttttactatggcctggacacttaaccatgacattcaaaatggcagagtgtggagagagttttgggaaacacaatatatgatatcgtcactctaacgaggaattctatttaattggacttttctgctttttgcgtcgacacaagacattaccctttgtttctaaccaatttatggaaaggactctgtatagtgtgtataaggggagacacagggttgtatttttcaaggaatatcataattctaccattcagttgttaacaaggagagggtttttttaagtttctgtataatatctaaactttatttagtctttgtatcaaatataaagtgacactcttaaagcatgttttcatcttttcggtcaatcaaaattacaaaacaagaagggaagttcttgccattaacataaactttgcatgacgtttaagtcccaggtagactttaaaatccactaaatccagttatttttcaaactgaaagtttactgaacagccttagatataatcaggcaatcctgaggctctggttgcaggagaggtggcaggggggtctggagctttgcccccctctggcattccagcagagcccctggtacccctgggagtgcagtatgaaagctgctaatctaggtcaaatctcttgttcatatctggaagaaactgagacccaaggagattaagttatttgctgaaagctgtcctgctattcagtagtacagcaaagactgagactcaggcctctggccacacattcactactgtgccatttctttcaaaaaagatgtgaagacatcttgctgactggctctccttttccagtattcaaagaaaaatatttaaaaatcaagagttctttagctgtgtaacccgagtctgtctgcattcaaaactccccagtgagcaatgttgcaacaccatcccccttccactctagagttgagtgttcaggtgctgctccttgagagccaagaggagccatctttgcctgtgtgcccggcagctggaggagagtgctggcaacggtgaagggggcagctttctgtgcttctctcctcactcttcgctggaagtgagggccaaagtattcttgcccaaagaagctctgtgtaacactagagaattgataaactatggctggcagcataatttcccctcactactctaaaaataaccctaagatctcacctccgcttagtaactccccaaaggatattctaaaccagaaggcttcctgagtgcacccccaggaagcctagtccttgcttctctcactcttaaacgatgtcctcagcaaaattagtgtgcacctttgagcagatactaaggctggccctacctttacttctgactcctagttggagagggaacccagtcaaggctttatgtgtgtgtgtctggtacttgaagacttctcagttctcacccttgccctatcttttatctgccaacttgatcttcaggctctcctgcagtgggattttggcaggcccaagccctctgacctcaaaagaggataggagagagagggcctctgggttcacagcacagtaacgttctttagctctgttatctaggcagcttcctggtctatctcagtcactgcccacttcccctctgcctgtcactgatacagtttctgccggttgtcctcctgatattcccaacaggctgcccttggccttatccagcctaaatagaatgacttgacgagtttagaattaactcttcctattctagaaaactcaagccacaaacatttgtttttttaccatcaccgtgtctccaaaacagacacacgtattacagcagctcaggactatttgtgaaatatgttattaacatgaaacctacattgtccgtcttttcaggaggaaaatgagatccctgccagcgtgtttgtgaaacagcccgtttccggtgccgtggaagggaaggaggagcttccggatgaaaacaaatccctggaggaaaccctgcacaccgtggacctctcctcagatgatgatttgccccacgatgaggaggccctggaagacagtgccgaggaaaaggtggaagaaagtagggcagagaaaataaaaagatccagcctgaagaaagtggatagcctcaagaaagcattttctcgccagaacatcgagaaaaagatgaacaagctggggacaaagatcgtatctgtagagaggagagagaagattaagaaatctctcacgtcaaatcaccagaaaatatcctcaggaaaaagctcccccttcaaggtttctcccctcactttcgggcggaagaaagtccgagagggagaaagccatgcagaaaatgagaccaagtcagaagacctgcctagcagtgagcagatgccaaatgaccaggaagaggagtcctttgcagagggtcattccgaagcgtccctcgccagcgctctggtggaaggggaaattgcagaggaggctgctgagaaggcgacctccagggggagtaactcggggatggacagcaacatcgacttgactattgtggaagatgaagaggaggagtcagtggccctggaacaggcacagaaggtacgctatgagggtagctacgcgctaacatccgaggaggcggagcgctccgatggggaccccgtgcagcccgccgtgctccaggtgcaccagacctcctgagcttagagccaccgtgccatcctgtgctgtgctcaagcgggcagccagggctgaagaacaaactcttgcacatctccagcacgactcacccactcctgcgttcctgtccaggcagtaatcattgaccatatagtcatagtaagacacacgagaccaggctttaccatgaaagcgacctgtcacggactccacttttaatttgctcttaggttctatctctgtagaatgtctccaagattgaagaagaaactgagcagttgaaaaatgctaatctctttgacttagtcagaaaaaaacagaggataattaagatactagtcatgaaaagtgattcattcttttttgtcattccataagcttgctgaatagtgtaccggtaatatattgtatttccaccgtactctgtgaatctaattattattctttaagtgttgatatataatatacataaatatgtaagctaaacatataactatatgttttaagaagaaaacatctacgaaaggtaaaaagagatgatcagttggttgtttacttgctagaaaccattgttttattgcaaacgaaggaaaaatgaagagattataaaagtcagctaatgaagtaagatacgtagtaaagtcaggactattcaaaaagtaagaaagaaaatttggaaaatgagagaaacaggaaacaaagaatgccgaaaagaatgaaaacagagaaaaaatgtatgtgcttgaaagtaaaatacttacaatagtagcttaactatttcactctttaaataaaaatactaaagaagttcgtatatcctggaataacatgtcatcttcaaaatatttttattttctaatatttttaataataaacattttatagtgttaaagctgtatttttcttaataaataaaggacattacaaat

SEQ ID NO: 38433 - DNA, 209783 bp, Homo sapiens
gcccggagagccgcatctattggcagctttgttattgatcagaaactgctcgccgccgacttggcttccagtctggctgcgggcaacccttgagttttcgcctctgtcctgtcccccgaactgacaggtgctcccagcaacttgctggggacttctcgccgctcccccgcgtccccaccccctcattcctccctcgccttcacccccacccccaccacttcgccacagctcaggatttgtttaaaccttgggaaactggttcaggtccaggttttgctttgatccttttcaaaaactggagacacagaagagggctctaggaaaaagttttggatgggattatgtggaaactaccctgcgattctctgctgccagagcaggctcggcgcttccaccccagtgcagccttcccctggcggtggtgaaagagactcgggagtcgctgcttccaaagtgcccgccgtgagtgagctctcaccccagtcagccaaatgagcctcttcgggcttctcctgctgacatctgccctggccggccagagacaggggactcaggcggaatccaacctgagtagtaaattccagttttccagcaacaaggaacagaacggtgagtctttcccccattctccccctgcttgtttctcgctgtgtgtgttaacgttggcattgtgcgttggtatgtgatatataccagactgtgaaggtatctttggtctctcattacatgcaaatgtgcgctgcgttcattggcatggactgttaaaggttaagtgtagtttgcaacttcgggagctgccacaaagctccaagagggcaacgtgagtgccactgctgagtgaggacattctgggagcgattgtgaacgtcatttcaaatgcacattgcaggttcgctcattgctaaagttagaagttcaagaactgcctctaaaaacgaatccaaaatgaatgagccttggcatgtttgactttactcagatttggggagggcgaggggggtcggtcaggaaatatatcagccgcattaattgaagcactctaggtcgaagtcatcaattaatcaatgagtagataggaaatatagaggtcaagaggctgtgtggtcgtttttagaggaattaaaaagtgtatttctcttgctccctagtttttgttttttaaacttgcctttgtactctgaagtccttacctttctggtggtgtgtttttgtatgtgttggtgaatgactgctattttgtgtgtgctggaaacgacttaatcctgcataggaaatgagaattactttcagctttcaagtgtacctgaaatgtttagaaaactctcagatgcaagttcccttgggctgggattgcacagagctggagaaaggctcctttcataaagccagggcagcttcagggtgtgtaatttgcttagcctctgaacccatatgatttacatcattcaatttctaaactctttttctcttcatctaccattatgaagtcatttttgagaatactttgtaaatagaaattttatactgcacatgaaaccacaatgttcatgttaggctgtctaaaattggaatatttaacgccctgtttacaaatggtggctcttactgtaatttgaaaaggaatatacatgtttttactgctttgtatatcatctattcagaatgcaaggattctgtcacttgattaaccatgcaaaatgaacacaagtggcatacctacaaaattaagataggatgtgctatagttttaagtcagagtgattttttttccttttcatattggggtgtttcaagacttcaactttgaatttaaactctatgaagtgttcatgtttaagaaagcacagaaagttttagggtataaaagtagataaaataaggattctgccgacttttgcaaacgttatttgtatttgctgttgcgcagcaagacatagtatcacatttatcagctaatattagtgtggtgcttcttacaacttgctaatgtgatgccacatggcacctgcaggctccttgagctgctgatcaaagggcagcctagggatgtatctctaatcacagtagctgcagaggtctgggggaaagtgatcaaaggagccacagcaccagctgtacccgtgcaggaaacacatcagaccaacctttgttctttctcatgtaaaataaatgtccagttcaaaatattgcttcttactagccaagctcctccataatgacaacaatgcacaatattcctggcttcctggcttctgttttttattgttcctgtcccatatcatttctcctattgccttgtcttatcaagcctctcttggcatctgcccgaatctctttgctgacctgtgcttctctttgtcctttccttttagttctctcttgtgatccccatgctatcatcactttgtaagggtcccagagctgtcatgcagcatgtggtcataggccactttacccaagtagattcacacctccaggagagatgagttcattaagccaggccacacacattctgttgccatctgaggctgggccatttccattcctaagatgcatgatgctaaaaattgctgcttgtttcctaatctgtgggtagaggattaggctatgtttgggggttggtctatgttaaggatggcagcaggaagtaactagaagtagaggaactacttgtagtttttagcccaaggagaagtggcactggccagcactagggggcaatatagagctattttcttgcacatgctcaggttgatttttatacgtaaatgtttcaagatttgagggtaacaggtgggtgctgaagaagattcccctggaatgtaaccagatttgttagagctactaccattaccgttactactactacttctacttcttcttctttttgtctttcaaattttccattatgtgggtaatcttttgcccacatactgaattatgattgaattttgattgccctgttgctgtctcaattttgacagttgtacagtcctgtaaatacgaaccctccttgaggataccacgtagaagatcccattggcccagtttgtgcattgcatcgttttgtgacaggtcttctctaactctgaaatgtccaaattgatatattatgactgtagcagctcattcttgtctccaaggacccctcctcatgatactctcttttcttgagtattctaaagtccctaatggtgattactcaatcaggtacctcgggctgctcagttttaatattaacttggtatttcaagaggaggtagaattggaaattgattgctgtagccaatgctgcatacatggatttagactggatcatgtggacatggttcagaattagctttgaagggttagtgtcatttacactattgttaggtatctggtttttgacctaccattggattgcaattcttgccacttttactgtacaaagttttatcctctaatattataagttgacttcatatactatacttaatttttaaccttacttctgaccctgtctcacttatgaaaacaagagtcttcagatttaacttgaggaaagagattaaaagataacattgacttgcttggagggtgtctggcctgtatacttgttgtatgaccatggtgaaaaatactcatattttgtgcacactggttttagatgagaatgcctattgtggaatgattaagttctgggacggtgcttctgagttgtagcagaaagaatcatacacccaggaacaaaacaaaacctactttgtctgttgcatacagcacaaagagatgtcaatgacaaagttgttggtggaggaatgcctcttctacctgtgttgttggtgagtgatttttagtttactcatagattaagagcatgcgtatcatttttttctcattttctttagccattctgaattttgatttggaatatgccgctcttcgctacggttggtcttattaacatcagttattgtatgtgttctttttctcaagggcttttgtggcatgtggggcaatttactttggtctgctggtcgtgcccttttgccggtatcttgtgtttatggattttccatctctttttatcagtgccagctttctcttcctactgtcaatgctcctgtatctaacaaaatttaaattaaaaatggaaaattaaaaaaggtgcccagtcccctcgccatcatttttaggtggcagcttcaaatctctgttttatcaaaaacagataaccacaatatttagaacagtgtccaagagtaaataggctctaactgcagactaaagggactttcctgtaagtttccctgtaagttttattgcgtgacctttttgacatttatttttgttgtttaaaggcttttttacaaaaaaaaaaaaaaagaaaaaacttcctcctggttctctgctgtttgaaatagttgaggaagttgaacaagtacagtgccattatgtaatgatgaattttgtcttttcacagtaggtgattaaaaagctctattatgtggtaatttttcttccatatcaattttaatcatagatattggatggatgatatactttgcttttaccactgaaaggtgtttagaaagtacagaggtttgtaggaagcctcagggactaatatatcgtttgttaaatagttgtaaatagaggatgggattggacattaaacttccctcagtgctgccatctcttctacgacctctagttctgtctcaggcacggaagccttagctttgtctacttgtatttcacccttcctgaaacttatttcttaaatatcttctgtatattagcttccacttcatgtttttttcaagctttagactgataaggttctaagttttatctataaacttttgcaccctttgtggaaacaaaattctaatgataaagtgatatgttgaataagtaataacaaattaagacattcataaatttcatagtaaaaaaaaaaagtttccaagactgatgatattttccccgtaggtttctgtttgtatcaaccaaaatggtagaagtcataaagtcccttcatttacttactctgattttcatgtttctaatttggaagcattatacgtaatcagaatatataactctgtgtaactctatgtaatctctatataactcatttattaagcaatctctgttgcttcttgatcttttgggtaagatcagttgtaaacaatctgtatgttgtattatttttcaccaccactgcctccaactatgattttatttttcaaatctcccattttttaaatctcctaaggagacatctaatatttgataatcatttagtatgcaccagtgttagttccatactgattaccaaaatgttgaaatgttgaaatatttccaatgagttgggaagagactagtgcaactcctctaagacaaatggaccaacacgtgatgaagcagaaattccaatgcctggtactgcttaaggcctctgagatacttctgcaaccctgctggcctctgtcctgatcgatcagtgttcctgccgtactgattgttaagcattttgacacttttagctgtggacaattttagttcatattggggttaaaatttctatcttttttcctctctgcttggcagctcaggcctgacccatgacttgaaggacctggagtaagaaggggtatggcttctttcaagctcccttcctgcagctcttttggctttagctcctcaagggttatggctgggggagtgatgagatggtggacatggcacactcagcatacaattgcaacttccagtcatttgcccctgcctctctggctaacactaaccagctgctcttgcatggataacaccttcccttcatctagattaaatgattcacttcctcagagaggtcttttttctgaccactaagtctaaattaaccacccctcactgtcttgtcaaggttaattaattaattatgtagtacttaatactccttgatattcttgtttattaattaattaatttattatctaccaacatccctcacccccaccataaaatctaagttgttgagagcgtggaccttgtttgaatcgcttcctgtaggaactccagcacctgagacaggtatggcagagtgtgcccgatgagtatctgttgaaaggttctggaggtagttagtatcttattaaagaaagactatgctgttaactctaacaacaggccatcttttaagatatctttttggtcttggagcttgcacactacttgacttcttaaataggaagatagcttgttcatgtattggtagtgatggttgtgccaatcagagtaccacgttttactcttgataaagattatgttaccaagtgagcaggtaccaggcaaatggataggtttcctagaactggttactcttttaagtgtcattgctgtgcatagccttacattttctgaagatggggactgtcatgtgatgcagaccaaggactcttgaaaatgttgcatagatgacaagcctccaaaatctgtgtactttctatattttacctgtggctcaaggataacttgcacaggctagaactcagcaacatgtgtggtatgaggaatgttagagttggaaagaccccaggaacttatcctcactgatgtgcagattgaggcctagagagcagaagttgacttgactttgtcaaggccactagacagccactattaaactgctaatgtggtgatacatttttccttatgtgagaaccaattaggaaaatggaatcctggtttcaaaattcacatactttttataaaagcatttctttattatgttagtggattgcatggttttcagattgggagatgaggtaagaatctgttgcttcggaaatatttacgggaacagtaagggaaacaatctcataataatcacattagtcaaatggaatggtatatatatatcactatatatatactgtatatatatgtactatatatacagtatatatagtatcactatatatatactgttatatatatatcactatatatatatatagtgataacttctgtttctgtaggcatctgacaaattggcaaataactggaaatactacctttataatggttaccattatgttagaactgtactttaagcaagtatatagatgaaggatgtttattttaatattttggcttattcagtgatggtgatgaataatatggctgacattggcatgcttggttccacaaggaaactttctggtaataattttaacatttcatttaacagtacatctcaatgataaaagtaccataaaaatgaataaataagcatgtttagtgaacgctagaaagtataacctattatttttgaaatatattcagtgagtgaccttaacttttatttacactatattctatgggatattctattcagaagttcaagtttttttttttttttttggtcaagaccgtcagaaaataaattcatagctataaacttgaatggcttgcctaaaatattattaatttacctttttaaactttggtttgcaaagttcccaaatctgaaaacaaagggagctaaaaattataaaggggaactataataactacgtttataattaaagccaagttgttataagtgatacttttggtagcattcgctaattttgccttttacctcatgggaatgcattttaaatttagttttgttaattttatttgtcatcagatttctcgttagaattcatgtgccaccttcaagccactttttatcatcccctagtgactgagtaggctcctccctggacggttatttgccctgtttccacaccagactatctttgccaggctggcttcactaaatttgctctcttgctattccacttaattcctcttttattttcagactgtgattttttttttgtacttagctttttcccttttgtatttgttttgttttgttttatttttgagacatggtttcactgtcacccaggctggagtgcagtggtatgatcacagctcactgcagccttaacttccccaggctcaggtgatgttcccttttcagccttccaagtagctgggattacaggtgtgtgccaccactccctgctaatatttgtatttatttttagagatgggggtcttactatgttgcccaggctggtcttgaactcctaggctcaagtgatccttccacctcggcctcccaatgtgctgggattacagaggtgagccactgtgcccagccggctttttttctttagactagtagttgggttgtttcttagtccactgaggtatgtattgggttgttgctggggtttgtggggcagaggcaaagtagaggtctgattccttaaaggaaatcaacattctcaaacagaacaaggcattttaatggtaagtgcaaggatgtggatttacatttctactatatacactatgtgctgataaaccagcatgatctgccaggaaggacctgggagcagcaggatttagatgcattttagagggtagttggatgggtctaaagggctctgagtaagcttctagttttgcattgcttaataatgactctccaggagtgactcttaggtgccacatgtgtcctcaatgtttgcagatagtatgcagtgtataaactctccgtgaggtattaggaaaaacaccagggcttcactggctaagtagcttagctaaggtcccacagctggtagatgtttggaccttggtctgactccaagccaggactcagagccacgtgcctcttccttcataagttaaatggtctaatgttttattagaacattgttttcattcagcaaatatgtatgagcatctgctctttgctaagctttgccctaggtgccgcatatgcagagaagaagatgcagacctgcctttgagaaactcggtcagaggatggcagatccttccttttacttcatggtctattagttttgtgctcaaagtgctatgggaacacagtgctttatttcacttcaaaaatcctctattgatttactaagtggttggttttgtctggaagggaagttgaaggagaaaagttcccacagaggaggtgatgtgttttgaagcgggtctgagagggagaaaaagagggaaggatcctaggctgagggaacagcctgaagaaaagaatagaggcatgaagaggcatatatcatgggcgagagacaagaagcatcgagaatgttgagagtgaggagaggctagaaaaagtggaaagatgtcctagacctatgcattcaaaggccctgatgctgtgtgtacttcctgcagggttgacagttaacaaacagaacaaaaagaaaagtcttcatgtctaagattccatcaaaaccctttctattcagttcctttctcagcaggcaggcagtgacagatttctgctttggtgtgtgcagataactacttgttgctggaatgtttttcagtcatcaggcatgtttggaagttgtgaacaggttagaagggcaggctgcgcagcctcagttccactctcctgagctgagcctgtgtccacactactctatattgccttctttatgtaaacaaagagctattttcacacttcattcacaaaacggatggcgtgcagaatgaggctgggtgaaggatccgcaattgggataaaagggaggcagcttccaggacactgaattaaagtaatgaagctgttacatcacaggcaaagaaaacagttataacacttttaagatctcaagtttgtggaaaattaattgctatgaggttacacttcattgagtatctgcatcatttttccactgacattcattcgggtcccgtgtatataaatgctggaaagattttgtggtatttaaggatttgaaatgactgaattcttttggtggatgtactatcttgatgccatgccattttttgaagctctgctatttgcattctaggaaatccttgttcatgagtggatactattttaagcatttcaatgtttgcatgatagaaatatacttctgtgcttaaatatgcccagttggccgttgcacctgccctttgagtcactacagagatcagaaaccattaacaacagaagttgaatttacgtggtacttatctcctgttgtttctggcagttattttgctgcgtatttataaggacatctgtcttttaagtagtcataattatttatctttttttctgctggggaataaatcacagcttgtttcccataatgccatatatattcatagtctagggtgattagaaatgcaaattgagagtcattaaagctttataatttattttgctttggtagcagatgatatttaaaatcagtgtgctaagaagaaacatttgcttaaaatataagatgtgaacaaattagaagacagaagtattcatttctcctactggaaatttcttgctgggtctgggaaaagggggaaacctgcagtgttcgtttctaatttactgtactttaaacctgagatcttatgtcaggcagggtgcaaattgtaaagaacataggaaaaacacagtaatgattagtgttttcagattgctctatggaagcatgctaaagactctctcttactagagtgtgatttgcctttggattacccattaaaaggatggataaaatttagatgaatttcttatagtagttggtggttttgtgaatacactaaaaacaagggaaaaagttggataatgctggtatgaaaaatatagatctgtacatccatagcctgagatggggtgtcctagagacagatctctgctggaaatgcgttaattttgtagataataaaaggcatcaggggattctttgttttcaataggcagtgacatctctacaactatgcattttattattgactttacttttatttctaaacaaaagttcactatttctggagctataaatgaaaaagaacacacacatatatagatatacacacacacacgtgtgtgtgtatatatgtctgcatctaaagttataagaacactagtatgccatgaggtctagtctcttgtattgtagaggcaatacattttcatgtagagctccagaaataatgtacttttgtttagaaataaaagtaaagtcagtaacaaaatgcatagttgtagagatattccaaatttatagttttatatatatatatatatatataacagttatatatatatcaaatggcttcaactgtatctttgcattgtgttagtcactatggtcaaaactgtctatttcaaaagcagcaatctgaaaatagcaggcaatttcccaggtcacaatctggctaggctactgagagatgctgagtcgagatacctaattgataaatactaaccctttaaaaagtggtttttaatctgtgttttcttgagaatattagcagtcttgaggttttaagccatgataacgaagaaaaaattagtgattaagtcatctctattcttattttaaagaagtttttgcttcacggtgaaaaatttatctttaatctgtactgataactttgaataggcatcggttgggcaccccattaaactaacagctttaaaatggtttccttttagaactaacatttacatcctaggaaatcaattagggtgtctggattttacatttcccttgcaatctttgtttgcagtcatttctaagtggccaacctaccgtagcaaaaactcagaggtgcaaatcttctggaagaagtgtaaatgccacaagtttacttggaaaaatggaaaaataggacttatttaatgtatctgccgaacatttaaaactgcataaagcactggaaatacttttggtatgtaggaatgtgtggtgtttcaaaactacaaacattgttctgaaaatttccccggtagtggtgaattatatgagaccacgtccatctaaggaaggcttgtttaactagcctgtggttctggggctcattcaaacactcttaaacaaaataaagggaatggatgtaataacttctttatggaaaggccataaaaagctacagggccatgtaaacaaattgggtcatttactagatgtttaagtgatagatttgcagtccaaatttaggggtgtgtattatgttttataggatggtgaccatgttctaccttgagaatgaggttgcaagcttattttttgtttatttgtttgttttcgtttagtgcgtggaaatccattattgctattttgtattgcacttggaaagcatacctaaaattctgggcaattgcatttataaagcttttcaactttgaaaaatggctagaaactcaggtatgaagattgaattgatctgatttctggtatcattaggttcttttcaaggaaaataagatgattgaaatagaaattttccttctgggctcagacatgtctaaactaattgtaaaataattgttctggcttacaagagtagactcataactacaactatgtaaagtaaaaaatctaacaacagttaggatttatagttactgtcactctgccagtcttgtaataaaactgctattataaccaccctagtgtgagattcatttgtcttacttgagaagtgggcaataagtcctatccaagttatcttgcttttagcagagccactttattgcattaggatattaatttaccttctctgaaattgggtatgatgattgtgccaaaatggttcagtaaaggggagttgggtgggtggatgtataaaaatatgttgtgctgcgcattaatggtgatgactagtggcaatgggagctagaaataaacttggaaattgaagtaagcacaggaaacgaaataatttttatgttgataccataacatttattcattctgtaacttctgtcaaacatggttggctcatttggccttaaaggaagtgattgtgtaagaaatccttagtaaaaatcaatgagcctttctaagttttgaaaactgatggcatcataccacactggcaacttttaagtgttactgctggaagtttggcagcagaaataactgcttcagcttcacagtcttaaaaaacaacagacaatggtggatattatagtttctgtgtaatgtgtgacttgctagttcctttttttttttttaaatgagtaacttgatggccttaagtctgtgaataaacctaagacctgcatttaaactggattttctgtgatcttgaaaacaactcacacttctatgccttaggtacctgtctgaagctgaggcattgtggaaaatgcaaagagaaattaggcttagtctctgccttcaagtagtttatagccaaagggagagagaagacatgcagttaggtatattagagaataaaaagcgatagtatcatgtttggtgggaattcagagaaaggcaagattatttagttgagccattagaaaaggctgagaaaagttgttaggggagatatatattttttgaacaaaggggccaggaaagatgagcatcatttgcacgtgcagaatcaaaggtgggataggattttggcagctggaaacctggtgagtagatatgcgcagtaaggaagtgtgggaaattcatgcagtctaaaatgcagtttgttttgaggcagacctcagaagcaggttcagtgggaaggtcattggaaatgggaggcacaaagggaggaacattgatgtatgacttgggcttgagtaaatagaagagtgattcttcatgctttattgtgagctcctttatccacccgcccatcccagctatgcaggcagccaaattatgaattaaatctgattcctgatggcacatacaagacagaaacagaatgaaggttgctgaacagtgaagaataaagtcagaaggaaaaggaaatctcacaggaagaaatcccctgaagaggaagccatgaaggaaaaaaagtcagtgctatcacaaggtggggagtgaaggatgccaaggaaggagagagagaaaaatcacagaaattggcccagatgataaaatacagcagagactgaaaaaaatgaagaccaatgagtagcctatgatttttccaggttgacacaaagaaaaaatcttcagtgtaataagtggtgtagaagaatggacatggagtaaagtgaggaagtgagacatcacgtttttaagagagaaggagatagtggttccaggatggaaggaaacatgttttgtttctttgcttgttttggaggtttgggggagagccagaggagaggaaaagattaaatgtgtagcaagagataagccttctatttttagaaagttctcctaccgttgatattggaacacaggtgaaataactgtagagcattaagccgcataccaaataatcacaataagaactgagcttatttggtagggaagtaggtactaagttttggaggaagtgatccttgagataatttttgaccaagcgagggattcagcattcacagaacagcttctcgccatttttcttgaaaatctgtcttattgccactttgatgtcctggtacctatcttgtggaaacctcagttccattggaacatccaattaacgtgtatatttagaggacttactatgtctcataatctgggctgctcttagcactccaagtctgagaaagcaacttaaaactaatagattttgtcctgcttaaatattattccttcacaatatttcaaaatatataatatagtatgttaagtaagcatggaattattgtcaagctaataagtacatattaacattgctatttttaggtaaaataattatctttacatttttaaatttcctcattctcactgtcatcccaaaccaggtgctggttacctatgacctaaactgtggcaaagtgttcttattcttccttctatgactcaggcttttccaatgccgtgtcacccacaatcgatcatttgcaggaggttaatgtcagataatcttcttataatagagttctggttgtgtctactctagtcaagcttggattggtgcttcataaactgtaatatacatacaaatcaccttattaaaattcagattctattttagtaggtcttgagtgggacctaaaagtttgcattttaaccacctcacaggtgatgctaatgccatcggactgaggaccaaactttgagtaaggaaagtctacattgttgttctccatggctactgtgctgtcaccccagtcttctaatacaaaaattacacaaaactgacctctgctcaccccagagatctgtactttcctaactccatgtattgctctgccaactctttcaaacaataaattaatttaatccaatacacaaaagtgcgtgttgtggtgattactgtgtcacatcctgaaaacaggtaaacaaaatgtcctttgtgtgcttgatgttcataatcagtgttgtttgtattacactagacatatgcttagaatgcccaaggactcagggatgttctacttttgggtcaggaagggcttctcatggggttatcactgagtagggtcttgaaggacaaataattcaccggaaaaggaagagagagttctaagcagatggtgcggacttgtgagagagtacaaagcctattcaaaaatgaactacttttggtgagaagtaagattgaaaaattattcattaattttgagggctgtgtcagacatactaagagcatgtttagatgcaaactcatgagatgcttgggcaccactgaaggaccttggctgatgggtaatgattatagccttctgcgccaattcctaataataagggtgtgtctttttgtttatgcttgtattcttacacctataacagatcattaaatattcataaattaatcaggtttgatttttgttttttaaatgcattttacatttttcgtattattattttatcagcaaatagggtttttcccagctttgagtatagctgacaattaaaaactgaatgtttaccaaataaaatggaatgttttgatatatgtatacattgcaaaaggattaccacaatccagctaattaatttatccatcacctcacgtagttatctttttttttcgtggtgaaaacatttaagacctactctctaaacaagtttcaaatatataattgttttctttccaaaataaaggtacttcaggatgattgtaaaggacagagaagctagaggctgggacagcattttgaaggcatttgcagccgttcagatgccagacagtggaaaaatagccaagtgagttagtgcctggggtgtggaatggaagggaaccatcatctctccttcatgctgcgtgttcaaagccaacgtggatttaaggccctgtctgactggtcccctctccgccccataaagccttccctcttgccttcagtctaatatgtctctcttctctaaactctcagaatagtgcagaattgaccactttctaccttggattctaattatatatgtgttttaatctcccataattttcaagtgtcagagaataaaatgttgaataatctctagcctaatgccccactggatggcagatcttttaagtgaagtgaaaacagcccacttagacccaacacagcttgttctgctgcagtcttggcatctggtgtcataaatcatcattgatgggttctaaacgagtcatatgccttatttcacagctgggggatgcgcctaacgtctggcttcattttaaggaactacaaggggctaactggagagcctcaatctttttgcttagactgagtaaaatgaatgcacaaagaacatgattggcaaaattataatgatgactgcttagaatgttatttcctcaataagaaaaaaaaatgtatcatttccaggaaacttatttttaaacagggaactttaggataaagttttattgcaatcaatttattatagagaagagcatgaccatcgcaagttcattttcagtaactttgacgtattttttgttttgaattatttccccttttgctctttctagttaacataagatataactcatgtgctttcttatttttagtttgtttttctcttttgctttgaggttttgagattgacaactgtgatttatcccagagaaggcaaaaatcttgaaaaagtcagtcttttaaaaagtcactcaaagaatatagttttttttcccttggaaataaagttgattttctcagctctgatcctatgagattatgggcagaactaaatagtccttagttctggcatgtggacaaaacagaagcagaccctggagagagagttcaaaattcatgacagtaagcacatgttcggtatgccaatatttatggtgtcacaaccaaattgaaaccataaccctctgctatttacgtaagtatggtgcccagactgcacaaggttatgcctatgtttcccagtaaatttaaggcaatagaaatgttcagtacccctagagaccagactatttattttcatgttcattttgtttctctatatgaggcagagtgaattgtcttaatttatattcatatttgaagtcagccagaatgagaaggaatggcatttagtgaggatagagaatggttttgtgctttcatatgtaatgtatccaggccattgtgtcctggtattcttagtttctgagctggggtgagttgggggtattgattattgatagtgaacatagactgcttcttagatgggtaaagctcaatgttcgtatcttacgtcttatgctcttagagaacctgggtttcaccactttggtcaaaaacagacacacatactgttggtaagaagtcatgttttatgtctttttatagaaactttgaaagtattatcattctaaagtatttatcgtccggtaaaattttaagaacaatgaagtttcagaaccactattgagagtacatctttttttctctactttttcaagacaaagatatctagtaacttaaattatagtaacatcgtcatgcacttgtacagcaatataaatgagaaagataatagaaaaaccaaatagcatatcacatttgctgaatgtgaatacgttcttaatgaacctttttagaatctcagactccttctgatccctttaccattagttgactttagtctagaaaacaacttggacagtaaccagattgctaggtgtctttagtaagttggctgtttgatttggctctttgagaggtggtcctatatctctgtcaagggaaagtttttcaaaacaattggtgactggaaaatgaggaatgttttgtgcaagaagggaggctttctcgtttacaggataaaagacattttggaagagtaactcccaagtaagcaaatgaagcttgactatgtaaatccttttacttaagggatagaatccaagatatttaagaagtcattttatttcttgagttcagttatttaaacattgtgcttaggctttttgttggtactccaaacattttattaagatttcccttggtgttttcataaaaagacaaaattcattatgttttatttgtaaataattgtcttaaacctagatgaaagagaaaacaaacttttctgtatcatattctttcagactagttattcagtgttttttatgccccaaatttgaaaatgatcacaaatttttcactgatctgtttatgtctaattttggtgctggaaaaataaaaacagattacttagggtgtttaaatcctgtacagattagtaaacaataccaaggaaatttacttggtgttactagaaggttgaggaaggttactggcttttgcagtccattagtagatcaatttgttaaatgtttagtgctaggaatctcatttatcaggaaatatcttaggcattggggagaattggcctgtggtatttacattttagtctagttgccaaaattgattttcacgttttgtgtgtgacttagctctttgtactgcagtagataccaggttaaagcatagttcatatcttaaaacattaatagattttgtttcagtgctgccaataatttcagtgagtaacaaaaaaactccacactttcattaaaatgttcttaatgatttctgtttgattttctacgtagtgataaatgttgccatttaccccagcggtttaataacaacaaataagtattacattttgaagaaacttggcagtatcattgaatgccagtgtgtaatagctaatctataatttaggttaattccatcattagtttgtgacttgaaattctttgtttctgactgtttcatgacttctttaagcacaaagaggatattggtagaatcaggtatgtagcaaaaggtctagaaatacagttttgattatttgaaacactagtattttaaaatccagcagatgcattcctttgcctaaatatattgtgtcttatgctataaagaggacacattttgttttgttttagtgtacatattaaaacagtttatatcccaaataagctaatatgactaatggttgtcactgccctaattttggggaagaaagtttgaatcagaaaagtgttcttggaagaagaatactcttttttcctatctatttaggcattcactggaactttctttacttctaaaatttatgcttgaaatggctcagagtttgtgtatgtggagcatattggaggctgattgtatctgtgagtttaggaaagacttaacttgatcccttgtgcaatgaagtctttcaaagaaaacgagggttttttgtttttttttttttttctataaggtagagtggatattcaggctcagattttagctaaattaagaaggacctttctctgtccagaatagtatcacaaaattaagactggctctggaagagagacagaggatgccctcttttcattgtcatacaccatttgaattgtgtttgataaatttatattgtgaccttgaaaatgaaaccactcagaaatcctggttaatttctgccccatgcgtcagtctcaaaggggagacctgcctttgccaacagaccattcagtaagaaacaaaaatattaaaactccacaatcacaacttatatggtcaataatggtttcaaaaattaaaaaaattgatcctggcatatttacaagcaattatatataaatacaggaacatgtatattatgaattttctttaaactatttgcctgcattgattatagagagaatgaagcctcacaatgaaatctgattgaataaatttaaacactgttgtgatcacgagcgttgttttattaagtcactggaatgtaagatacatgaagcctgaaattttagttgttgttattggaggtttatttattttctcctactgctttatcttcaggatctagaaccttgcctggcaggcagtaggtactcttaacattatttgtttagtgaatgaagagaagggtgtaagaagcatctacctctggagataaaaatacagtgaggtgaaagagaagtatatattttcctttctccttgtttaggttataaactgtcatatccatagcgcctagatcagggcttggtagttactctgaaattgaaagattcaataagtgaatttttacatgaagaaaaatgtgaactgctgattttgtctgttatatcaattgtcattttacttttgctctttttgccaatttctagaatttttttcttatttatttcataaatttgtagtcatttagcaattcaacaattataaacatttggaagttctgtgtatttgtgggtataaatagattttttttctgatttaacactgctttcaaattgcttattgaactatagtggagaggaaaaaaaaagaacttttcttctacctcttaggtttagaagttaaactacaaattaaactgacaaaagacagagtaacaggagaaaaggcatattaattttattaatattttaaattttgtgtgcataagggcttcaaagtaaggatgtgaaaatcttaaaaagcagttagacttgggattttctataccgttttaatgaatggtgataaattgtggaggagtgactagacaatggaaaggggatttgagcttctagcgccaatgaagtttgggaaagtgaccaaaaaacatggggaaactaatattattatctaatcataacagataatgttattttagtaaggttattttagttaagtctgcatatacagtctcattccagcgccagctgtttgtctgtgctaagggtcactttcctcatcctggaatggagggaaagggggcatttatgtcatcttcaaaaaggaaaatttatgtactacttttcggcagataactggagaacggagaacttttcccaaatctgtttattcttacttgtcttcagctcaaaataatccttatgccagaaaggcatattttagggtgtcatactcgagaccccttcataatcattgattaaaacatatgactgtttctgatagcatatatagcctaggaaaaatgtcataggtagtgctggtggttgttggacatgctgttgcttatgtacctttgagtgaagctatttttatttcctgttatgcttactgcttgttttcctgaaggtaaagctgtaagttacaaatatatgtgacccaattcttaacagcttctgccaggactgaccctatatcatctcaggtatgtcctcaaggggacgtaggggaaggggaaacagttctgttttctcatttgtgcagtctttgatttccatagaaagtcaaaagtcattctagtaatacacacttaggaaatgtgaagtgctatgactcattttattttggctttgcacagtgtagaaaatttcttggctaggaagaaattccttttcaaactaccagtcctccccaaacaattctcctcccttctgaataggtagttctctctttgcacagacattcttctgggcttagctgctgtgtaacctcttaacccttcattaataatttcctgaggccagtttgttataaagaaatattgcagcacagacagtgtgtgagcaagagagagagagagaaagagcgagagagaaagagagagagacacacacacatactactttttaatgaccaactagaatggggttaatgctctgaaagaaataaaaaaaaaagtacacattagactttttccccattactttgcacgttaatcaaggagatcacccccttaggcagaaggtaataaatacttttcaacttctctctgttattcagaataaatggctcatttctatattatacacatatttaaatgctttgagtatttaaaagaataatcatgaatctttcaaagaattcttaatagtaggagaccgttggtgagtaaatttatctctttttggttcttaacaaaagagatagtctctcttttcttgaagaaatcaccaaggaactggatgttttcagagatggacatttgggcttccactctcctgcgctataatcctttctcacctttctcatatttcagcagcacaggacctcggtgaatttcacactggtcccttggctagccagtagagcaataaacctcccatgagaaatgctgtgaattacacagagctgtcattactcaggggatacggggcaatgatcaaaatgctgcctccacagagaaatgctcacactctaatgttaagtgaaaaagcagggtgagaataagattttaaatatttttatgtatgcccccataaatatttctatgtatgtagaggaactagaatgaaatacactaaaatgttgtaagtatttcatctataaaggctgtagggcagcggtgggggtgttggtactttcctttctaaaatacatagtattttccaaatttcctatagtaagcttatattactactatattagaaacaatgctgtgctaattccttaaacctaatttaaacagagggttcagggaaggcaaatacaaatagcattttctcctattgtaacggaaagcaccttaatatgccaagactttttttagaagcctaggaggtggcattcttaaaggtggcccttcaggcttaagatttaaaattggctcttaattttatcccagagctcgatgtggatatagtcaaagcggccgcagcagtcggtgcaggagagccatcacaacaattatctatgttgtttttggcagtttataagaaatgttgttttcacaagacctaagagttttgtctgggaagaaagaagatagctgccaacatttggcaccatatggggttttcgtcttttccttttttttttttttttagctgtacatcccctcttgagccttgaagatcaagacaatattctgggaggttttttttttttttagtacacttgttggaaacatctggaaaatgccattaggttgcacaccatggacttcatttatagacaagtgtgtgagataaaaaacatggaaagaaaatccctgctttgcagctgcattctatggcacaccatccacagtgtgtgtgtagaccgtagagacttgctattcacacttattgagactagcagatcgagaaactgtaaattaatttccctttctaggcatagaatgtccgtcaaccataccagaacctgtctcttattgaagtcaggcagtttctgattttattgctactttgcttttaccctaaggctgcacattcacactctccacagtatatggacatcatagtcaatgtagaatattttgtcctaggaaatattatttagtttttggaagaaacactgcagattgtgcttatgacactaaactgaatcaaggattcagtttaaaggattgaggggaaaaggctgatagtgacaatctcgtttcttagacctctttttgctgttatacctcaactaaggcagttgttttgtgataccacctctcattaatttatctacacataaataaggaactaagcaacaaataaataaacaaggaaacaaaaccacacagttttatttcctgaatttcagtttttcttgttgtcctgtctttcattgtcatccttcattttgatgtttacttagtttaattccatgtttcaaatgaaaactactgtctgcagagtctagaacccctgaaagtgcattagctaggccatgtcaggggagaactttaaattaaaagagagttttgagtagaaaagtaaatgtggagtcttttgagtagggaaataagtgccaaagtaaccctctgtgtaacctgcagctagtccatccatagcagagggttacagaaccacagctgttcatacacacagatcctgaataagagatggctgggcagagggcttgtgtgcgttcctgcttttaccccttttagtcttttatcttgtttacttcttaggagctagaatcccagcagatgagagggcgatctctttggtccattctgctgacctcccttctttatgtcatttgaggtttgtaatgttgactcattaacactgctttactaggctagctgagcagagagattcccatttctgcttccagccttcttaacactgcaactgagatttctctgctcctgcttctttttccctgaagtaacattaaaaattatttcaagcattcctaagtaaactgggtgatgtcttcttactgcttttggtctggaaattttcaagggcaagaaagtcttaacacatatgaaaacatgaactgggagtgattgagatactgtgttgcctagccctctccttctggtctaagtgaggtcattttctaggaggtgaagtcattatcttagtcatgtatgttgttggcagcaagactagaacacaagtccaactctcagtcccgggctctgtctgtctcatcatgacgtgtctttctgttcctgtggtcttgatgataaatagataaactctggagaaaagacagtagctcttccttcggggacctaggcaaatttgagctcactattacctcagaaaaggggttgttgtttaaaatcctgtataatttctaatgccatgctcattaaataaaataataccaaggccatttttcatcacaaaggtggaaacctcactatagcatgcttgtttataatttttattgataaatgaaatcatcttggatgaaataatatatagtatacgttaaagtgggttggttgcttttcctaagttatactttttatatttctgtttaccatatgctgtgaaaccaaagctattatttttgcctcattctgataacatagtccatattctaggtggtagataaagaaatatttcagcatttaccttaaaattcttgtttttttaaagttgtttcctctctatcttctctgccagatgtgagtaatactaacaactagtactttctgtaggattcacagttctgtctgcatattccataggctgtttttaataggcaggacataacctactttcattcagtttttcataaatataacaaatgttacatagtttacaagaagaaatatcaaggctaaagcctcttgttggcatgataactattgccaaatcaaatatgggaagaggatagaatatgaattctaatttcttagttccagtagttgatttggatcagacgcgatcagctcctggcagcaaagggctgaaatccttctgataatgagcctggtgatttaggagtcagattgggcccatgagtgaatattataatagagggagagagtggtacaatgttggatgtttttcagagagaattgaaactaaactgctgagtctctttggtcattaaaattcccaaggtgctttttgcaagattatgagtttttagccagcatcctgaccaaatgagtaattgctctgccaatcgctcctgcaatttcatttgtacaaggtcattgcatccacttcctgagctaaactgtcacattaagggagagtagcctctttgagagagagtgatctctttaattcacaaattcatttgcccccctgctttgggaaaagagacagtagttgcttagcatctataaataggagctatattttttctgtttttccttttttcttataaatctttggtttttggtttagacttctgtctagaagaaagcatattactgttgtgaattttccctactgattatatatatatatatatatatatatatatatatatatatatatatatatgtatgtatatgtatatatacacatatatataatttaaaatattaagagatgtctataaaatctgtttattattcatttaacaactatttagttagcatttatgacatatgcagcaagatactagtcacagattaaaaagcaatgagcagaatgtacaaaacttgtggtctcctggagtttacatttctattgaggggagaaaaaaggacaaataacatataaataagtaaactattggtatgatagaaaatggtcagtgctgtgttttgggggttagagagtgtggggatagggcacattgttgcagttcgaaataagtcaccgagggctgactgagaaggtgactttgagcacagatcttgcagagatggcagagaaggccttcacagacagggccaaggggagaggcaaatgccctgggtcagaatgtgcctagcaagattgaggatcagcaagggggattgtgttctggagggggtcatgtagatgagtgatgaattttatatagagatgattatttctgccgagtgagaatacactgtaggggagcaagggagcaaatgccgtgatagtgacttaggccagagcaaagtaggtaagtggtcaggttttggatttattctgaaatgagagctgttggtatttgctggcggactggaaattgggagttgagatggattgtcaggcgccagcctgaaggtgccacctgtgggacttggcaggcatttttgtcttcacatgcagtttttgtcttgaaaatcttcaagctacttgttaattgccctagcgtgctaacagtggacacatgaattgattgtgatggtgaaagtatgtaagagacacacattggtgatggattttatttttcatttttaatcatgataagaagtcagtgcatgtgagtagatcaatagaagagaaagaagcaaacattgcattgatttggaagcatataaataatgcctagtggaagacaggccctttttttatttacagaggaagatgtgccagaataaagaattccatttagtgataaatatagctaagacatactcagtgtttaccatctactagacatgcatgtaagctcttaacacatattgatacctttaatgatcacagaagacatttgagtgaaattactagcattaatcccaatctaagaagaatttaagccacaagccaaggtcatgtggttttcagcaagggcagtctggctccatggcacatgcctttaatcgttacagtgcctctaatagccactttaatttgttagaactaaagctctaatttggctaggtgctaagcagacttgctcaatttacagtttcatttcttaaatgtagacaagtcaacgagagttcttaaataccttggagtttattcttactaacacaacatatttgttttaagggaaagcctggacgtttgggatgaggaaaatccacagtggaagaaaaggcagagtgtgaaaatatggcttagtgaaattaggtttaaattctggtttattcactttttagttacatgatcttgacttcaccacttaacccttctgagcacttaattctctaatttgtaaaatgttaacattaagaactagttcacagggacttctggcaacatgcttggtctgcttaatagattttagtttctctgcccatcttcttggctagatagactgaaaatgaatgtaggggtttctgaaaacaaattgggtcgagtgaaaaaaaaaggtttgatgcagggaggccaataaaacactccaatgtagctccacaggagaacatttaaagcaagaggttttgtgcacttatagtggtgcttgtcagagttgaaagtgcatttgaatcctcccggatcttgttaaaatgcagattctacatcagtaggcttgcgggtggggcctgagattctgcatttctaataatttgatgtgatgctgatcctgctggcctgtgcaccacacttttactagcaaggacatatgaaaatagatttatgaagaagtaccatgggaatttagagcgaataatatcaaggttgataccagtaaaacagtttaacagagcttctcagagatgaaatgagctacatcataggtattaattccctgcctaaggctgtatttgcgtcatttctgatctgtgctgttgatatattgatacaccggggggttgagccagacttgaattttctgttactcattggtaggggttacccttaaatagaagtgagtagagcatttaagcattattagttacataggttcctgggctatagggcaccaagcacagattttttcgagggaattcactcactgaaaagataatcagattaaatgactactaatgctcattttaaccttgggataggacgttaagtcacacatactctagccgagagggataatctgagatctgtatggtatctgtctaacacatattactaagcagaaatctcagaattccttaaaggttttaagaggaaattattcattgtattcataatcattcatatccatttgattgctctctaatcacaatattgcaattatacataattatatattgtaattatacatgttgttacaatataattataattatacatatataattacaatataataatattataattatataatatacatgtatattatatacatctattcctttagtgtattggtagcagtattttttttgtctgttttaggtcttggtgatttgtgctcttactgtttctcagaatttttcaaaatttagcctgtaagttactaagaaatgtaaatggatagggcatggttattgacacaaatacattcttcttttcccctcaattttcatacagctgtagtgttactagaaaaaagtatctatttatgggaagtgtttttctcttctcctgtggaatcttaaaggcttattttcaagtatttctagagctgccacctgttaaattatagtgattctatgctttgtagatattttttaatcatgaaagaagataagctagaaaaataaagtacattcgatgttggaaaaatgttacaggctttttgaatcctgtttgcgttgagctcttggaccctcctcccctggccagccttctggagcgcctgtgagcacaaaggaatggcatgtatttatacttgtgtaaatacgatcctgtatgctctccactgagaacatgcaggcggcccttttatggtcaacaaggggttttccctctcgtctttaggcagaccacagggctacgtgctcaagagtgtatttttgatgccatccatcagaatgctttcataatctgcctcccttttataaaatcttggaaatgactttgttatacttgcctttattcactaatagatcatccaggaacttatgaagactttcatgtaaaacgtcaaagttcttttattttattttttttctaagccacctctgttcctgttcaatttttactttattaacaggctcttcttgcaaaatagaccatatcaccttattattttgatcacatatctcaggactctcagaattgttggtattccttcaacgaatatatggtatcttattttatcatgtaagtaacttcaaattttgtctttgatgaagtctcacgtattcatataccaaaaagaaatcgttaaccggcccaaaagttgaaagaaggatcatgagtgggtagtgtttggaaacagcattgagcaaacacattatttggtattttcttttgccttggcatttaaaaaatagcaaataataataacattgattacaataacattattttaaaactgatgcattctagaaaatgataaagctaatgataaaccaccttgtttctctcagcacagtattcctgtgaaagctgtttggatgtccagctctaaaacaaatgttctgtctaaaattacagaataaagtttgtggagaggcaataacctttcatggttgttgaccgtcatcccgtgcagtttctcatttgtaagaggatatttcattttcaatcattttctataaattgcttaattgcatgggaaaaaatgttaaatagcattacttttaaactgtatacgttattgaagaaccccttcattatgtttcacttacctcacagatctctatctatcccttcagatttcagctcagtgatcactgcgtcagtatggtcttcattattaattcacaatttagtttacaaatacttattgaacactaactatgtgctaagccattggtcttttgggtcttaagagtctcttacacctgtgaagactgttgaagatgccaaagagcttttgtttgcatacattatatctattgatagttaccacattgacgttagagccaagaaagttcaaacatatttatttgttattcatttagaaatggcaaggataaacacattaacatatttatgaaaaaatattttccaaagtaaaaacaattagtgaggagtgtggtattattttatagttttgaaatttgcttatgtctggcttacttgaagacaactgaattgtcatatctgtctctgcattcagtgatatcacacagtaggtagccccagacaaacttgactgtacacttataagaaaatgggagtgaaaaaggcaaaaaaacacctcttattattattctgaaaatactttagatgttacagacccacaaaaggatattctggacagacacccagaaattcccagaccacactttgagaaccttagacattgggtatcgatcagtgcacaaaaaggcacagatctcttcctttgagggcctctgtttattctaagagtaccaggcaatttccctttttaatagtttaattttcccatggcaaggtagtctccagaaatgtcagggacttgtttttgaatttcacgcattgttttacttttctgatctccattattaaacatttattgagtaaatagataaaatcaattgtccagagtgttgaatatatatttcataacctatatttagggcatttactttactatttaataatatagacaagattccaaaattttagaaaagactggcttaactctctggattaagtactgtaatttttgaactttttcaggatacttggaaatatttaagtacccaggaaggaaaggctgatcttgaaattggaaaacaattgatttgatgtaataactaggtagatttcaatatggttctttgacttcaaaccagtagtttgattctttaaatatgtatttttagtaattcacattgttgagcaattaaacgctttcatatgtgactaatctacttgaattattgttgattgcttcagatattctgaggaaatgagaaaatcagctttttcctttgcatgtcattctatgtagggaacagtgcttctagaaactagtgttgcagagcaactgcaattgtttaccaatttcagtaacttcctttacagtaagcttctgttaactttatatactgtaatcccaagtagttatatttccatttttatgttgcattctgtcaacgtgaggctggtagcagttttagaagttttgtattatctgggtaatatttaaggcataaggcttgtagaggaatgatcagagttagaaatcaattaacacttcttagaagggggtgttcatttaatttctgctgaggacacattgatgtcaacttgattttgaaaggcattttatgtaacaagccacaatttaaatataaaacgataaaacattttgtgcatatatttcatttggctaataatacaagtctgatgtgaattccacattgtcatttaagtgaaaaatgtgttttcttacatataagatttgtatagactcatctcttcaagcccacttttatgagcctaattttgttttttaggtttatgtgagaaaatccagtaactgagaataaggccttgctgactataggattttatttcatgtaaggttgaaattgcctgttatttcttgtttctatatctgactcatcgagttatttttctagtgaattcacattgttcatgatgtcagtattgcaagtttatgcacatattattgtataatacaatgtaagataatcagaaaaagatataactttaaagcggtgatctagtaactacagtagagctttagggtagagcttggcataccattaagcctaaaaaacgatatgtaaattaaatagccaaagttctttagttaattaataatagaggcccagcctttattcatcttaaggctgagagagaagccattatattgtttggatgcattcatggacaatactgaatcacaaattgcagacccaaggagggctgtattctgtactggttttgacctcttgttaataggaattatgatatttgatgggattgtggtttttactccaagtgaatttggttttaaaatttaaaattactatacctattttaatacttagattatttttctaaggattgaacaatataaaataaattgtatttatattaataatagtttacttatattatttataatgttgttgtgctattatattagtatgttcattaaagtattaaatatacagatcatagataacttttagatttttccttttgaataaagtgcctaaaattcacttgcaaataaccacttttaatattttcttacacagctttttataactttttacatatgaatacttactcatatctttattttttacaaacatgaaattttatatgtatgttattaaacatgctttttaaaatctgagttttgtcagttttttaaatataaatattgacttgttattgccatggttcttacactgttttagatcatttgatattataaagaaatctatggaatatttccttccctcaaaaaatgtatctgcaagaaaatgtataaagttttatgggtcccaggaccatgaatctctgatcaagagccattggtcatgtcatcagttcttaactgcttcatggattctaacttaagtttacacagcttaagttttatttaatcagcacgttatgattggattctaggatttttttatttagcgcttaggatctgctctacagtgaataccttggtatctacataccttttacatatctctatatttctttcattagagtgacttcctagaacttgaatgattggatcaaaattttaccttttttcctagtatgttatgtatgtgtgtgtgtgtgtattttcatataacaaactaacttaaaattgtaaaaatttgtcctttcgtaagaaatctgtatgtaaaagtactgtttcacctcatttggcataattctcccaatctttgccaacctgatactacacaaatttaatatattaatttagtaggttgtaaatgtatcaatattaagcacattattaaaattgagaagaatttttagtccctggttttgtttctctgtaatttcttcattattctctaaagaactttatcttaaggtaatttttttttccaccatgaatcaagttgctactgaaatacatttgcctttcaaccaatattagggttgtattgtattgtgtaaacacaggaaatagtttagagatttcaggcactttagaaaatatgtttccaccatgttcagataggtgaatatgcctttcttatttatttatttagaaaagttttgttttgttgcccaggttaggttgcagtagcacgatcacagctcactgcagcgccaacctcctggggctcatgtgatcctcccacctcaagcctcctgagtagctgggactaaaaactgccaccatgcccagatgaattttttgtattctttgtagagatggggtttcactattttgcccaggctggtcttgaactcctgggctcaagccatttgccttcctcagcctcccaaattgctggggttaccagtgagccaccgtgcctgaccacctttcttatttttaattattcaagtaatttctttgaatcttcacttagggtttcattgtggtggtctccagaagaaatacctcatattgggtttgcggtggaaagataacaagattttttccagctttagacataattttatgcgttcaaattattgagaaacaagaatcaatgctttaaatgatgatgtttccaagattgcatccttgatccattctcttagtatatccttttcttcagaaatgccttctatcactatggcttcaataaccatgtatttattgataatttcaaatctcttttttcagcacacaccttgcttttttcactcagactcatctgtccatatgcgtgcagtgctgtctacgtggatgttcccttagtgcttcaagtttgacatgttcaaaactgatcttatttctcagctcttaaatttggttctggtcatgaattccattgcatagagcataatatttttcatcaaattgttcacatcagaaacctgagtccctcttcttcgttcctattttcaaatgttttccaagatctgtttttgctgcttcgttgacataccttaggcattcctttcagtcccctctgctgcttagttcaaggcaatacgatagtattcctgattactgcagtaatctctaatttgtcattcttcttccattcgtctactccatcccatccatcaacaatggtgtccgacatgtcagtcttttaaaatttcttcacagctctgctttgcgtttggataaattcaagttcctttgcaagacttttcaaatatttcctctttttccaattgccttttcctgattcttctctagtgtttcttctatcctacactcttcatctacctcatgatctaaatacatggagaagaacagaaagctgagtgctgggattggtaggttccagagaaagggtaaaaaactgttgttgttgtattttttaagacaaagtaatcatttattaaaccaactaattgtattagttcttccctctcctttggttaggaatgagttgagaggtggaggccaagggggagagagacctgaaatgtggtagaaattctcctctgagagtttccatttctcccaattttgatccattcttgagatgcagtcaaggtttgaagtttgaatactctctaggggaacaaggtcctcctcatagtacctgaagaaagatactttttgaaactcattctattacgacgttgggtggatactgatttcactaaaagacagatccaactgtgatgggaagtcacagagctagcaagtagcaaggtgtttttagtattttctgacaccaaccaaagagagtgcttatttatattttaatattaatctccaatgaccataacaggaagaggaaagatactgatttgtaattacaacttcacatgtattttcgttctagcaattgtcaggttttttcctcccctgtctatgacccctaaatagtcagtatatagattttataaaatgtgtacttgacattttaatttccttgagggcagggaccttgtataattttgtattcatgttgtttaacacaagatctagcatatacagtgtagtctcatttttcatggtattgatggtctgtaaagccattgcaaacactaaattaatgaataatgaactgttgctgctatggctcttacaagattaggttcctgcgagttcctggtcacaacatattcgtcagctgatcaatacaaaccttattttatgtgtgtttctgtataaagacatcttatttaatatatagtcatgtgctgcataaccatgttttggtcaatgatggaccacatatatgacagtggtctcatcagattttaatggagctgaaaaattcctatcccttagtgaggttgtagctgttgtaatgttgtagtgcagtgtattactcacatgtttgtggtgatgctggtggaaacaaacctcctgcactgccagccctgtaaaagtgtaggacataacattatgtatagtgcataatacttgataaagataatgaatgactgtgttactgatttttgtatttgctatactatttattattttagagtatattcctattactcatatttaaaaagttaactgtaagtcagacatggtggctcacgcctgtaatggcagcacttagggaggccaaggcgggcaggtcatgaggtcaagagatcgagaccatcctggccaacatggtgaaaccccgtctgtatgaaaaatacaaaaattagttgggcgtggtggtgcacgcctgtagtcccagccactcgggaggctgaggaaggagagaatcgcttgaacccaggaagcagaggttgcagtgagccgagatcatgccactgcactccatcctggggacagagcgagactccatctgaaaaacaaacaaacaaaacaaaacaaaaaaacgttaactgtaagaaagcctcaggtatgtttttaggacagattccagaagaaggcattattatcataggagatgacatgtccatgcctattattgcccctgaaaaccttccagtgggataaaatatagaggtggaagacagtgatattgatggtcctgatcctgtgaaggccttggctaatgggtgtgtttgtctcttctgtttttcattaacaaagtttaaaggtaaaacaaaataaaaaaaatttaaaattagaaacaagcacatagaatatggatataaagaaagaaaatacttttgtgtagttgtgcaatgtgtattttaaactaaatgttattgcaaaagagtcaagttaaaaaatttaaaaagtttataaagtaaaaagttacagtaagctaaggctagtatattatgtaagaaagtaaaatatttaacaaatatatttagtgtagcataagcatttagcctttataaattctacaaaagtgtacagtaatgtgctaggcctgaaaatcactcaccactcactcactgactcactgagagcaactaccggtcctgtaaactctgttcatggtaggaactctatacaggtgtaccattttaaatcttttatattgtatttttgctgtaccttttctatgtttagatatataatacttaccgttgtattacaattgtctacagttttcagtacaataacatgcttgacaggtttgtagtctgggagcagtaggctgtactacgtagcctacgtgtgcaataggccataccatttaggtttgtttaagcatgctctatgatgttagcacaatgacaaaatcgcctaaagacacatttctcagaatatatcccagttgttaagtgactcatgactgtatattggtgattcattaacattaagcacaaggcactataattcatgcctgaaggaagcttatctaacacacatattttctctgtaaagtcatgtgttagttcattttcacactgctgttaatataaagaactacctgagactgggtaatttataaaggagggagatttaattgactcacagttccacatggctggggaggccttgggaaacttacaattgtggcagaaaacaaaaggtgaaaggtgaagaggaagcaaggcacgtcttacatggtggtaggagagagagaggcggggaaagtgctacacttttaaaccatcaggtcttgggagaactcattctctatcacaagaacaacatgagggaaaatgctcttatgatccagtcacctcccactaggtccctcccttgatatgtggggattacaatttgagataagatttgggtggggacacagagccaaaccatatcaaggcacatcatagccttgtgtcaaggaacactagacagcacttcagcactatgctttgggaaattttaaacagcaaaattaccaaataatagcaaaaaattgagaacaacctagcactaaatatgctgcagaaaggatgcttgtttacagtttgggagttggaacaagaaggcagagcatatctttgctccacctcagctgtgaacagcatcatcttgggtgacttaaagttttgtgttgctctgtgtctgtgcatgtctgccaacgaccacaaaagatgccgtgtattgattttggggttgcaaattaattgtagccagtaggtgaattcaccaatatggaatctacaaatagtaaggatctactgtagttaagtttggatatcttattaaatatataagcagcatttcatttcactttatgacaagaacatacagctaatagctagtgatatctactgtgggactgcatttcattagatttccttcatttaggtctttaaagaaccctatgaattagctgactttcttgtacaggtgaggcaaccccgattcagagaaggcatgggatttgcccaaggtctggcaggtagggagcggcagagactaggttctcaacagacaagcctgcctctaccatgtgatgatgattaactttcatcccatacttttgtttacttcactctttgtgtgtgtgtgtttgtgtgtgtgtgttagaaacttctttttttttttaattataccttaagttttagggtacatgtgcacaacgtgcaggttagttacatatgtatacatgtgccatgttggtgtgctgcacccattaactcgtcatttatcattagatatatctcctaatgctatccctcccccctccccccaccccacaacaggccccggtgtgtgatgttccccttcctgtgtccgtgtgttctcattgttcaattcccacctgtgagtgagaacatgctgtgtttggttttttgtccttgagatagtttgctgagaatgatggtttccagcttcatccatgtccctacaaaggacatgaactcatcattttttatggctgcatagtattccatggtatatatgtgccacattttcttaatccagtctatcattgttgtacatttgggttggttccaagtctttgctattgtgaatagtgccacaataaacacatgtgtgcatgtgtctttatagcagcatgatttataatcctttgggtatatacccagtaatgggatggctgggtcaaatggtatttctagttctccatgctcacgggtaggaagaatcaatatcgtgaaaatggccttacttcactctttgaacacaaacagagtgtgttgttcctgagtttatacttcctttaactacataaagtgaatattatgcttgctttgattgctgaaaggtaaactcaagtgtattcacttagaaaattaaaaaaaaatcccttaaaagtgtaaattgtaggaaatgtgaaggtgaattagactcctgatcaaaacagagcacattaaatgttcttaataatagattaaattagcattacattagtaagtaaatatccatctcttacctcttttgtttatatattttctaaaactttgagctatttttacctcaaatcatatactataaatgtcagggttagtattgcagatgctctttaaatgttgctgtaatatatttcttatgagtaatgtatagaacaattttcaaaagaaagaagtctttaaaataaaaaagataaaagtacattccactacctaagttttctgttcaacacatgtagtttaacaaaaaaaaaactcctataaatgtagtgtttaaaatccatgcaaagatatgttccactgtaagtataaaccataattctgaataaatatctccacttcagtttaagaggatagttaacatagcaaatgtctgggtggtccaaagtttcatgaagcttgaacattctagggagtaggggccagtaaacttagtttctaatattaacagccttgcatttgtctattgtcttggccttagttgtcccagctctaataaacagttaaggtgtgatgctcttgaagattactgtgggttgtttttcttggatagttatgaaagagaatcactgttgactcacctcccccacaggccagctctgtgattgtcaagtgttccaaagcacatgcaataaccgaagacgtgaatgcaatcctgggtgacttaagccttcatggatctttgactataatttaagtttccttcccagtagaaatataatactctttgtcctgtagcttggaggcactcttaacaatctttttattgtcactgttatcttttcagaaactctacattagccttcggaaggtaagccaaaaaagttttaataacaggaaatacctgccattttacccctaatacaaaagaattcatgtttatcagtttcaagttctggaaggtcaggattctgaggctgtcacgccttttgctttcacaattttttgtcagttttgtctattcagaatgattttactgcattccacacttggctggctaccctccatcccctcagcccctacctccaacaataggtagcaggaaaaagaagttaaaatacagttatgggattactgggcagggaaattaaaaccaataataagatgataagggaaagcaggtgaggctgaattttatgtataaacctagatttatacattttaaacctaaattcttttatttttatttttatttatttttttgagacagagtttcactcacccaggctggagtgcaatggcatgatcttggctcactgcaacctccggccttcctggttcaagcgaccctcctgcctcagcctcccgagtagctgggattacaggcgtgcaccaccactcccagctaatttttgtttttttagtagagacagggtttcaccatattggccaggctggtcttgaactcctgacttcaggttatctgcccacctcggcctcccaaagtgccgggattacaggcgtgagacgctgcgcccggcctaaacctagattcttaataattgtcttgagtataaggagtcttaactttataatgggatttcatttctgttttcaattacatagttgttgtggagatgccttatttaataaaatgtcttttaaggtagtgtaaacaattcattctccacattggtccccgccaaaaaatgtgatattaggatttgctagcctacagatcctacagattgattaagctcaaaaatcttattgcagtctttggatatcctttcagttcctcagatttgatgatgtttgcctgattttgcacatgctcttcccactgcctgaaattatttttacacaggtctgcctggaaaaatcatatagcaataacgacaaactatataggattttgtgaattaaatctacttttgaacaaaaatctcttaaatgcagatttcttaaaatctgcttacaatgtaggcgagttacccagtattcacacaatggcatataagggagatgaaaattaaagtatgcttttaagaagttagaaacatgtaagtctaatgacaaatcaatccagttagtcaaccagttcatttagcttaaatccagaattgaatggcaacccatttggtgttgtaacatctggcatatcaccatgtgtgacccaaagatttttttttttaacatttctacttgtgtgggcctttgagcagggctgcacacttctcaggacactacaagttctggcctgtcaacacaggcatcttgaaaggaccatttgaaagtaggagaggtaacttgtgaaatcaaatatttaagaatgttatcaactatttctaatatccataagtcactaaaggataaatagccagagaatattttccattctactctgcataaagattgagtgctagctccctcttttcttattagctgacctgagttaacccttactgaacagtaaatcattcactgaaggaagaagaggggaagaggaaagattttgtctctttggataactcttttgtgttttggtatattccggaaggctgtaagaagagagatttcatgtgcagattccatggagcaaaatgagttttgtttttttaaacggagagtagttctgttttttttattggcctttttttttttttgctacgaatgctgattttatgaactatgaaaatggtcattataagatatgccacttttctcccttttatttcctttctcttttcttcccaactaatatctcacatagataggttgggatatagaatgcatttttgttctgtaatttctaaggtttgaacagatactgataaaatttctttacaaatatgtagatacttgagtatttgattaagacttttattattgttgagtcatttcccaaaaagttgactgatttgtatattgtatctttttgctggttgccattttgcacaatttttcttttaaaactatttccaaattgaggtctcagtctatttcagagtatttaaatagcaagggtgttactgcttctttgactattgctcgcagctgaccctcctacattgccccttatagattcatgtatagagattgtttctaagtattccttctatttggaagagttcatgcatactctttatcatttctttgaccgttgtgttttattattttgcttagctcccatgtaagtacaatcgtgtattgttaacagacagttctcttaagaaccaacatcatagagataaacagtccttcagtaactataaactttattcttaggataaccaatatgagaaaaagtggaatctcttgtaagcaatgttttccaaaagtctattatggctaaattctgttcttcaggagttgtatactaaacagtctttaacaccataaaaggatatttctcatagtctcttaaaaatggtaaaaagaaactgaagcaatggatttaaattcagggatttctggagacaagtatagagcgtggattggggtgcaatatctctttgcaatctatgcatcttccagtctcctccatttgccattcaggcctcagccattcttcctagcagcaagtacccgggtattttactgttcagccagctgttctgagcctgtgtttcacctgtgccttacccagccaggtctttttcatttcttttatcctgatgcagtagctagtaatcccacggttacagatctaagtgcaatgcgtgaattttcaatctttaaagttaaaatcaggtagagctgcagttccagctacttgcaaggctggggtgggaggatctcttgagcccaggagttcaagaccatcctgggcaacatagcaagacccatctcttaaaaaaatcacatagacggatagataaatgggtgctattaaatgacctactgacatggtttagctctgtgtccccacccaaatctcatcttgaattgtgctcccataattcctacgtgttgtgggagggacctggtgggaaataatttaaatcatgggggcggtttcccccatactgttctcatggtagtgaataagtctcatgaaatctgatggttttatcggggtttccgcttttgtatcttcctaatttttctcttgccaccaccatgtaaggattgcctttcacttcccaccatgattctgaggcctcctcagccatgtggaactgtaagtctgattaaacctctttttcttcccagtcttgagtatgtctttatcagcagcatgaaaatggactaatatagtaaattggtaccagtagagtggggcactgctgaaaagatacccaaaaatgtggaagcgactttggaactgggtaacaggcagagattggaacagtttggagggctcagaagaaggtaggaaaatatggcaaagtttgggactccctagagactcattgaatggtttggccaaaatgctgatagtgatatggacaatgaaatccaggctgaggtggtctcagatggagatgaggaacttgttgggaactggagcaaaggtgactcttgttatgttttggcagagactgaagcattttgcccctgccttagagattcgtgcaactttgaacttgagagagatgattcagggtatcttgtggaagaaatttctaagcagcaaagcattcaagaggtgacctggctgctgttaaaagcattcaattttaaaaggaaaacagagcattaaagttgtgaaaatttgcagccagacaatgcaatagaaaagaaaaacccatttttgaggaggaattcaagctgactacagaaatttgcataagtaacaagcagcccgatgttaaccttaagacaatgggaaaaatgtctccagggcatgtcataggtcttcatggcagcccctcccatcacagacctggaaacctaggaggaaaaaatggtttcctgggccaggcccagcgtctctctgctgtgtgcagcctagggacttggtgccctgctctccagccactcgggccactgctaaaaggggccaaggttcagcttgtcccatggtttcagaaggtgcagtccctaaaccttgcagcttccacatggttttgtgcctgcatgtgtgcagaagccaaaaattgaggtttgggaacctccacctagatttcagaagatgtatggaaacacctggatatccaggcagaagtttgctgcaggggtggggctgtcatggagaacctctgctagggcagtgtggaagagaaatgtggggtcagagcccccacacagagtccctactgggacaccacctagtggagctgtgagaagagggccactgtcctccagaccctggaatgctagatcctctgacagcttgtaccgggtgcctggaaaaccacagacactcaacgccagcccacaaagtcagccaggagggaggctgtaccctgtaaaacacagaggcggagctgcgcaagaccagggaaacctacctcttgaatcagtgtgacctggatgtgagacatggagtcaaaggagatcattttggagctttaaaatttgactgcccagtgaattttggacatgcatggggctggtcgcccctttgttttggccaattacccccatttgggattttgttccaaatgttgctggaatgcaacatttgggcatgaaaataggagtgcctgtcctcacataagtctgagggaagaagtccgagggaagaggctagagagtggagcccttgccagggaccctgcctttatctacccagtacttccctcctcccctcctgtatcatttttatggttttgtcacatgaaaataatctcttttttcctgagttttcttggttctatcatggtcagtctttaacctttaagggtcattaagatcctaagcacttaggaatgataattcatttatcccacagtttccagtgtaatgcagtaaattgatttgatattaaataagcattcattgaatgaacaaaagaatgaattagctgtagtagtgattactgtcagacaagaaaagattattgacattagtcaatagtgtagtgtagtggatccctgtctttctgtcttttttttttttttttttttttttgagacagatcttactttcacccaggctggagtgcagtggtgtgatcatggctctctgctgccttgaccttcccaggctcaggtgatcctctcacctcaacctactgagtagctgggattacaggcatgtgctaccacatctggctaatttttatatttttttgtagagacggggtttcaccctgttgcccaggctggtctcaaactactgggctcaggcagtctacccgcctcgacctcccaaagcgttggagttacaggcatgagccctcatgcccatcccccgtctctctcttttttttttttttagaataatactgcctctaggacactacagccaatctcttgccttcaaatactgtatgtatgtagatgatctccatgtatctatatctagagttctgatgtttctctctaattccaaacctgtataattatctatctgcagagatctcataggcatcttaatttcaacatgaccaaaacaaactcttcattttctttcctcaaatgtgcttttcccctattcttctgccttcttaaaggtacccgccagtaccatgtgcagagttgctaatgaagaaagtctcagtggttctgtatctgccctgattgcatcccagttcatcaacaagccagtgaacttccttcatattgactaccaccaccactactacaccacagtagcatcttgagcatcctgaattgtttgcttccactcatgattgccattattcactttgaccagagagtctttaaaaaaatgcacataagagcctgtccagcctttcttaccctggtttctgaagcctttggtgatctggcctttacctgctttactgacaagattatatactagtttttgcctttgcccatacagttttggccaactgacatttccttcctgaaaacacatggagctccagcttgtctggcaagtttttcagtccatcctgttctcatgatttcctcagtctggaatcttttatctctgattattctttcaatttagattccagcataaagttctcctccttcctgaagcctcctgcaaggcccagccctatgtgctgccctgactctttcactgtgtgaggacagctgccagcacctgtatttctttgcctgcatcctgtctcttcctggcttgagcctcttttttgctgcccagcaaaaagagggcagcaaaaagattgcccagacttaactggggaatccttctccccttttagttctgaactagtgaccaatagtatttggtgtataactatcccaaagcttccccaccccttaggtgcatagctcagaaatgtgtcccagaatcttcccagtgggatttactgaagttgctcacaatggtggttgttcatgataagggacccttcactggttacttcatttcattgcccaatttttcctgaccgacatttcttccccctccctaataaactttttgcattttaatcttgttgcaagatctacttctgggggaataaaaattaagacaccttctgtgacccctaaaggagctaccttgtctttttcacatcacaccattttaattctctgcatggctcttaccaccaccattttccttgttactttaggtacaatttatttaaaaacatttttttccccactgaattttgagaactaggaaagcagggtatttttcttactttagtatgtccaataactaaaagagtgccttctatattacaggtgttcaagaaatgattgatgaataagtgggtaaatgattttacacagaataaaaggacctgatttcaagaatacaaattgtaggttgaaactattcggctgcccacgaataaacacttgactgtgtgctattgaaattttaacttttatatggagcgctttgcagagagcaaaaattgttagctattcgtttggccaacatattgagtggcttctctgtggattttaggctaggctgcttggctggtgtggcatattaagcagggctttaaatgaataaagaataatattttaactgatgtagcttgttagaagaggggccatttcttctcaggaatagacatcagcaattcccagtggcagtcttttttactatttccttccccaccacacacagctgtcttcccactggtggctctgttcccccaaaccccaatatccctgtttactgcttttctgtcttctttttcagcactatgagctgcataagtgcaagaatggattttttttttccatctctttgtccccagttcgttacatgtattagtaaatgatgaatagatattttctcactgatatgatcttttgtctcttggtgtgtgagtttacctgttgcatcatcatccagttttgggaattttataggttatttttatgagcaactagtagcaaatgttggtcactctaatgatactgaatagaatttagaaaaagaatatttgctttcatatttcattttaaaagatggcttgatgaaaatggcttagagttttctttgaaactgcttctttctttacaaattaatcgccttctacaacatttcctttagttttagtaattagaattgttttgaagtaattagtaaccacatccagtcctagttttctatatctattcattgaatacaattgaatagtggggctattttctctttattgtttttgagctagttctcttaagctatttctcttaaggctcaaaggctggagatgtgaacgatgagaaagaagcagccatgccaggaccggaggcaggtgcgtctaggcagaggggataggaagcggaaaggccctgagtgaggaccaggtcagcctggtgaaggagcagcaagaaggcctgggtggctgtaaggggatctagtggggcagagtggatcaactggagaggctagcaaggggactgattccgcagcacagctttgcagatcatgaaaagcagtttggagtatatgctgagaagactctggaagattttgcatggaaataaagcaatctgatttatttaaaaaatataatctggcttttgtgtagagactatataacgtgggcaagcataaaaatctggagtaaagggtcaatttggaagttattaagtaatttaggaagagaaggtgataacttgtatcagggcagtagtggtcagggtgaatggaattgcttggcacttttcttactgtcagagtaactacgatgtatcctttttcactgtctcatccattctttgtttttcttcttttttgacccaacttcccagcactcctctgcttcctcgatctcttcactggctcatgtggaacaccccccgacccccaacccaacagcatctcatgaagatttaagctgtgttcaccataatcttctgtaaatattgcctctaccttcttgtattaattggctcacttctattgcagttcattctctcacctctctgtaggtaaacttacagtcagagtcataaatgcccaaagatacttcctatcttcctgaaaaccatgagtcttttgaggtctgtgccattttgtcatactagagggcactctgcccttgctcttgatgtcattgtaacacttatcacaccatatgttaattgtatgctactttctaatatttatagtatattaaaacttgtaagctggagctgggtacattttgtccaggattatattctcaatgcctgctatagtacttagcatatgttagccattgaatgaatgaatgtttccatgtttgggtggaggaggttataaaacaaaagattctgtccttcccaattcagtacacatgaacaatgtttagctgaatgcatactttgtgcaggaactgaattaggaaccagatatacacacacacacagatgcacacacacacacacacacacacacacacacacacactatgaatccttgtgagataggcacaacactacaggtccctgtcttctttgctccttacaatatatttataaatatccctcattgtaatgattttcattttctgatttctcactaggctaaagatcccttagtggtgggattggaccatgttcatcacaattttctccttacctaatatttgcacaattaagcagtttattgcatcgatcactgcactgggactgtaaggaaatactagtgtgtgtttgtgtgtgtgtgtgttgtcagtgtgaatgagaagtgtgggaatagctgctgaggagggaagaatattgacaaggcagctaatatgtgggggaaatatcaaccaaggaaatgcacatcagtagaaacagttatctgtgtttgtttggacatcacttttcttcgtttatacaatggaggggatttacctagatgaactcaaaagactcttccagttctaatagaccatgatttttgctcagagtgataatattactcagctaaaagcttcgttgtaaaggtgtcatactgaaaacatatttctgtgtcttggcttgatcacccaggggaaaaaaacccacccagcatctgtctttcttatcaaccctctctcttctctttctaattttcttttttttcttttgtttcctttcctttctccttctcctcctccttttagtaaacttacagtcaccaagttctctggatgtctggaatcgcattctcttaataaccaaatacatcccatctcatttgttatgggaagttcagcaccattctcagtatttttgaggctggggtgtgggtagtttttctctgattatctgttgttctgaatacatgatgataccttgattagattctgatcaccaccccttatctccctgccacccttaattttgtagcgttatttcacgcatgcggcagttcctttcttttctactggcacaaagcatttatagattgtagaccttcattgtagtcttagggataaataaggagaaggcttagcacagcatgggaagaaaacaacttaaaattgcttaggaatcttaaaattttttgactgctcctttatagagactgtcttattggttgtcttattcttttggtccagcttctagtcacattcatagcattcaagaggttcattctcagttaacaatccatttttcatctccacttctacctgtctcctcagagttacaaatttttgttacttgattatgtagtgaaatttaactttcggtctgtaacaactacactccagcctaccttggcatattcaaaattgttgattatatttcccaaacaaaagaaccatctaccaaaccatgcacttttagaacaacagaaaagtagaaaaaggttggcaattatagtttttatttaggcttggccagagaaaattcttaggcataactattcccaacccacaggacaaactgcagtgtgtgtatatgtgtgtgtgtgtgtgtgtgtgtgtgtgtgtgtgtgtgtgtgtgtgttttcttttcctgttaagcttttctaaaccagaatttgtatattctcaaagtatactttcttagatcatttttttcttttaattagggacatctgctatttcagttatttaaaaaattatcttgaaactaaagacattttattgaggcattgcagaggttgggagagaggatcgactttggaggcagactcatctttgttcacatccccatttaccatttatagtatttggtctgtagtgtcaatggctttcatctgtagaaatggtgttattaacggctacctcacagagttgttaaatggagaaaataagacaatgtttaggcaggggccatttttctatgtaatgcatttcttagatgtaataacaattcaaaacaaccggttgatgttaggctttgtgttggtatgttttgtgttgctataaaggaatacttgagactgagtaattcagaaagcaaaggggtttatttggctcacagttgtacaagctgcacaagcatggtgctggtatctgctcagcttctggtgaggccttcaggaagcttaaaatcatgaattacagagaaaggagaagggggagcaggcatgtcacatggggagaggggagcaagatggaggggaggaggcgccaggctctttttgatctggcatgaactcatagagtgaggattcactcattactggagggaggacaccaatccattcatgagggactgacactcatgatccaaacccctcccactagaccacacttccaaaattagggatcacatttcaacatgagatttagaggggacaaatatacaaagtgtatcaggcttgtatgttaataaggacagctctgttcctagagagctaaaatattttgaaattccaattatgtttcatacaggtaactgtccaaattattactgtcttgtcactatccaaatgactacaggaagtcatagtggatgtgagttacttcaggggcaggcagcttcttggtgtccatatccccagagatgctaaggacatctaggtgagccatctctctggtcctcagcttcttgtatcctctgtgctggacaaaaaccagttaggcaattgcttgaagggtatagaaaatctgataagcaggtctgataaagaggatgatgaaataaataggaaaaaatgcgtgtgagaaaattgaaccagactgccacttgggctgtctgctttctttctctggagtaactctccctcttcagttgggagtatcagaagactttcagataagttatttgtactgccccatttctgtatcaccaaattctctactcagattaagattatgaatttgagggtcatttaggaaagttggggatcacctgtatgtaaagcgcatgcattttcctgtattccgttgtcagtttttctttttaaatttatagtaagattagtgagaaaacatgatttttaaggccagcctactttaaagataatgctttgcttcactttattcagatatccttctataaataactatcaagtgcaatacgttaccaacttgtattgcttatatcagatggaatatgtattcggaaagaagtaaacaaaacattgttaacatttttatcgatctgaaaagaggacatttaatattgttggaagcatgttcatgcttggtaagtcgtgttgtaaaatcactgactttttggcgttagctttattatagtacaatataattaaatataataccaaaaaccgtcatgaactgtacattcaaagcaagttctttttgggaaattgggtgataccatttttgagagcttattttacctttcaaggatgtacagtctaataaattagtgtaaaatattgataaacatttaaggaagccgtccctgacctttttggcaccagggatcagtttcacggaagagagttgtccttcagaccaggggtggggagaatggttttaggatgaaactgttccacctcagatcatcaggcattagagtctcataaggagcacacaacctatgtccctcgcatatgcagtttacaatagggtccgtgttcctgtgagaatctaatgctgccactgatctgacgggaggcggagctcaggcagtaatgctcactggcctgctgctcacctcctgctgtgtggcccagttcctaacaggccaaggactggtaccagtctgcagccagtggttggacccctgatttaagggacatcgtctatggctataacctttctaattccccgtttcacctttatttcttctaaagagattgtgtaagctttttcacatcctatttgttgcatatctttagtgctaaaataattgacttcttacagtaaatctccctagagtagttacttgtttgttatgggagtatgggggaaaatgatactgagtgagaatttaatttaaaacttttttgaaatttgtgagaaaaggaatagttatttttaaagagatatataagaacaaccaaatttaaagagtgttcctgagacaaaaatataatgacatgtatttaattatgatttgaaaattatgtggtagaagtatttgatttaagcaatgtaagctttgtaaagtattaggttagtgcaaaagtaattgcaccaagtaattacttcttgtactaacctaaagagatcaagatccaaaacaaaatgcactgaagtatgcatctaaaattcaaaaaagcatttttcctcattaattaatttgatctgaaaaaattaaaatgtctcctgaatgttgaaacagataagtggtttagagtatgaacctacttgaacatctaatgaaaataaaagattattatttatagtttatacgaagtggtcctttagcatcctggaagtttgaaagcttaaaaacttcgcatattagcgaattattcggttgagtgtaactcatgtacattaggtaggttaaaattggattaagttaatttgttaaagattttgcaaaataaatatttcaccaacccagaggacaatggatggtaggcacagtggaaatctataataggccaaatctaacatattgattctataatctgtccaataaaatgagtgcctcagtcactgttcagttccaaggataagttccacgtggggattatttttctttaacaagattttacttactggtaaggctgttgcttgtgacagggaaaggcttccacacagtgggaaatcatacaaatcataaccaagacaaatttgtttccttgagatggtggtagctggataaagcccatctgccttatctcagaagttcataaaggcaaaggataaatttcccatagaactatgaatagtttttctagggctgtgtttgggatagacttgccatgtgtgataaaatgtgaagtgtgacctttgggacggtttctagtaatatttttccccaaagaatcattcaatcagttccccaatgggttgagtgatgaatagtatttaaaaatcgatcttgaaggccatctgtcaagagtggtctcttattgggcccataccataggttggttttatggtcatgaaaacttcctggagttttcctttttttcttttaatttgggaggctatctgttgcacattgaggatgcaatttttcattttatcaaattgatcattagagggcttaaggggatattgagctaagggcagctggttcacagaacctgtggcttttgcagttacatcagccaagtaatttaccttctttagtatcagtttttgagtgtcctgggattttcattattgcaaaagacttaagagttttggatagtttttagtaatttaggacatagtagctgttttttatcttttggccagtagcagttagaaaaccactttgtttccagagtgaaccaaaataatgtgccaccccaaaggctcagcagctgtaagtgtagctaagtgcagtcctattaattgacagtataggtgttcagagagagtagcaagttctgcctgttgggcagaagtggccttgggtagggaaccactttcgttggtttcagacagcgagacaacagcatagagagcttgatatttccttgagttattttgaaggtaggatccatcagtgaaacagacaagctcagcatttggagtgggggttttctatagatcctatctagggcctagtaaggtatgtgacatcttgtcagaaggaagacataaggtctggatttatagagttgtggaaagcaatagtaccttagaaggtcttgttagaagtgagtctgctagcagagagatgctcagtatgaagagagtagagtaagaccttaataggatgagggacataaacaactaatggatagctcataattaactcttcagttgcctttaagaaatttgcagtggctgtgatggcttgcatacagggtgagaggcccttttgcaacagggtctaactgttagactgtaaatatcgtaaaggcctctgattgtctctgtgccttggggtaagaacccctaagatcttagaattttgttcatgaatgaaataggagaaaggaggtttataattaggatatcctaattatatgagcagtgggctcaagaaggttcttcttaatattcccaaaagaggagtaggcttcttttggccattgtagaagtttggggtgatcagttttttagaaaggaatatagagttagagctatcacagagaaacttggaattcattttctacatatcctgctaatcccaggaacccacagaattttcttttggtcatgggggcaggaaaagccgttgcttctattctttggggatcaagcaaaagactgtcttaaatacttgtgagagagttggtagcttttcttatgaaactttgtgattttcttttctttttttaattaaagcagagtctcactctgttgcccaggctggagtgcagtggcatgatctccactcactgcaacctctgccgggattcttctgcctcaacttcctgagtagctgagattacaaacacgcaccaccactcccagctaatttttgtatttttagtagaaatgagttttcacaatgttggccaggctggtctcaagctactgatctcaggtgatcagcctgttttggcctcccaaagtgctgggatcactgcaccctgcccccccgcaccttgttttcaagaactgaaaataaagggacagagttcagtgggttccttgaggattccctctttagtagttttttccaatgctagttgcatttcccccttttgagagaaagacacatgagctttgtgggcttccagaaaatttcagccaattaggtggatgggagcctaagaagctaatagaaactgatgaccaccttagagttccctgagttaaaaggctatgaggagagattgtaaactgtcattggctgatttgaaaccctaacgctttgtattttgttgttactctaaggaaaaggaatagaaagcatggttggaagaaggtttagatttataaagttttggggattcatttaatgctagttgctgcatttggtagttgataacttttgcagtttggatctgaaaatctaggactttagcagcatttttttggccatttttttgtgtgtgtgtggttttggagagttgtcccaccatattcagtaggttggaggtttccatagtcacccaatttaattgcttgttttttattaagatgctaatttactactctaaaccattaacaaagctagaaataaacagaagggaagtttgttagtcaattttatccaatcctgggtattgtaaagccagtctgtcatagtatttatagactggttcctaaatactatcaggttcttagtgctttgttgaatctctttccagtctgtagttttggaaatacttcagcaatctgagcatataattctctggctgattttgagacttttagaaatcaccaggttttgttttcatttcttcccctgggtcatgtaaaggatgatgccagcttgctttacttaaccacgtttgaacatggctttcggctaccaacacatggatcaactggtaaagattagagtaacctagtggataggctttagtaaggaggttgaattatttggtgaatctgacaggatcagttaagggatcagtgataactttggcaatagccgtgagttcttgttatagtccagggagtataagtaacagaatatccagaacctttttcagtttacatttaataagggttggatgactggaggagattcactaaggggttcatcaaacaatggaagttcagatccagaaggctatataggcagtaagcaagagggtgcccagtatggcagtgggatggaaggggtagggataggagaaggaggcaacacagaacaaggacaagcagatagaagcacacttggttctggttttgtttttagaagcttctgagatctccccgcccacaactgagagagtttttgagctaatttggcattgttatcccttagattcctggagtattcacttaggctatttaatctttctttttagtccttctgattgtgtgcagaggaaaacatgtttggaagatcaaaaatccccaattaattgatcattgtaattccagatcaattctagtgatgtttttccatcaagaaagaaatttacaggataacctaccataatttttgtgcataaaaccagcagggattctagaaggggatgactcagtacctaatacccttagaagtccccatgagttttcactgaaaagggaaaaatccctttgtcagcagacagcagcaaagggcacctgataaaagcctgaacctcaaccaaggtgagaggtttgggagagaggactcaccaacggggcctggggccattagagaggtggaacatgaggggtccttgcaggtaccattcctaaatctgctgtagctgtgtaatgcagaggagaggcacttcatatcccacttctgacaccacttaatgtcacctaagaagaagcaaaagaccagactgaaaagtagtaagataaggtgtttattggggtcttaggaattctaattcaggagacagatttggcgcgaagcctcaagagagggagggaaataggggcttttaaaaggaagctaaaggtgaatgcacaagttgttttgaaagacttatttctggtagaagcaactggcttagtacatgattccgtagttcattggttgtcactgttccagttgcatcacttgcaaaattcagctgtttttcaggatattgtagtcattgcagtttggcctggtacaaaggttcaggtcctattttttttttctttttaaaatatttcttgcaagcctgtaggtcatgtaggcagtccttgttagaagggcttcccaactccgttgtagggctctgtaccaccatgacaccattttatatatcacatttcacaagatatagaaaattttgttagaaatagcttgctatactgaaggatggaggtaaggactggtactggagagtttttttatgtattagtgatagttgatgcgaagggtatgtatatctttcaggatgtcattcactccttgaagaagaagggggtaacaagagaccaacttttaagagccaaacattttgaatctaaacattacatctgggttttcctgttagtggatcatgagagacagcctctcaactggaagcttatgtccaaaatataagaatgggtgtgggttatgtcttaaaagactataatcataaaaatgaagggaaagatacctcttaaaagatttttttaatccctccagctattttagcagcattccttttattttatagtctataattaaagatattctgggtagtctgtgttgcatcccaccgtgaaggacatccagaatctgactacttgccatgtagagaaaaatgtacatatttatataatatttaaagtatacttacatatttcttgtgttcccattttctcccttaagattatgatgattcattttatttaaattgtatttaaatctcaagtagacataggaaacccgcttaattcatagtggacttctagaatactgtcagtttcagaacttaggaatacttttgtggctttgccctccacatacatttctccatgttattttgttgtctactagaaagaaaggaaggaagataggaaaggaaggaaggaggaagtgggagacagggaagcaagcagtcagggaagttttctaaggacatgtgcctcgagaaccctgaccacttccacataatgaaaggttaagaattaataagcatttgtgcatttgagcatgtaatataccaggaactgagttcttagatatagtagatgcagtgtttgttgaaaaagacaagatttctgtccatgagtttaccagcttatttctagttggtcctctcagccaaatgaaatatatgaggtgtctagctgctctcaattttgaatatattttttaaggtttcccttgttcaatcttgatttcctatacagtgctctaagaagtgaataccctgtttttgtactagaatattttttcctgacctccagaaaaaaatcatcgtgtaagttctaaactaaatttgctctcggtttctgttattctttgtctaagtcctaagaaaactttccttagtctctcagattcatactctagtttctcttttttaaatattgaaaccttgaccaaagccacttaacttctgccaaaaaatttagacattcattgtttaacaataattggccagctctccagtcatcatactatcatatgtaaatcataaacatgtctccacataggacatataacttttgcttaccaacgcatgtgcattaattacgtagacttatttttaatatttcatctgccttatcactccactatttagatgtcttttcagattaattagctttgttgtgcttcaggaattaattctggaatcaaacaaatgggtttatgtcttatctctaccacttactagctctgtcagttgaccaagttatttaacttctctattcctcagaattttcatgtatgaaatgagaataataatataacacttagaggttttttctccacttaagatttaataaatgaaagcaaataatatatatagcataaagtctagtatatataataagccctgcacaacctttaactattattactgttaatactagtatcattatttacaacactcatcataatacctcaaaatacagtattaattttatgactctatttcttctcgaaagagaagggaaatagttcagtgtagtcaaggaatagggggaatttgtttccgtttcacaataaaagaaaaaaactaagcatatgatatcctctatatgagacttttatgtgtgtgatacatatgtatgtttaaatggatgtaagagattttcaaataaagcatagtatttaagtgagatgtaatacatttagggttctttaaaaatgcaattcttcattgaatgtcactcattaacatgcaagttcaattttcctcatgaaaccttctcataaaaatttagaaaatatctagggttaggcaaacagtacttagatatgatcccaaaagcacaccccacaaaaggaatgactggtaaatttggcttcatgaaaataaaacttttgctctgtaaaacaccgcgttaagaggatgaaaggacgagctatggatttagaaaaaaatatttacaaactacatatctgacaaaggatttgtgtatatgatatataaaggactctcaaaactcaactgtaaaaacatgaacatcctaattcgaaaatggataaaagacatgaacagacattacacagaaaagggatctacagatgtcgaatgagcctatgaaaatatggtgagcatctgccgttaggtaaatgcaaattaaaaaccacaatgagatagcaccacacacctattagaatggctagaacaaagaaaaatgctggtgatgccaaatactggtgaggatgtggagaaaatggatctcccatatgtcactggtggatgtaaatgctacagccgtctcaagaagtaagttggcaatttttttttaataaaagtcaatatgcatttatcatatgattcagaaattacactcttggacatttatttcagataagtgaaagctatgttctcacaaaatctacgtatgaattttcatagcagctttatttgtaaaagctacaagctagaaaacagcctaaatggctttcaagaagtggactgttaaataaactggtacctttgtgcagtggaatactgctcagcgattaaaaagagcagttattgataaatgcagcatggtatttactacagtaatgtaatgacattgtactacagtcatgaaacatgtcaacattagcagaagagagtgaagggtttaagggacattgtgcactatttttgcaactttgtgagtctacaatcattacagaattttaaaaagttaaaaaccacaaaatataattgttttctagggctgtggtaacaaactgccccaagcagggaggctaaaaccaacaaaaaacaattcacagttcagaatgccagaaatctgaaatccaggtgtctgcagggtgggttctgtctgcacagtttgaggaaaaatttgttcatgactgtctctaagcttttggaggttgtgatagtatttgacattgcttggcttgtagattgatcattctagtttttacctttattttctcatgattttccccctgtggctctgttgtcaaatttccctctcctttctcttacaagggcaccagatactggatttagggtacaatgtaaatccaagatgctcttatctcaagatttaacttaagaatctgaaaagacattatttccaaataagttcattttcacaggttcaaggggttaggacttggacgtatatctttgagggaatactgttcagcccactacagtagtcaaggacacagtaaaagaaaatcagtgataattctattgttcagagaaaacccactgttaacattggaatgtatttgtatgtggatatttgtggaaatacatgtgtgtatacatgagatcatattatatctaatgttttatatctttcctatttacctttgtttcataaacagttttccaggaaaatatagtagtagttcactgagtgacatgtacttataattatacagatgtaaattacactctcccaaatgtgtttgtatttctggctcacttgtttggttactttctcctctgaagtttattttctggccataatatttgcaatgctaagagagaattctgtttgtcccaactttagagaagtttaggtagatgaacttgtggaatggctttttataaaaagcaaatttcactttattttaggaatttcttgtctgaataatagctttattgagatataattcacataccataaaattacccatttaaagtatccaattacattgtttttagaatactcacagttgtgcaactttagaatatttttctcttctcaaactcagaatattttcattatctcaaaaagtaatactcgttagctgtcacctccttattctctcaaatgctggtatttattcccccatatgccttattctctaagcaaatactgatttactttgtagaaattacctattctgtacgttttacaaacatgaaattgtatatgtgtggtcttttgtgacttctcctttcccttaccataatgttttccaagttcatcatttgtggcatatgtctgtgttttcttcctttttatggctgaataatagtttcttgtatacatatgccacattgtgttcaaccattcattagttggacattggattatttccaactttttgggtattatgaataatactcttgcacttgtctgattgttacataagtctattgaactataatttcaagcacaagtcatattaagagataactggcttggatgggaataattaaatgtatggtaggtttaggtagccagaagtcaacacagaattactggatgggaaagaggtcattgaaaggattgggtgtttgcagaagcagaggtaagatatcatcacagttctactaacattttgccacataggttattttgtccaatgttgtgatgacaatttcctagtgccaagtttgttctttgtattacttagaataagaaaaaatgccatacttctgttttactaattggcagctattatcatttatataaatattctaattctaatttggcatttctagattgaaataaatatttatttatttatttacacaaatgagcataaataaaggaggtaaattatctagtaaattgcctttcacaaagtattatatattgacaccaactactctaggtaattagaataatgtgataatgcatcataaatctcttaatattttattattgatctattaatattttattattgccttaaagctaagctttgttttgttaaatgagatataaaggaaagctgctgcttttttcttttttggaatggagtctcactctgtcgcccaggctggagtgcagtggcacgatctcggctcactgcaacctccgcttcctgggttcaagtgattctcctacctcagcctcccaagtaactgtgactaaggtgcatgccgccatgcccagctaatttttgtatttttagtagagacggggtttcaccatattggccaggctggtctttaactcctgatcttgtgatcctcctgccttggcctcccaaagtgctgggattatagatgtgagccactgtacccagccaagctgctgcttttatataacactggaggagacagtaggaaggactggacatgtttggtgacctggagtgtgggggcatctgcttcaggacacaagccctagccagcatggaggctcaatccaagaggttagggccacttcatcccaggtgaaggacccccagtcacagccaggaatgcctagcacatgcctgcttataggtaaccaccacatccatcttgagatgcccacacccagaggcctggcaagagctccacccaccgactgagatttgacacacaagtctgaaggtcccaactccctcgaagattcttttcaaccatgaggactagtgagtggggggccctcaatgtctctagacattgaggtgaattgaaagatgcaaattcaggtgaaacaatctttatctcattcatcttaagagatgaaacccttaaacctttatgttccctttctccaggtgtagattgctaaagtaaactctttgtatccttggattttcttttgtttgcatttttggcatgcattttatattatgtaatctcactcatttgttagcaaatgtgtgttttatgattagaattaggtgctaatgtaagaaaatctggctaaaaatcaacatgtataaaaacagtggttttattttttacattacaaagatgtgaaagacaggtgtcacttaacaaggcatgcattttaaacatctctttaaaagtctatcagtaatctctttttggtccatttttatttttaagtcatggtggtggtatattctcctaatctaagatactgggctccaagtatttacatgttctgagtaaaataaacagatttcataaacagtagattgttatttgtttattagacaaaagtacattttcttcctgcaagacttaatttctgttataaaacatgttttggctgcatccatgttagttcatcagtgtatccatgcaaggtgaaatggaaggggcagagctgagatcccagcataagccagccttctattaccagtgaggctttctttggaagtgagtgtaaaattaaagaatatcagatattattctagaaattaagggaaacgtatgattaacttttattaatttttgttgtgactccctcagaacaatgactagagtagccagaaacctaagtctgcaaagaggaaatgctcttgtaagagcaatatgaaccagaagtctatttatgctgtaattatatcccaaaacttcaaagataaacctttgtccgtgctcaagatttttaaaagtacatcataaatcttttttaaaactgtccccctaagctaccttccaggaattcttaattacaatgtagtgaaaaaccaggaagtcaactcctattactcatctgtctactcttaaaattatagttttacatcccattgtatcacgttttacaagtgattataaaaatatagtaaatcaaagggtgaaagtgattattcctactttacactacataaaagaataagccaaaccactcctcaccatgagccataaacattcaagaattttaaacaatggaatagaaattgaatttactatatttaacaatggatataattgaaatggaaaaaagggcagagaaagcttaaatttgtcgtattcaaaatttatgacattaagaaacctgagcaagcagtatttttaagtgatttgtatttaattgtttgggtacaccgaacttctgaaatattcttgtttttaaaatattcttacttgttttgaaaatttctgataacttcagaagtgctagtatgtaaaatgtgtgttatatgtcatctataacatatatacataaacatgcatatgtatagattataaatgtatatctctgtgtatacttacacaagtatctgatgaagcatcttttaatactgggtttcatctgttgcttttggtcactgacactttacataacaggcttgtaagcagagctaggatgtatttttgaggtgatgtatctacagtatattaaatgtgatatagtacatggcaattatgttgctttattgtttcagatctagaatgtaggtcttgcgtgtagatgtaagcccttgggtaacacagcataatctttctaatgtaattaaaataaagctgagcccttcaaactctagatagacttactttggtatctgggcaaatagtgtttctttgagaatgaagcagtgattagatgcagatattctgaatggttgacaggagagagaactagagacatattttctactccaggttgaactgcttgatagtttggaaaatgttgatcagaaatgtattttagacagaatgtgaagctttgaaatcacaggcttgggtatgcatcctggctctaacacttcaaactctgtgttatttgggttaactttattaatctccttgagtcatgatttcagtttacgcattgcacattatgggcaactatctcatctttgagaaaaaaataaacataaatgattataaattggcacatataatacaaaagtgatattatggtcactatgaggctttttttgagaattgagtaaagtcatgaatataaaacatcaaaaacagtgtctgtcatataagggacattcaaaatatggtgtcattattcagtaggtgctctcagattgccaaacttttatttgctaaggaattatgattaattcattcaatagagcttgaaggttatatttgaaattagtatttatttctcaatctaagcctatctcaagatgatcccagctccagcttcttgatcatttttgtatttcccttatgtgcaagaggcacagaatctggttttaccaatcccatagtgtccagtgtaatgctaagatacaggaatttaagcaagtgttccatcagctcaaaagataattttctttttaagagatgatctccaggtaattttatttttaacatgtgcttgtattgagcaaatatttattgggcaaatattatatgccagcaattcagcagcaaacaacatatcaattctctgctgtcactgagccttactttgcagtggggataggcaatcagtaaacatttaagtgtagatatgtcagttggtaatgagtgccaaaaacaaaaataaagcaagaataaagggttagtgaacctaaatgcacctgttggcaggtactattttaccagcctgggaaggatttgctgaggaggtacatttgagcttcaggtgagagtagctagttggaacaactaatacacaagcacaaatatacacttgatggtgaaattctcttatatgtctttgtatctactaagatatgtcacataaaaatcttaagagattattcattcttatttggatcttgtaaatgagggaactagtgtttcgagcaatagagaaatgaaggctatttttattatgtgaaagataaatttctatggacaagagaaataagtgcaggacacttcccaggtgttattttatttaatgttcaagatggttttagagtgtatttaggtataattagccctgttttaacagtgttagaagcacagtaaaattaagtaatttgcctgaagtcagtattaatgactgaccataaaaggcttttaattatgatctctttcctttttccagcttttatccatgacttttcacgttaaattagggcaccaggggatgaaaatccaagtcagttgataaggaactccgttttctgtccaatgaaagattcactgatattgccttatttccctcatcccatttcaatcccaacttaatccaatttttctgtaaattgtatgctgtaatatcattgcaagaatatggcacttaggcccactttcatttacaaaatcaattattgtattttttgtggtggttttaaatttacagggaacctggttttggatactaacaagcattcaaaggcaggcatcactatgaacattaaatcacactagtgagattaaaattggcctaaaggccagtacagctctatcatgatctttgggtctagagtcttgcttcctttcctcttcctgccaaactataggtaatggtttgtcttcctacactttgctatattttaaaattaagcttgaaattaatcaagagattctacagaattactcgttttacagaaatggattgttggctggtatttgggaagacacactaattgcacacttggatttatttttgtttctgattatttcactggcaggtatgctgtcttgaattgctatgtttatcttattttagtttcattagtcagaattcattctttaattattggatctcttttattcttagtatctattctgagcttgctatgtgttattttgtagttttaaattttaaatcattctttctaattttcataggggaaaccatctgctgtgttatttgttactgtgtaatatttgtaatatgtctagatggggagaagcacttaattttacagtcttggaacattataaatccttgtggtcagctctttgtgccatcacctttgcttaatttggtcttctacttgttgttttcattaagtgcatgttttcccactaggacttaaatgtatacatgtatattttattaatttgttcattttattagaaaatgttattgtttaatttgttctataaattattttcataatcatattctctgtatttgtatgtaagtttaatatttcatgtcactacaaaattaaggtttctttgaaataactgcccttttcactgtaatacatatgtgatctagtttatacacacacacacacacacacacacacactctctctctctctctctctttgtccttattggttttgatgttctttttcttcattattagtgtcatgagggtggaatttatttgacatgacttttatgttactctaaaaactgaaacttagtagcggctctatcaatcgattttcagaagctagatattttatttatccaataaataattatcaagtgcctgtttttttgctccgcatagttgaagatcaagaattttacagggacgtaaaaaagaaagaaatattgagtgctaatgtgctaatgctaggaaaaatatttcaggcagagcaatcaaatgaaccaaagctaaacatctgtgccacatgaatatttaagttccacatgtggttggtttggctggggtatagaatgcaatgggttgttaaccaccggttcatcaataggaaattgtatgagtaaactgtggtaaatttgtacaaaatactattcagtaatgataaaaatattttaattactttttacacaaagtaaacataatattaaagttattaaaaagttaattgcatgtgattcttatagtttcatagaatttatgtaacatgtggaaacatggaaagcaataaggtatattgtttatgaatgtacacatgttagagttaacataaaaacatgcaatacatgattaaaacgagattcaagacaaaagttacctctgaggaggtaaggagggatacaggattgtgaaaggaaacagggtcttcaactgtgactttatgttagtttcattttaaaattctgaagcaaatttgacagaatattaagactcattaaatctgggtagtagataccagtgtttattagaatcttttctgaacttttctatttgtttgaaatatttgatgacaaaaatcacaaatatattttataacaagatatgtagaagacagcggttaaaaataagctcaataagtagtcaggagtcagattgcaaagtatcttctgtgtagcctgctaggtttttggatttcctgtataagcatatttactattttggtcttcattactcatctttatgtggaggactccaaaatcattcagctcaacccaacccatcctgctcctctgaatgtcagatttctctgtcctacttcccttatcctggcatcgctgtcaatgtagcatgctcaaagctagacatgttataccttaatctacatacctggccaggctccgtggctcatgcctataattccagaactttgggaggccgaggcgggcagatcacttgaggcaaggagtttgagaccagcctgccaacatgacaaaaccctgtctctactgaaaatgggataattagcccagggtggtggtacaccgagctcctcaggaggccgaggcacgagaatcacctgaccccaggaggcggaggttgcagtgagctgagatcgtgccactggcactccagcctggacaacagagcaggactctgtcttagaaaaataaaaagtaaaataataataataataataataataatgaaatagatacccggccattgccctgctctctctctctcgctaccaatatataagaaataggtaggcgttgttctccaacttcttatttcatttcccattgctgtatgtcatgtactctgtgaccatccttgcctgcattacttgagtcagtcattctttcctggtctccctctgtgtccctgatggtatccctgacttggacttaccctcttcatattaatccttcacatgctttctagggagcttcgttaaaagccaatctgacgtttacatgtgcttgctccttgctgagaaacttctcatgactcctcagtatctctaggagcatttgtagaattcgtgggtgtctcaatatcaaagccacccatggtcaatttaaaagatgtggattccctcatatggatactgatctgatgaaatggaatctctatgggtgggtctcagatcagtatttttaagaaacataccaaaggatttatgtgcatgatacaatttgagaaccatcaatctagcagagaaaatacaagctcttttgctgagtatggtaagcttactcttcacttttcagtttcatcttttgcattctctcttttgtacactcacttctctgccctcttctctttttttcttcctccctccctcacttcctccctccctccctccctcacttcctctctccctccctcccttcctccctccttccctcctttcctccctccttccttcatccttgcttcgttccttcctttcattcctttttgagacagggtctctctctgtcactcaggctggagtgcagtggcaggatctctgctcactgcaacctcaacctcccaggctgaagccatcctcccacctcagccttctgagtatctggcatgtgctaccatgcccagctaatttttaaaatattttttgtagagatgatgttttgccatgttgcccttgctggttttgaactcctgggctcaagcaatccacccatctcagcctcccgaagtgctgggattacaggtgtgagccaccccacccgcttcctatcctcttctttaactagttcgttcttgttcatcatttaagactgaatacagcagcatttaatctcacaggcttacctattacttctctgactccacccattatgtctgttactctacgtgtcctagttttgctgcccattccttcgtttaaatgatcatgattcccaggttaggagattcttgtttacacaacatgtatcaaggtaactggcatgtggtggaccttttaaaaagttcattaaatgcatggcattgctctttagaggacagggaaccaactaaggattttgagcctggattttaggtgtgacattcaggaatttcgggaaaaagagagaattaaaactggagatggtgaattctagtaagaattcataaaattagatatttagttgatcaagattggagattgggattagttgaaagtagagatgactgggtagatgaggaggatgagactttaagtttcacatatctttgattcaagttttctgtttattactttaatatagatgaataatatttatttagagatgcaggtcatgatcttagtttataaatgaattatgataagtcagattaccagaagagtagaaggtttcagagggagagagtgctcagctatgcctggttctgcagaaaggtctactaaaataaggactgaaaattatcttttggattttgcaattaggatgtcagtagatgccataagaaaaataattttaatgaattaattttttgagatggagtctcactctgtcacccaggctggagtgcaatggcacaatctcagctcactgtaacctccacctgctgggctcaagcaatcctcctgcctcagcctccctagtagctgggattacaggtgtgtgccaccaacctccgctaacttttgtgtttttagtagagacgaggtttcaccatgttggccaggctggtctcaaactcctgacctcaagtgacccatctgccttggccttccaaagtgctgggattacaggtgtgagccaccacacccaagctaattttaatttattaaataaaagttaagaatagaagtcatcggagttagtaagtgaatggtccatgaagacatattcacaatgagaagaaactctgtgtttaagaagcttgaaacaagaacagcaggacagtaaggcaatatcgtcatcccttaggatctgtgactcccatggataccaaaatccaaggttgctcaagtccctgctataaaatggtctaatattttaatataacctacacatattatcctgtacacttcacatgattacttgtaatacctgatacaatcctacacaccattttgtggattcagtatagtactgggtacgagacaatttcaagttttgcattttggaacttttaatttttctgaatattttcaatctgtggttggttgaatccacaaatgtggaacccatggatatggagggccaattatactatattttactggttttgttttgttttaattatatgtgtaacctgaacatgtgtaaatgccaaagagatggaaaacctggaaaaagaaaagttccttaagaaccttgctacatttttggtattaagaagaatggggctgggctcagtgactcatgcctgtaatcccagcacactgggagaccaaggcaggtggatcacttgagctcaggtgatcaagaccagcctagaaaacatgtgaaaccccatctctacaaaatatagaaaaattagccaggtgtagtagcgcacacctgtagtcctagctactctgggggaggcaggaggatttctttggcccaagagaagttgaggctgcagtggcctgtgtttgtgccagtgcacgccaggctgggtgacagagctagaccctgtctgaaaaaaagagcaaaagaaaagaaaaaagaaaaaaaaatggaagcttctattatcctgagcataagaagaggaaatttaagttgcgtaagaggacaaatgcctcttcctctggaacaaaaatgacagagcaaacacaagttgcagttgcagattgtacttgtgaagaagtgaaagtgagagggctgggaggatagatctggaaggcttgtccataccaaactcatttattttattctcacttataggcatttgtcaatacctatcacttcagtagttattagttatcacttccaatagtgtgtttaacttgtttttttccttagtctgttcgaggtgctataacaaactaccatagaaagggtggcttatacacaacagatttctatttctcatggttcttgaggctgggaagtccaagattgaggtgctggcagattcggtgtctggtgagggcccacttctcagttcattgatgaccatcttcttcctcacatagtggaagaggcaagtgagctctctgggtttcttttattcagacattaattgccttcatgaggcctccaccttcatgacctaattgttcccaaaggcctcacctccaaatgccatcacattggggattaggtctcaagatatacgtgttgggaggacacaacattcagtctatagaattctgcctctactactccagttcatcttcttacatgcaaaatacatggtttttgagattacacagagcttcatatcatccatctcatgcagacggacagctttatggtgtgaagctcatgattttgttttgttgtaaagctactaccatcattagttacttatgttcttagttataatgaagagttaaaggggctctcttcagagtgtaactttttatgtgttttattcattagcgagtatcttccgtttgtcgattgagttgctcataggaatctctaaaagttgaaataatttcagttatcagtaacatgtagacataaaaatgctaatgtctgttaatgtagatattgattacaaactttctcaaagtctatgtaggtttaacatttagttgactcattttctcctacttcaattcatttttaatgtagaaaaaaatatatataattttgcatcagcctctgtcctgataggaaaggtgggctcacccagtcagtttaatgtgagcaaagaatcacatgatttcagggccagaaagtgtatgtgtagagagagggagggcagaatgaaaatttaaaaatggttaacctaaagtgtgttgagttcgaaataatgcttttgacacacacacacacacacacacacacacacacatacactctcacacactctctcatattctctctctctgtctgcctgtgtgtgtgtgtgtgtatttatttatatagttaattcaagcaaattcttttgttgaattattaaagaaaacccaactttaaaattactaaaaaagtgagacttacttattttttagtcaaatgtctctctgtttaccttaataaaacctgaagaattaaccttactgcctcttcatccccaaataagttttctctcctacttcctattttacatagaagtatgtacattttaagatttctttattactgcaaagaggtatcgactgggctcctttaatgtgcgtattaaattattcttctcataaagtgagtgagatcatttctgccaaaagtgatgccatcattttaacagatggtcaatagacacattgttagtctctttttggatcaatttcaaatcttgagagaatacttgcttctaaaacaaaaagggtctatttccagatgtggtacttagtgatatttagcttccatggttttctcatgaagtgtcttttagtggccgcctatattttcatgggttcctgtgcctgaatggctgaataacttcctaccctctatcccctttagttgccatagtaacttgctgttcaaataacacagtggtatctgcacagtttcctctctattttcacctcttaatgcacttttaatgtgttatgtatgacttttctaaatatgtaactgaaattttgattgtccatcttaaatattgtgtcaactctttaagtaaaatttgcccagtttaaattgggattaaaggtgttctgggtatgttgaaagtcatagctatgatacagggctggaggaatccttgtcaggtggcatttctcttttcagtctaacctttaaagctgtgtcttgaccaggagcatgtaaaactcctatattcctaggtttttcagctgtaaagtcaagataccacacacctgtcagggttgttttgaagaataaatgggaatggacttatgaaagcatctagcactcttccagtcataggccagttactcataaacattggtggagagttgttaatcctcaaaaacttcctcaaaacaacagtgatttttatatctaaccttaggcattataattattaatttattttgaattaacctaataaggattaaattatactctatatgtttctgaattatgtatttggtaaagaggtacattatgtttgatgtgttgatcactttaattaatatttaattaaccagaattctttaatcctgatatcatttttattattcattttctttgtagtctgtaattaaaatgatataatcatttccagtcttacttaatttttttggagatttaactaaattaccttcttttgattcagtcaaatgaaagtggcttaagtattttttagcaccattaatgttaaatatgttaatcatgtttgcttttccagtaaatcaacactcagctactctcactgtaactttcctgttttggcatttcattcttaactgttcacttactctctctttttcctgtgtgacccgtgtctcatatttttgtttaaaaccacttatgtattttatatatatgttatatacaggtatactcacatatacatagattttttcatctctttgaggactaaaggtagaatttattactttcagaaactctgatggcacccacttttttttttttttctgagacagagtcttgctctgtcgcccaggctggagtgcagtggcacgatctcagcttactgcaacctctgcctcccgggttcaagcaattctcctgcctcagcctcctgagtagctgggattacaggcacccaccacaacacccggctaatttttgtattttcagtagagatggggtttaccatgttggccaggctgatcttgaactcctgacctagtgatttgcccacctcagcctcccaaagtgctgggattacaggtatgagccactgctcccagctgacacccactcattttctattgatttgctatcccaacttttatataaaagtatttaaatttttgtatatcatatagaatttgtgtgttaacattatgattttatttagaaatagaagaccttgagaactaagtgaacagtccatgctgatttggtctgtcattgccccttattaatagtatagctcccatttactgtcaaaaggatgtctgaacagtaacttacatagtcatcctgtgggccctcccctttaggatgcatatagtagtagcttctgtgagaggaacaggagaagtgtgatatgttatctgaactcaaataatttctactgtcttacaaacctgagagtaacaaatataaaatggacacttcatagttggatttaattatatactcatttgcatgcagaattagtaaaatacatttccaggggctgtgaaaatcctgagggtcataataactagagattcttcaaagaatgtgggaatggatccaaatctacaaaaaattgatggaacctaaatctgaatcaaatggactaaaatgagtgctgagccttttttttggtttttgttcattttgttgttacctttttagagaaattctgtcttctgactttttaactatagagttctttcaatttcctatgcagtggaatcccaattattctgcagcctcatgctgtcaattttatcttctatttaacatatttcctgttgtgctgtctgcctctgaactagaggattaatcagtattgaatacataatttttgagtttgaaatattgctatatattttgctcggattaattgcattattgctgaatttttaaaattgtattataaactcctattgtatgcattatagtagtgatggtattaaccttgctgtaatggattattcataatgaacaatactatgatgcaatgctgaaatggtatatgacatatttatggagagagacttaaatgctagtctatagcatgaatctgggggagaactggataataaaattgcccagttaggaagttagaatgataatctagatgataaaatcctacattatgtatttagactataattaggctatttgtttctgaaaaggttttgaactgtccagtaaaaagtcaagattactaagataaaatatagttaatcaaaactctaaagggggatggttaatacacttaaattgttgctaatatacttacagtgatgaagtaataaatttaggcatggatatatttttagccatggaataatgaatgtgaatagctgatcaattagtataaccattattttgaggcacctgatacttatcagtcaccttggaagatgtcagggatgaaaggtgaatgatacatggttgtgaactacaggaaacacacagtctaaggagaggcttcaaattctagttgtgtgagagaagaaaactaataaagagaaaaaaattatgtaacctttggcatgctttttgtggatgactttaacatataatgtgtgtttatgtataatatgtctataaaattcgtattttctaagataaagttttgaatttctaaattataattattttgattgccccttcagtttcttagtgtgtgtcattgctggtcaatgaagcatactaacagaccaatctgagcagtaattgtccttgcataagcaagattttttttttttttgatggtaatgagtgatttcaaaaatacgtttaggctgggtatggtggttcttgcctgtaatcccagcaactttgggaggccaaggtaggaggatcactcgaggccaggagttcatgaccgtcctggtcaacagagtaagacctcgtctctgcaaaacaaaataaaataaaataaaataaaaaacttaaaaaatcatgcacctatagtcccaactgctcaagaagctgaggtgagattgcttgaggccaggagttagaggctgcagtgtgtgattgcccactgcattccagcctaggtgacagaccaagaccctgtcttaaaaaaaaaaaaaatctagttagagcattttttacttgttgcgtctatatggtctgtcttaccatagatcacctgaacgaagttaaaatatgtattgctactacttaatgtaataaagagaatagctcttcttacattaatgaaactaggctttcttcataccttaaccttcctttttttcattaaaattctcttggtgactcacagaaaatttaaaaagaattatgacaaatactgttagtctgtttccaaatagaggatattgcaatgtcaaatataaggggtagatcattgagaagggattttataaggtcctggttaagacttgtctggtggtatgtaataaatctgtgtggtaggggtggatagtgaggaccttgtcagacatctgccagctatctacatagtttcactccagtgcacttaataggaaggtcaagtcctctaaaataccagcaagtacccagatgttaaagcctagaatcttgccttggacgtttgacgtaagaagtataacagctttagtgataactattgagtgcttcaactgcagcaaatgatactgtggttcaacatgcttatgcagttcaatttatgtcatcagctgtagagaaattataaatccaaccaaaatcctttgcctgaatggttcttttatggaattcctctagtaaggcatgtttaagtttctatttattttaaatttattatatgtttatagttttgttttctctaacttttcccaccataataatcctttgggatttttatatcctttttttggatttccatttcaccattcatcaaagattaggacagcattctgttatgatttatgtttcatttctatttgagagttgtggtaaaagaaatggtggtaccatcaggaaatgaaaaaaataataattaaaagtggcaacaacaaaaataaataataaatcttaactaagaatgtttctggggaagaaaccattaattttgcttttgatgtattgagttttagttgctatcaggatttccaagctgagtagagaagcatgtatcagttttgttaattatgctttaattaatgtataacctactgaagaaaactcactgtgattattgcaacaatatctgccactattggttcccagcatttactggtgctttatttatactttttatttgttttatgaggtaggtgttattttccctcattttataaaaattaggtattttaattgattcggattatatagctggtagagctagcatttgaacccagtcaggactatgtttagagcttacacaaggcttctccttgacctgaagcctgtggctcagtaaatgctggtttgatacacaaccagcacgtacttcatgtctagaatactgtattcattgttatcatggcattttgaataagagtactagtttgggtttatgttccagttattcagttataaaactctttaatgtacattgacacccatggcaagtttctttttagggggaatgatcacttgtaatcaaagctttacctttggcattatgaatggtgaattattctactataaagccagctacctgtagtcaccactatgtcttaggacacatattaaagcgaggagaaaggtttatattgttcagctgaatctgtacttaatgttatttatctgaacactgtaaaagtttgctgaaaggttaatctgaggttatttcaatttgtcttttcttactggcaaggtggaaaacactgtttctcaaagcacttcctaagactttcaggataatgtcctcagcgatgccaaacctcactgaaaaggatttgaatgtaaactccaatagagaatcatgctagtcttaaaaattttaccctgttcttataatctcctgaaacactttgtaaattaaatttagttcacatttttaccaaaaatcttgtgcgtgtagaggcacatgctgcaaaacaacattttggtcaacaacaaactgcatatacatatgaagatggtcccataggataataacactgtatttttccttttttttttttttttttttttttttttttttttttttttttttttgagacggagtctcgctctgtcgcccaggctggagtgcagtggcgggatctcggctcactgcaagctccgcctcccgggttcacgcatttttccttttttttatgtttagatgtgtttaattacataaatacttacctttgtattacagttgcctacagtatttagtttagtaacatgctgtacaggtttgtagccaaaaagcaataggctataccataatagtgcaggtgtgtagaaggcttttacataaaggttttatgacctgtatgatgttcacacaacaacaaaattgcctagtggtgcatttactataacatatcccatccttaagggacacgtgaatgtatatacacacacacacatatacacatattaccaaatggatacatacatggttacctacagaaaaatttaaactttgaaataatactcttagggaatgttacctttttaaaagatattctttaaatttatatttgctattatgttgccttaccaatattcacatgtaacattgcacatttcactaagggattttttatattagcattttagtcagcacatttgttgtctgtttaccctgtgttatgagttaggtaaaaagagatcttgttcctgctttaaagagatctcagtttagtgacagataagtaaaccaaccaaagagggtgcatgaaccccggtagcctgggtaggaagaagctttcactctcagtagttaaggtgatgatgggatggaggactgttcaggaaagactggtcagaaaagctcagacttgtctaagtatggaagggtgggaggaatgagttaggtgggaaagggcattcgaaacagagacggcagcgcgtgccaagtgctgaagcagcatagcctggcatgaggaggtacacagtaatttgactcagctggaatgatgggtgcagggggcggatcctcattttcagactcacaagacctcaaagctaaagaaggaacatgctgtttttttgcagtggacaaatccctgccattctgcttgccactttctggatgaatgctcaggcatctcttcctttctgattacatccctggctgcttttctatgccactccatggattactgcttcaagtttatacccccttcccatatgatacagtcacctcacttgacacatgtaggttccagaccagtgccctccctttctgtaacctcatgaactaacaaggtgtagatatttaatacatattaacctggatgatagcatgtattaactcagaggagctgcttacttataaataagtaaaagagttaaaaaataatcgtcaatgagtcaatcaaataagttaccacatagctttccccccaataaaccaacacttggaccattcaacatttttttattcactatgcatgcagctttagctatgactaaacttttacaaataagacttgcagggttaccatttagacgtaacatgcactagattccattcatggaggaaaccagttggctgctgttggagattgggcaaccgacaagattagaaaaaaaaccaaaaccaaaacaatgcctgttagcttcagatctccttttagttttggagtttgctgtattaaactgttccattacactttgtagaattgtgtggagtggagttctgttgatctaagagcttaatacccatgacaaaaaggttcaagttttgtatgtgaactcctacttacagtattgtcatcatagacatgaagaatgttaagaaacgcagtatggcaattaagagcactaaccttgaaggtgacccaaattggaatcccagttttaattcttggccaaatattttaactgtactaattcaaagttttcctgcatgtgtcatggcaataatttctgttctttttcattaaccttgggaaattattaatatgaagattacgtgacatcttatttttgtatgtatcctagaaagtataaaatgtgatatgaattaagttggtattaatagaaaggtataatgttcagggaaaatatcagacctgtatgtgagattttgtaatcaccactgggtatttgagtagaagaaaacatgagaaaaaaataataatgtgcatagtgttaagaaatcatggctgagaagaaggtaggcctctgtctgggcaagaaaactaggtttttgaagataatagctttgagtgaaaaatgagagatttgtaatcatccagaataatggtgtctgaattcttcagcacgtggtagtagacacacgacgtgtttgttgtctcagaattctgagggcaattcacaaagaaattgttacaaaccatgaatcattacacaacattagaatacctcaaaagagtgagtaactcaaagctcttaacagatcttgagaaacttgaaataataggcatgtttttcttgggtgagcaatctctctaattatgtgagagttgtgtgtgccctttcctgctccaccatattatgaatgtttagtgtagagaattactgaaggtttgcacaccaattggtaaaaaatgcaaaaattaccagtagtaaatatacaagattgtttgggtaggggcagggacattggagaaaaaatgaaagactaagaaaaaagtgatgtgaattttagaaaaacacaaagattaagcaaggttgagtgttttgagaggaaatcaaagcaacaggtaaaagaaaccagtaacacagttagttgacttttttaaactgagagatttctcaagaaagatttcttgataatagagtaagaaagaaacatcctgtgatggggatgttctttacagaatattttgatctccaatttaattttatgtctgaatttataatcagaaaaggtcttgtttccttatggtttcatcaaactaaattaaattgtaattgctcagatggtataaatatgtgcacaaagttgattattgaacattgtatagtggccagttggctaattgtaactctaaatgacaccataatatgaagttttgtttttatttatattgttctctaaataccagggtgagtatgatgtttctgataagtgcataaagaaaacatgaacttataactggagcaatagggcaaggctgcatctttattacttaactctccagttgtaaaaacaagtactacggttgacaagacacctctccatgggtacctccgtaattgtcataaatttaaatttattgtaatgttttagacctgtttgaactgtagtacacagcccattataaccatgtttgaattatatttatcaatcttttttttttttttttttaagacggggtttcactctgttgcccaggctggagtgcagtggcaggatctcagctcactgcagcctcaacctcctgggctcaagcgattctcccacctcagcctcccaagtacctgggactgcaggcacatgccaccactcctggctagtattttttgcagattttcacagagacagattttcgccatgttgcactcttgagctcaagtgttcggcccacctcagcctcccaaagtgaggggttataggcctgtggcactacacccagaagacaataaaatattttttaaaagtggattatttgtaagggagatatctattagaaagctttttgaactattcacggaataagtttcaattttctattttttcctactagtttaatattgaataaaaatgtatacattattcttctcctggtatcaatcaacctggactcctacattttctttgctaatgattgatttcttttttggaatgatacgattacttttgtgacattgtcacttaaacaattactaagaaaaagttaaaatatatgacctcaggtagactcttaattttcatatttaatgaaaacatgcataaccagttcttactccccaaaaatatgtaaaattacaaatgaaaatggcatgatgacattaaaatgagcagctttgtatattttctgccttgttactaaacagcagagataaaggaagtctccttatcaagttaacagaatttaaataatctatgtagataattattataaattatttgttaatgtaaatcaggtttttagacctatagtaagctgtgatgctatgatataacatcctgaatgatgttgattcatttttacatcttaatgaagtatcatcttcattagaatatttgaatatagaaatgtttctttttcatttttagaaataactttgttaatagtggctcatatggctttgttttaggatgtgtattatgtgtgaatacatacaaaaattctaataaaatatcctaacatcagttaagatacttctagccacaggtaagaaaagacacaaatcatagcttaaatattgtttattgtctcatataataagatgtctatagttagcacagtttcagggttaattcaagggctcagtggcatcatcaccaggttagttaaatcttttattttttcctgtcatcctcagcctgtgaacttcagacagtaggcctgttccagcatcacctcctcacatagttgtgtccagatatagaaatgggaagcttctccacaaccatttctttgcaagtgcaagttctccattattggtcacagtcagatcttatgattctgtttagaacagtcactagcctaggggaaatgaggcaaccattaattatattcaactgtgattcagagctgggggcatgttcgaccttcatgaaggtcatggtcagtttgaggtgagagaataaaatcaagattctgcttaaagagtatgctgagtgtaggacgatagtttggttggtgataaaagtatgtctgccaaatagcaattcagaatattttctagaatctactaaacaaaactttattttgttttaagcacacagttaaaaaatattaatctaaactagaagtacaagtctcatgggtaaaatcttttgggatgaagtagcagttaaccttttggtcttttaggaatactgcacttattgcaagagagttatagcacattggcattttactaacagaaaactgaagtctctaaaaaattgcccttcccacaatgttattacaccaataatttagatattatgtataagaatttgccacaactttcacattttatcttctaatacctccttttcttattattccccactgtgttccatttctgccctctctcaagtgttatttcctgctaagccttttatattttgactttttaaatgcaagattttaataatttaacaagcattttagctgataattttcactgcaggagctgtgaactgtaatgcaagactaaatatcagtctaagagctaggatacctaagaagtgccaaaattattttgttatattggaagttgtaaatagggaggatagaggcctgaattttatttatttatttatttatttatttggacaagatcttgcccagtctgcagactagagtgcagtggcatttatatctccctgccacctccaaatcctgggcatagacagttctcccacctcagcctcctaagtaatacaggcacataacaccatgcctggctaattttttgtgatttttgtagaggtggagtctcgctgtgttgcccaggctggccttgagctcctggcccaagcagtactctcacctcagcctcccaaaggtgtggggttacaggtgtgaaccacttagcttggccatgacctaaatcttattacacaaaatgaaatgtcagcaatttgacaaaaaaaaagcatactctaaattattgctgaagtttatattgttatagacattgatatttaaattgttagaaattaaaggcataaagccatatatgctgcttttaaagggtgcacaaatattctaagcctccttttaaagaattattatagtctacaaaattttaaaattttcattttcattgatcagtgtattaaatgtaatgccaattatttattttaggccattgatgtaatgcaatgcagttacattgatggaattcactgtatcttagtaaaatggaagagacaagatgaaataagcacacatatatcttctgttatggagtagaactgaggctaaactgtgtagtgtttggatattactaaatgcttaggtaaagtgtgtgtgtgtgtgtgtgtgtgtgtgtatgtatgcacatacatgcacaagtatatttttctccccatattctatttctgcctaggttacgacattcattctgaaatgtctaacaccagaaacattattgttatgatctctccaaatatgaaaaacaagtaaaagaagctaaagggcaaaagtagggaatttacctatgtaataattgagtttatattaagagtttattttatggaattagaaatgagtttgtgatagactggatgccatgttgtatatgtatcttgttaaaacttgtttgtaaacaggtttgaaaacttgatccatcgtgcagtagagtcacatattcattaatctttttgcatgttcaatgaaatgctttctattgaactagtttcctattatgtatatgtggtatcagtgtatttggatatagacaaattgaatttcacaatgtgttttaaatatttaaattcttctttttacttttgaaaacaattagcaaatcagtatacaaataccagtaaaatgtgttcaaagataatgtggacaaatacaaatattgaaatttttcattacttttacttctgcatcttttgcataggaagtatgaaaaggcagtatctagtggttgtttcacttctttggatctagatactcgactgtctaagatattaaactgttagatatatggctggaaactcctatctgtgagtcagagttttcttcaggctggtaaaatgtagctgtcttccatgctaggttcggtgtgatctgcaaaaaggcactttctttattgccagcccactgaatttctgaatgatgaccttgcaacccataacaaagtctttcatgcaagcctcgactggctggatatggggtctgtttcttgtctcttttaccttggaatcagccctgagggttgaccttacacatttttatcattctagctgagaaagaaggaagtcaggtaagaagataggaaatgcccttcccaaataggaaaagaaggcaccaactctctttgctgtgtctgcatttccctagctttaggaaatgcatcttgtttagctttccttcttggaggcatcctttaagtaggacatgcgttccttgaggatccagagaagaatagttgcttttagttcttgtactaaaaatcaagagtggattaattctaagtggcccattttgatagagatccctaatttccttctgaagatttgtgtgagcattgtttgtgaccagagacctttatcttgaggatatacatggattcaggagagatagtcttaacataagtcaatgccaattgagaagtagcacagaatccctaagtgacccccctcaggtataataatattgttaattacattttcaatcaattgaaataacaatttagaaaataatggtttagataaactcctatccaggttttctttaaggtacactgagagaaagagaaagagaaagaaatctcagatcatcaaagatatccttaataaagttaagaaaacacactaagactgctgtagttcaatgatgtatagtagtaaatggtcactggcggtattctagttaatttgttttcttctgcatattgttaagtgggcagtgtaattaatcaaagcaatcaatcaatactaacttaatttgtattttttaggtatttccaaaataatctaacataaaccttgcctcaaatgtattattcttggggtaaagtaagtatgaaagagaatgcaatgtagcaggctgtgatgagttgtacactaagagtctaaaaatcacctgggttcatttttagtttcagtacccaaaacccaatgactttaatccaatgactttaatacaatctttccattgagtataatcaaatatgtttcatatgtaaacagagttggacctagtgatttctaaaaaattcttaactgtgcaatattatgaaataatagaaaaatataacactatagaaaagcactcagtttagactaatataaagacagaatcagaaaagtgcttagaaatggtactacagctagggcagggttgacttcaagtgagagttactcagtggcattttcttttttttttttttttggagacagaatcttgctctgtcgctcaggctggattgcagtggcgtgattttggctcactgcaagctccgcctcccaggttcacaccattctcctgcctcagcctcccaagtagctgggactacaggtgtctgccaccatgtccggctaattttttgtatttttagtagagacggggtttcaccttgttagccaggatggtctcgatctcctgaccttatgatctgcctgccttggcctcccaaagtgctgggattacaggcgtgagccaccatgcccagcctgagtgacattttctaagttaaatttttgaatctgaaagatgcaggtgtcaaataatacagtcacaactcaaacttgtgcttaaaattgttttagagaaatatatttcagaatttactgtcacttttagtcaaaagattgacatagaatacaatgtaagcatttttaagaaaggccaacaatccctatcaacatgcagttgtctataattactttacaagtgttatgggtgatacatgttaaccttctataccctggatatttatatattaaggacagtaatcttaactatttcaaaatatgtttttgaaatctttcttaggttgtcttatacttagaacattaaatgtaagtttaagaataattacctaaatattgtactttttcttcacataaggtagattctgtgatgagctatatttttgttatttttactttttggcactagggagagaattgtcttaagatttttaagtcttggagaaatttgtttatcttaaaatacttcggtcagagcattctttgattagaattatgaataactacacaaaattcaaagttaggtaatgaatgccaagcttagtggactcaattttcaacttaaagaattgattttcttaacaatgtattgttttagttgcggaataatgaaatagcaggatacttaggacttgggagacttactactatagatacagtcatacttcaaatttattgcgtgtttgcatgcagacagtaataaaacaggtggtcaataaagggagtgtattagtccattttcatgctgctgataaagacatacctgaaactaggaagtaaaaagaggtttaatggacttacagtttcacatgtctggggaggcctcactatcatggcagaaggcaagcaggagtaagtcatgtcttacatggatggcagcaagcaaagagacagagagcttatgtaaggaaactcttgcttttttttttttttttttgagactgaggctcgctgtgtccctggctggagtgcagtggtgcgatcttggctcactgtaacctctgcctcctgggttcaagcgattctccttcctcagcctcccaggtagctgagattacaggcacatgccagcatgccccactaattttgtatttttagtagagacagggtttcaccatgttggccaggctggtctcggactcctgactccaggcgatccactgcctcagcctcccaaagtaactcccattttttaagccatcagatcttgtgagagttattgcttatcatgagaacaccacaggaaagacctgcctccatgattcagttatctcccgctgggtccctcccacaacacgtgggaattatgggagccacaagatgagatttgggtgggaacacagagccaaaccatatcagggagtcacacagatattttgattttccagtgcagataaaaattacatttgtaccaccctataggctattcagtatacagtagcattatatctaaacaacaatgtacataccttaagtaaaaaaaaacactttattgcaaaaagtcttaacaatcatctaagcctttagcaagtagtaacctttttgctgttagagggttttgcctcaatgttaatggctgctgactgttcaaagtggtggttgcagaaatttggggcggctgtggcagtttcctaaacgaagacaacaatgaagtttgctgcatcaattgactcttcttttcacaaaacatttctctgtagcatgtcatgccattttacaacatttcacctatagtaaaacttttttcaaaattggaatcaacactctcaatacctgttgttgctttatcaactaactttatgtaatactcaaatcctgtgttgtcattttaacagtataacagaacacctccatcaggagcagattccatctccagaaatcactttctttgctcatccataaaaacaactcctcacaactcctcatccattcaggttttattataattttgcagcaattcacttacgtcttcaggctccacttctaaatttctttctcttgctattttcacatctctttttatttccaccacatcttccactgcactgttgaacccctcagtgtcatccatgagagtggaaacaacttttgagatccatctgaggaatcactatctctggacagctataccctaaataaatggattccttaaataataagacttgaaacttcaaattacttcttgattcatgggcttcagaatggttgttgtgttagcaggcatgaaaacagcattaatatccttgtacatctgcatcagaacttttgggtgaccaggtgcgttatcaatgagcagtaatattttgaaaggaatctttttttctttctgagtagtgggtttaaaatcttcagtaaaccatgctgtaaaaatagatatactgtcacccaggctttgttgttctatttctagaacacaagcagagatttaacataattcttaaaggatctagtattttcagaaaggtaaatgagcattgattttaacttcaattcaccaatggtgttagtccctaacaagagagtctacttgtccaatggttctttgaagctagcctttgacttttcctcactagctatgaaagttctagatgacaccttcttccaactgaagactgtttcacctacatcgacgatccgttgtttagtgtagccaccttcatctgtcagcttagcttatcttctggatagcttgccacagcttcactttgtccttttttgttatggagacagcttcttttcttgaacctcatgaaccaacgtctgctggcttccagcttttctgcagcttactcacctctctcacccttcatagaattgaaaaaagggctttctgtggattagattttggcttaagagaatgttgtggttggtctgattttctgttcagagaacaaaaactttatttagctcagcaacagaaagttgtatccttgaaagtcaccctggtaattaatatatgatcagaaaagtaattgacaattttactttgtaggttcctgggggctttgaaagaactatgtttatttcaggaaaggaacaatagtatgttatcatttgaaatgaaaacagtaaaaatctgcactttctatttagtagccagaaaatgtccataaatcctgttttagggcactggaatttggagtaaatgacccattgtttgtataaagatttaaacaaagactgatcatcagctttattctttattattaatgtcctgtgcttgttagtaaaacccagttgcttgggtttttgtatccctggagagtttatttttgttatctttttcactgttaggcttcttactaaagagggattcaagtaagtaaataacttaagagaagcaacaggaattgaaatctataaagctttgttttctcaacttggcacaactgcatctgcctttgcagtctgggattggatgattgattttatatcttggaagctcatttttatatgagtgtgaaacgagtctttcaaaatacactttgtgaagataacattaattagttactgtcatcaaccaacagggacaaacctctcctttttgtgatttctacaggaggattgatttaactgttaaattttgtcatgtttttcaaagagcaataaagaatcccccaggaggaagaatgagaaaagaagcagctcatttttgaggatatgctatgtacaaaacacctcataagacaactgacagtacctacctttcagacaaattatctgagtcacagagaagttacataaattagtcgtgatcccatagcaaatggttgagaagatttaaagtcaaacatgtttccattatttaggacctataaagtgtcaagcatcatggtagtctttggacacataaagtcaacacagggctacttggtaggagttacttctaggtaaaagtcattgttctctaaaactctagccctgttagtgtattacagaatgctattggaaatggagcttatagactatatgaagaatctgtaacagaggacatggaagcagagaagtttttttaatgttagaccaatgatttgtattacatctgaaatgctccaaaatctgaaactttttgagtgtcaacatgaagctcaaaggaaattctcattggagtatattgcattttgcattttctgattaggaatgctcaaccggtaagtatatataatgcaaatattacaaaatcttaaaaaattcaaaatctaaaatacttctggtcacaaccattttggataagggccactcagcctgtatcactgtcagttctgtactgggaagccatatgtgtttttgaacaaaggaattatgttatttagattgactttgttaattgtaatttttaataaaaatttacaattttctggtgaattttatctctagtaaaatttagtctgtgatattttgcttacattctactttgctaaaccatttccttattcctaagcacggaatgattggatctggtgactggacttcactgctccttgctctcaccctcctcagcaaatttcagttttacctcctctcctctcacagttttaattcctaggtctaaattacagatagccatctgcctacccccaactcatgcacctatttactaatttcccaaatatttttaagcgctttctatgtgccaggccttgagtgcacaaatattcgttaagtgctttccatgtgccatgccttggggcatggtggtaagtaaggcaaacctagtcctatacctcgggaacttaccttctaattgaggaggcaaacaagaaacagcaattagtctaattgctttattatatgtgctatgagagacaaggataacatgttaggagagcatattagaaaaggggtgagaatagggaattatcctagcagggtagatcagggagatgacatttgtgctgagacctaaagagtgaatagagttaaccaagcaaaaaaatgtgggatgcaggttgccggggagaggttgggtgtcagctggggtcaccaaagggatgaactcagaagaggaagtatattttattttatttcccatctgaattttctagcaccatagtgtctgcacatttagattttattaaataaaaatgtaaagtagtatattttgcttcacttcctgattgcacattcctagaatattggaatttatattttaactaccacagtgcctcgaataatcctttgcatataatattttctctactggtacttgatttaatatactaacattttttgcttgatttggaatggagtcggtaaagaagaaagaatttttttataaaaataacttacatagtcattacttaccctattataatttcacgattgacttacaattatttagttatggtcatttgaatgtgctacttaaaatttgtcatgagtaatttttagattaaagaagagcaatgttgaaaatgaaactacttgtgtatttagaaaggtgattacaattgacagtattttattgtacattttaaaataactaagagtaaaattggattatttccgtaacactgagaaaggataaatgcttcaggtcatggaaaccccattttctctattatatataataatgtgattattaagcattgtatgcctgtatcaacatatctcatgtacctcataaatatatacacttattatgtacccacaaaattaaaaattaaaaaaagaaaaaggaaaacagaaaggtgtgtagaagctatatcatttagtggtgttgaaagttttaatttgagatgtttagataaatggaccactctttttcaggttgtattgtttttgactgttgaaaagcagaatgcagatacattcattttattaattgtagagctcttatacttttgaaagagagcaagttattgtgctttagaattgtactgacttttttttgttttgatggtgtcttaacgaataaaaataatcttattaacaacaataaaaattcctagatttcgtagctttaataaagataacacttatctcaccaggtaatatgaaaaataacatacagttttaagattccaaggttctcaccagaagctctatattatgaagaagagactgctgttataattttgtgtataaagaagaatcaagcagggaaattaaggagaaatccaagtaaccaagacctttaacagtgtacacaatgactgaactttttataggctttctcaaactttttcattttcatgcgatatataaaccctgcccctgcagtcatgtgtatttccctatgacttaattttctcatctgtcaaatggggtactaaatagtacctgtttcagagtgtattggaagattaagtaatttgaagtttagaagatgtctaatactcagtgagtacacaattaatattagctgttgtttgctcaatagtccaaatgatcaagtaacttttttcaataaggaaacacatctttttgaacctttcgtaaacaagttctttagttgtttttacataactaaacaaatacttatttgggttaatttggtttctttaaggagaaccttgaagaacttttccccaacattttataatttaaaatattgtgagaaagtgactagaaacagatacttttccattaagtttataaaggacatagggaaactttatatgcacactcaggtcattgttttgttttgtttgtggtttttcaatacaagaaagtatttgcttttgattctttttctgttccaactcatgttttcttcctcgggagcagctgtcattcttaggtagaatctcctttctttgtgtactctattaacttctcttccatctcagagtaattgattcctcagcattttattgatgatatggaacagcttttgaaataatttcttcagttttctgtgcgaaatcactttttttccccccaacagggttttgctctgtcacccaggctggaatgcagtggtacaacctaggctcactgcagcctctgcctcccaggttcagattacaggcgtgcagcaccacacctgactaatttttgtatttttattagagatggggtttcaccatgttggccagtctgttctcaaactcctgacctcaagtgatctgcccacctcagcctcccaaagtgctgggattacaggcgtgagccactgcgcccggccttaaatcacttttgaggtagatgtttttctttccgatatgtcgggacaaaattaccttttcttgtgctgcagcatttttttcatagtcttcatatatttattttactatttaccttgcttgaatgaagagacatctggtgagactaggtttttactggcagataagatgtgtggactttcttctaatggctcaacttccacatgagtgatggtcatattccctttccatctctgtaactagaaggaaggttgataagcttagattcagcccagttctcagtggctagcatcatatgaaatgaagtcagggtgtcttttatctctgttgcctctgattgttattgtgttccatatggtgacatcatagacatctacaaattccaccatatgcagttaccaggatcatccctgaatacaccctgttgataacagttaacttgcgggtgtacctcctgcactgcaggcttaacagctgccatctctgtttctttcttctttcactcatcaattatttttgctttttttccctgttaattgcaatatctgaatggccatacacataggaggttgtgaatagtactctggccatttaaaaataatgtttaaaatagggaaataggccagatctggtagcttgtgcttgtaatcccagcactttgggaggccagagtgggcacattgcttgagctcaggagttagagacaagcctggacaccatggcaaaaacccttctctacaaaaaaatacaaaaattagctgggcatcatgaggtgaacctgtagtcctagctactcaagaggctgaggtgggaggatggtgtgagccccataggtagaggttgcagtgagctgagattgcgccactgcacacgaacctaggcaacatactgagaccctgtatttaaaaaaaaaaaattaaaaaaagagaaaatgtatttagtcttttataaatgcagtgtttttggctaagaggcaattcaagggaagatgttaaacatcttctttcctttttctcaagtgtgttggcttttttgtttcttgagctaaatcataggcaggctactgattcattttttatttcaatttcattgactttgttatttgtagaaattcttggcaaagcatataaggactgttttgctagtaataggtttcagttatatttgagttttcatcgtttttagggactatcttagaaatcactttatacttaagcctctcaaaggagaggcttaagttggagtgctcaaaactagctatttaataaatggttagactattcaaataaatattacagagctgatgatctataatatttttccttcttaattctatgaaaaaggtaattttatggtgtctattaattttttccttttgtattatggttaagacaatttattaactgtataatacacagctatatgttatcatctgtgacattttgtgaacatcccataagttaatgtcacgtatcagagataatgttcaaagctgtttattttctagaaaatactttatgtctagtatttgaccatgccacactgccatcagtattgtaagtctcctgagaactactgctgcacatgatgatatatgcatatgacacaataaacaccagatcatagttgtaattcatggatgaggttgggctttcagtgttttgagcaggaaagacttgatagcttcagacaatttagtgagtaagggaacgatcttttggaggactgggatgtaagtcgtctttgaattactttgtatagaggactgtcatttactcaaagctgatatttttcatttcttttaaaaggcaggacctgtcaattcaattcttccagcaaatgctgtgaattgcaaaataagtccaaggactgttctggcagggatcttgggattaaaacaatgaacacattagccctggtgccatgttcatggaccttcgagccattatattacatttaagaaattgcattacatagtgtcacaacttttaccaaaccatatccttttgtgctattattcagtaaatattttttcttacattgggcaaggaattttttcttaaatgaatagatttcaaaaagaagttataggaaatgtctgtggaaacaaaatgcgatttatgtatactgaatatttattaattatcaactattaagatgaagaacatgcccttttatgtagtgcttgaaatcatattaagaacaattaatggtacaactaccacaccttcagaaacagtggttcagaatcattctggaaccaaatacctggaaggagattgtctatcactatcacttcaggaatttgggagtaaggggtgggcactgttctcaaactgttcttcctgaaacctgtccctagtgagctcctacagttgatgagtaaaaaggaattgaaaaacactagtcttgcaagtggggtttgtaataaataatatatcttttgtgtcttttgtaatctcattatacatttagaattatatatgagcattcttcttccttatgtttttagtttgagacagggtctttctctgtagtcccggcagtggtgcagtcacagcatactgcagcctaaaatttctgggctcaggcgatccttctgccctcagtctcctgagtagctgggactacaggtgtacaacactacacctagatattttatttatttacagtagaaatcaggtctcactgtgttgcccagactggtcttgaactcatgggctcaagtgattctcccaccttggcctcccaaggggtgggattataggcatgagccatcgcacctggctgacaatcttacaatgtaaaaacttttaacaagagactatggatacaaataaatttttaatttcctagcaatcctagaacagttgtgtacttaaatgtttatttggtacagaagcattccttatcaaaggtcaagtcatttgagattattcagcagaattagcatggaatgttggaatatataataagacatattttgtgagcttaagtaatttctaatctagttaaagagatgaaacttaaaaacatactttaattaaagaaccatgaaggcctataagcttaagttgcaaagtgtgtgagtctgaaggatgtgcatcaggcattcagatgggatgagaggagtgtgtactaagggtccggggcccttgggcaagaagtcagactctggcactttgaagccttgagtcaatggtgtgttccaattggagtgcatcaaagcaataccaccaataatgtttgctaatgtatgtgctagaaaaagtaaattcttaatcacttttttttagatttgaagattttgtcttgtttgcctgtcttctgtgccatagcttcattgcttggatttctcagaaatccacatctttgccatattgtttgaaattgggcttatgtacacatacacacatacatttaagtatattatattagcatatattaaatggcaagcacactaaatgacaacagctgtgactgtcatggtttaatcagagtgtgcaaagctgatatttttaatccatcatggtaaataagagttttagtcgtcttccattgtgtatagtcttttattaagaggttttcttttgttgttgttgtttgctctttagtttattaatttgttttccttaaaatttgccattgctttattgggaatcaataaaaccatagatttattaggaaaactatttgagaaatagcctttagcgttatctagtaagcagtagtacagaagtataagcatgctgtcaatacatcttcaggttcacttttatctttctgtgtgcaaaacatgactgggattctaatgtttgtttacaagaatacttaaatatgatacactgtcctgtaacacttataagtcatccatagactcaatttaatctggaataatgtttttaaaatagtttttaattaagctcaacaataaagtacttatatagtatattctaagcaatatagtcttcttaataaattatattcccaggtgtgtctcgactaatttgcatttgaaataaaatattttaggcacattttctatttagtttatgtataaaaatatgtacatattgagcaaaaattgttgaaggctttaaaataagccgagattgataatagataaggtcttttacacatgacccatttatgcctggcgtatttcttcacccattttaactttttgattgtatgtgcatcatttcttatcttcagtcaaatttggaaatcaaaatctcagaataatgctttaattttttggttagactcactgggtccttataattgctagttttctcgatctgcagtctttgccagggggggaaaaataaatctaatcccttttaggcctgtttatctataaattctctagttttgttccagttcctgccattcatttctgttttagtgctaatattttcaaggagtttcttgcgcacttcccattataagctgattaaaacccctgtcttggcatctactaatagaagttgcagctgctcctataaactgagcagttaataggaaggaatacgaaggattatagccttttccttttcacattgtttttcctgcaccagactctatataaaaagctcctgcttgtgaagaatcattttgtttgcccataggattttctctctgcattaacttttagtgttttgaaccactcagcattcaatgttttttactctcttttaaactttaagttttcctttgtgcagcttctttaatgaaactttccaatcgctttacagagaatagctttttttgatcctctaactatagcaagacatagtatacaaatacattacactataactgatttcaactttggaaaactgtgtgaacatgtatcagtgagaaagtcacttagttacttttaggaaataactgtgtgttaaaaggatttttaatcttctgtagtgtttatacatcaacggcttagggttgaacattcttttgaagcactcatcctgtatttcgtattaaataaatttggattaataagccttgtggaagtgtcttcgtaatattaatttatttataagtgaggaggagaagatccatttaaatacaacagggataatactttgttcaggaattatagagaagagttaattccatagaaacagaataaaggaaactctctatgaagtagaagataataatatatcaggtcctcatcttttcattcaagacttaagacaaaaatgtctccttaaattcacttcagccttgtggttttctaatgttatgaaatattgtctgttttgaaacactttaagatttattttctgatgaaattcctttggaggcaatacatgggtaagaggtggaaggagaggaaaaaaaatcctattaagctaataagagaaaaaacttgttaaagtgttataaatatatagaaagagttgaaaggaagaagacatgttagagagatgaagtggggaagtaaatgaatcacttcggttaagtggattcttaatttattgctggctactaaccatgatcttagttttcttaattttcattgtgatacatgaaacagagaatggggaaagtctgaaccttacagtaagtgatatttagaatcttagccatcaatatgggaaaatacatgtaccataaaaaaaagctgggttttttttttaagtttgggagttaaatgtacaataatatctatttgacattatgagagttatattttcttaaattagatacaaaagactcagaatttgactgtattaaaattaaaatatttatttgtgtatgtgtgtgtgacaaaaaccataacaatgcttaaggaataaagtcaaatcagaaccagtattattctcaatcttgttcactgaaatgtttaatttaaaaagacacgaataggcatatttggtggaatatttttatttcctcagctgattctttaagaaagtatgaaattatcagtattcattttattatagaaaatttgtttcaattttagttcaatatccagtggtacacaaatgtagtattgattaaatgaagtattgattaaaaattacaaaactcttgcgttgaagggctggaaaactgaggttttcttagagaagaggaggattactgtatgagaaagctaaataatccatattgaagacaattgcaaaaacaacagtagctatgtgataagcattattcatatgctaggatcatttttttttttgagatggagtcttgctctgtcacccaggctggagtgcagtggcgcaatctgggctcactgcaagctctacctcctgggttcaagccattctcctgcctcagcctccggagtagctgggactacaggcacccgccaccatgcctggctaattttttgtatttttagtagagatgaggttagaccaccctgttagccaggatggtctcgatctcctgaccttgtgatccgcccgcctctgcctcccaaagtgctgggattacaggcatgagccaccgcacctggccggtcatttttatttaaaacctaattatattaaattgaagatctcttcatcaacagaagttcaagtaaaaaaattatcagattttgaggcttactggcagtgaaatagtgattccattaattgaaattagaaactaatgtagaggagaaactagagttcctaaactgatcgtgagtttgcagtaggatatattgagtttggaacattttggaatgtgattttgtggtttgaaaaagagttctgagctattgctatagatttaaagaggatgtgtttgtgaaagtacttgagaacaccaaggatttatgattatagaaagaagacggaggatagaatcttgaagaagaaccaactgcaggtataaaaggatacagttctatagaatatctaagatagtaaaggaagtaagaagtgctgccagtaacacaataaaatatagccattaaaaggtcaattaagaactagcaggtggttcactgatagaaaactgttataacagttttataatagaaacagttgaaatagaaaacagttgaaaatgtctgtattgcttgctgttttaagtgatactaaaagatagtatgcttcgaattttgggagagttgcttttacatatcctctttgggttttcctaggatgtttttgttcatcgtaaagcatcactaggttgatcttctaccagatgtactgagcctttctttgttgttttaaatgttggtgacagataatccttaatgggtagtgttcacacaggactctttcagaacaatttatttttccagcactaaaatcttctttgactttaaagtgacctgtgaaagatttagtttccgactcaacaattaattttgcattacataaatatttcatttgaagtttcaaaatgctcgcctttatttttggtgacaggtatgattgtcactaaaactttcagatttgtgacattcataggatttaatatactgcattttttgtcaaaaagtatttaatctccttttatcacattacttttgtcagtgaatcaagtgatttggtcttggctgggtgcggtggctcacacttgtattcccagcactttgggaggccaaggtaggtggttcacttgaggccagctgggtgtggtggtgcacacctttaatcccagctactggggaggctgaggcacaagaatcgcttgaacccaagaagtggaggttgcagtgagccaacattgggccctgtactacagcccgggcgacagagcaagactctgtctcaaaaaaaacaaacaaaaaattgatttggtctttttaaatttgaatctaacttccacattttttcttttacacttacataaattcttagcactccgatcaattcctttgtttggggtttcatattttcagttttgtgagctttgtttaatatgaaaacagtatgaaacctagtggtatcacaagttcgtgaacagcaggagcgataagtcacttaaaatatgaagctcatgaggttgtgttgattatttttcaattctctaatctttttctagatgacctgccgctcttcttaaggtaacaacagggtgtgggagaattgatacatgaatactcttgaattgacagataagtacacttggctttggtgatgttaacatagctctgtgcgcacccctttcactaccatgaccatcacccattaccaccatctcctgaagcaaaaacaaatcttaaagattgtgaatgtgaagacattgcatgcttttaaaagtcacttagtttaagagaaagaagtatcacctggcattattgcctagagctctgtcgttcacgtagattgcactggtatgtgtagagcaaagggccggggcttcaatgcagcaggctggctgcaggttgtatgccctgtcaatgagtatttgttgattgttgactgcatatttatatgtaattataaaatctagatctacttagaatatgatccatacatgatttattaaaaatttcagcttaatattcatgctaacatatttaattactgattttaaaatgaaatattaaaaaaattatagtataacccctttataaggatgcctattatactctactttttttataacgtactccattgttacacttctttatggaaaggagtaagtgaaaaataaggcgatcccagttattaactgtcttctccattccacttacaacactcagtagcaggtacagacgtgatgatgattccagagcattatatgagtctgactccaaggaagattagagatgcattcactgtataccattttaccatgcatttactgtactgtgctcactaatggattacaggagagaacctatttacaatactattgtcaagaaaaactgttttaattaatgttaagcaaaaaattagattgtgtatataatacttaaatatagatagtactggttatttttttaaactttctttaatatcctttatgaaatagaaggtctgatggtattggtcaaatggtacaaagtttcaggatgaaatgacacttaatgtaccaattggggcaatagttacaataatgtagtgtatgcatgaaattggctaagaggatagatcttaaataaacacacacacacacgcacacacccacacacgtccccccacccactgcacatggtaactgtgtagaggtgagagatatgttaaagtaagtctggtgaaagattttaattatgtcatttcaacagttccttaggaactaaaaaatacaacatatgcaatccttgtgtttgttactacttttcagtctgaccaaatgagctttttttgctgttaaaaagaaaaaaaatgtggcacatacacacaatggaatactatgcagccataaaaaatgatgagttcatgtcctttgtagggacatggatgaaactggaaaccatcattctcagcaaactatcgcaaggacaaaaaaccaaacactgcatgttctcactcatgggtgggaattgaacaatgagaacacatggacacaggaagggggacatcacacactggggactgtcctcgggtgggggcagtggagagggatagccttaggagatatacctaatgctaaatgacacgttaatgggtgcagcacaccaacatggcacatgtatacatatgtaacaaacctgcacgttgtgcacatgtaccctaaaacttaaagtataataataataaaatttaaaaaaaagtagaggaaaactttttatggtgttttgttaaacgaagcactattaacttaatcaaaacaagaacgaggatcaaattaaatctattttatgctacctgacccacctacatcgctcaagaaaaccactgctcattttaaaacatatgaacttctgctacaactcaccccaagggtactgtttactgttgccagagaaggaagcagctttgtcatcaatctatgcctgtggtttggaccttcctccctggtggggttcacgatttttattacttttttctcctctttgttcataatgtcttaatctagttagaagttttctaattggtagagtggtgatggtagtgtcttttacagtatagctttaagataattcacatgagtgactaacagtttctggctcattctagatggccccaaattgttaacagcttttgtcattttcccttaaaaactattggagtaaattcatccttttaaggatgtacaattgagttatctactatattcttttctatatacattttctgataaaaagctttttaaatttctccagaaaagttaataatttttaaaattatgtaatataaagaattcctagattgttctaaattagacattggatatgcgtttttcctgacagtatatcaactaattttatagagttacgttggaagtatgtgaaatgatacccctgtgttcatgctggaccactttgtgtatgtgtttgtatctgcgtgtgtgtgtgtgtgtgtgtgtgtgtgcacatgtatcttctaatcctaaagtgaaaaatttatccattgttttgcttcatgatgaaaaagttatttttggagaaagggttcttaaccttcatttcatagataaagtggtttgtagatggcttcttggggtctggtgaatattttgaaattatattctattgtgtgaacactgagagtgtatataattttagattgtacagatatataattttctgatttgaccatccatagctttcatcagattctcaaaactttctcaagccattggtttaaaaggatcaaacgtaactttggtttttaagtagttggttcagaagtttaacatacttgaggaattttgaaggctagttttataattggagcaattataaaggaacagaggattatagacattatttagcaaatcatgttaaggtttgtttttgtctcaaaactttcttcatcattatattcttctgtctgggtcatccttactggcatgctctttatcataatggtgctactatattgtactgccgtaccacaccagaatatcagttctaaacattacctttcaaaccccacatccagcacagaaaaaggccatctaaaaaaagttttcatcttggaattgtggtgaggaggggaattgtgaagagaaaaatatcaaatttgttaatgattagtatacacgtttttcccaagtcaagccaagaaaatggcattttatttttaaaacaatatttgacttttgacttcagaaaggaaaaaataatttcttcatgtatatgatacttttttgaagttgctagttttatttcagggatctcatatatcatggtgaattaattccaagtatgaatttaatataactctattccatagaaacagattttatgacacggtaatcagttgctggtgtctttttgtagaatatgggggatctcagtcagttcttaacacagtggccttcagtaagcaatggtagttcagaaaccaacccttacattaccctttttatccaccaaattttatttgtaaatatgtttgcaggtgaaatataaacttttttcttaggcagtttagccagtcagcaaatatttattgaatgtctattatgtgtgaggcactgtgctatgtgttaggagatacagtagttaaaacaaacaaatgaactaaaccaaaccaaaacaacaacaacaaaaaaaacaagaaacaaacagaagctttggcaaaaaaagtgattttattaattaaattatgcgcagatactttaaaaactaagtaatcaaataattaaatgaatatatgtgtgaaaattgaattcattgtgagggatatgaaatgtgtactttaatgaagattcagtttttcatatttttaaccctcatcagtgaacacatttggaatgatctcttgtcttctctaagttaatatgaaatttaccactttttaagagtatcaaattcgggaacggtatttataatctgaagtagaattaatgttaaccctactgattcaagcagtggagtgaagccagaatccagcaaatcattaataattggtaaagatgtctcttacttcattggtaatattagaaacaccccacaaataacccactgaaaagcagtaaaactgttattggatcatattagttattaaagttattaggattgttactgtttttgttgttttacctattttaagataaagtactgtaaatataacagctattgccaagtttacgaaaacaaagaaaaagttacactcagtgggctgagttgaataaagaggcaataggaaaatatacacttgtgaattaatcacacaaacatccaggttgaaaattttcctggagtagtgtaatatagtggaaagaaaatagtatttagactcaaaagatttgtattgaaggtttatgttgtcattaggaaaattatagtgtccagtttttctggggatattcacagtttatgtctgtttgtctgacataattaataacatcactctcttttattctcaaaaatgtattgtttagacaagatattatatgatgacccttatttattgtgacaactaattctgttttcataataattaagtgtgcatgatacaattagtttttatttgttgttttagctggtaaaaacttatgtatgagaaggttttttgtaatcggaaaatcattgtaagaactataaagagatacataggccggttgtggtggctcaggcctataatccaagtactttgggaggctgaggtggatggatcatgaggtcaggagttcaagaccagcctggccaagatggtgataccccgtctctactaaaactacaaaaattggccaggcgcggtggcaggtgcctgtaatcccagctactacagaggttgaggcaggagaattgcttgaacccaggcagcagaggttgcagtgagcagagactacactcagcctgggtgaccaaaaaaaaaaaaagagagagagataaagatgtttgtattcatttgggcaaagtgattaaggtgactataaaatagagtagttttatttttatcatatcactcttaaacaattaacattggtgttttttggattatttgtgtaatgtccattctctgaaagtgtgttgtgttgaaatcaactcacagaccatggcaacaagcaatattaaaactttgactttgcctttgataagagatatatttcattgaattaaaattcaatgggtttactaaactgagaaaatggaagaattattttgtagtttcatcagtgttcaattttgaatgttcttcagtttattctctttatcatcttcaagaggtacctcatgcctttctattagctttgaaaatgaaaataattttattatttctgtaagtcattatcagcagtcacagatgttaatgttcttccctattaatttgatcttaagtgtgcaattgtcaaacacttctgtgcagctctattcatgaatcctgttttatttcagaggatttattttatttctataaaatggttgcacctttgcttttaaaatttcttcctggaaagctattggaggatttgtattaatttgaaacaaaagaaaacaaaaccaatttttacactagcaaatgaatttctaacttcaaggtccctttatcaatagcaagaagaaacttattctgcctaaatctgagaagtctttaactcaccatcgggaggactacaaaaccttggcaagcaagagtcaccttaccatatggaacttttaaatatgtagtttctgggacaagatattaagggataataattgctactttgcagggttactaaaagcattaaaagataatgtatatgaaagtatctggctagtaacctgcaattttgagtagatactcaatagctattagttgagttaatgagcaagatctgggaagaatgaagagtcaagggaataaataatgctctttcttttattccaaataatgctctttcttttatttttttctatgccagccaagacccgctcccttaaagattagtacaaatgtccatgaataaaagttcattgactgactcagatagtcatttttacaagcttatgtgtctttccaatccttcaaatttttttaacttccaaaatctgaaattgaagattctgaaccacctagattaggatttgaggtcaccaaaagactcaattttactatctccatctactggcaggtaggaactatatccaagcatctggactggcatagaaaagaggagaaagaacatttaaaaggtaagcaaaacgtatatttttatttactctgagtttttaagcttttcttatcagaaactgttgtactttcatgtaattaagcttgatacaatgaaccatattagagcaagagaatttgtttaggtagtacaatactcttatctgattcttcaacatgagcaagtgtgaatgtgaatgccttcctttcataatgggagtactttctgtctttgcacttagtaagtttccatgtagtcattccaatgccctcttactgttttcactcatactcctaataatctttaaaccgcaaaaatgtctacattcccacttctgtatattctctgacatgttagagatagttttacctggcaaattatttttattaccatcatttagaaagagtagaagtatgtttctcaaagttgaatttattattctgttgtttcttatattttttcattgtctgtttataattattttaattgggcagaaagaactaaataagtttcctgttaattgaccagtaataattacatcagttctttttaaaattgatactttgcttttccctcaaaaatcttgaaatttccttggtttacttttcactatgatcaaaagttgcagtatgataactgctataaaaaatgctttgagggtttatgtggttgtgcagtaatagatctttaagtttaaatcatatattttaaatagtttcatattttaagtcttacattatgcattatgcatatctttctttaaaaagccatatctacacttgagaaaagaagtaaaagacatttgtcaagataattagtattattactattgctgcaattaaataagtataatttgtgcatttttttttcccaattagttttctcctccgcgccccgtgtcaggtgtttgttcatatctttgctttctttctttagatagtggtacatttcttttagagggatagatggatttataaggaacatagtggagaattttcaactacagaattagatttcatggaaaagaattgtcaaggaaatggtattccaacatgtctgttcacttgctcgaaggtcgtgaatgcagccggtccatttgctgggtaggggattacactcacataaacagtgcaaatgccataaaggaggacactcagatcttcttgtggcatctgacaatgtccagtctgacagataactcttcaaagttggccctgagatcagaagacaaggaagtaggtatttttcaataatgttgaaggaactagtgataatggggtgttagagaataatctcaccttgctaacagaattttggtgagcctcataaagtcagttcagtctctattttgaataaaagcatatgtcttctcaaatttattccattctgtctcaactcctcttttagtaccactgtcccttgatcttcagatcagtttgaaagctgttgtcataaagctagctgttgctgaagaattttgctagttgttacagtcaagccaattctagaataaaggatacttaaaatcttcatgtttaagcttttcactctttttttttataggccagctagatgataaaaataatgtgcactgaggtggaataacagcacaattgggtattctcattggtattaaaaatgtctttgctttgagaaataaaatttaagcaacccgtcttcccacaaactatccaagctttcttattaatttatggttttaatttctttaaaaacctaatgtttatatttttcgtatttttacatcactttaagattgacaaaaattgttacaggttgggagtgtggggtagggaggtaatttttctagcagggctgaatggataggatgttcacgagcatattttgtttaaacttagcctttgaggggcaatcatgtcctaggataattgccctttatttatacctgatagagttatgtggaattactgctgaaaccaaacatcttgctacaaatataacttccaaatttcaaatatcatgtatgcaattgtaaacactttagcacttattgacattatttaatcacataagatagaaggacatgatttgtatagaagtgaccaaatttagtatttttcttgccctcaattagcattcctaagaaaatcataggttcatcatgtatacattatatacattcacttttgaagctaaaatgctaaatggaacaggaagcagtaaactcattttcagcattaatatattaatctgaatatagtaagactaaaatgaatatgtttctattttcttattttttaaaattcatttgttttgctcaattcagagcttaaaaagagaattttaagtatcttttaaatattcattaaaagcataaactgatgggcttatttgcattttttctatgaaatagtaaatttgttttggttatctttttgttgttactttcattggtaaattttaaacatcttcctgtcaaaatgtcagtactttatctagatgttgtatgctcacaaagtaataggtagctactttccatattttaaattgcttgtaaattctgctctgaatgttgtaaattatatgtccaacacaggtagaaaattaacagatgcttaatctccaaaacagatgaaattctttattgaaaatattttccttaaagttgtttgtttaaaggatatataatgtgaatttgtggttaaccacgttagccagtttttgccacaacagtattattaggtgtaaatgtattattctgcttcaaatattttagagtgcctaatattttatgtgaactttctaattttaattcaataagagagttgattacatatttaaaaaatcaatagtgaacctttaaggtgaatgcttcttttgtaatatgaattactcctaattttttttcttccacattctggttttggtctctttaatgtacaatttaacagagtaaaaaacttatagtattgccaaacatgtttcactaagtggggtgtgcaattgtgtgtgtatgcaattatattcattactaattggtatgtaataaaggctttgaggagattctgtgtgtatatacttggccatttatcctatttcataataggtaagaagattattgcttatttttcttccataattgagccttcattttaaaacgtcatatcccattgtatagaacaaaaataagattattttttaccattaccttaaggcaaaaatgccatgttgtcaaatcattaacatttctatatcacatgcttcagtgccagaaaaattttatagatcctctctgctgagtcttttatgatgcaaattgggatattttcaagggcagaaatagtggcacgcataataataatcgcaccaggataacagacttaaataaggctattccaggtaaacccaaacatatattcactgtataattattttggctgtaagtatagaaagttctaactcttattggcttaataataaaagttgtttatttattcacaacactgagaaacctagagttgcagtgattttattgtgttatttgagatcggatctagctgcatttttcaatactaccgtacatctgcccacttttgtgcatcaactttttcattaggctagaatccattatgatggctaaatgggtgcaggagttcgaaatctcacttccatacccgaaattgtcttgtccccaacttttcggaaaaagccattgtatttactctgattggcctatctgaatgggcttatattgattttctaggaatacttctggctagggtcagttcgacctttattcagtggctacttcattgtggtgttgagggatgatgagaagatgctcgctatattaacattccttcattgcatgtggaagctttgttgtgtacttcctgaacacaggcccccatttcttaccaaagctcatggacaagaggctggtggttgagttcctgtacttcttattagattcatgagaacttcaaagtgttttttaaagacagcatcaagtcaaagaaatggtaaaatttctacaaagttgctccttttcctccttctttaattaagctgtagaagtaaatcagaaatttgaaatcactatctaaaaatcactgcttcttgcttaatcaatttgatgttcgtaaaatcagaaggcttatacagatgaccaatgatgtgttatatcttacatatgtcttctttttgatgacatcaggaaacctagtatgtgtgggtaaattttctctcttattctatttgagttaaacagaatatgatggccagtgttcttccatttacttatatactgattagtaattcttttatacaaatatcatttcatttgaactttaaatcaacctgtgattatctccagtttatcaaaaaaaaaaaaccctcagatatcaagtggcttgcctaaaataacagattttattatcaaatagatcatattttacagtttagataaaataatgactacaactgtggcattcccaaggtgtggtacattataaaatgtgttctattttcaaaataagtaggtatattaagaaaatggcagatctcaataatgcatactctaagtcctatcactttctgctgaaatatgtttgtaggttattacggatgaactttgagtaagacatcaaatgtaaactaagggactttattagggtctataaattgtaaatcatattatctttatcatatacagcgtctggaagttcaggagtgaaggatgaattgttgaagtgatatgtaaaattgttttctgccacgtttgtataatctcaagtttctttagagtatcaataggtattaggtgctgccatgtgccaggaacaggttatgggcttcagtaaatacagctgaccttctaggaattgtagtgtggtagaaaagtgaatccataattatgattaaaatattcactcctaaagggagtgtacaccaggaatcagctattgccttccaaaagaggtaacatctgaaactggctcgtttactagtatagctggtccaggaatgaaaccaaattacaaccctagaggttatcgcatgaagaggacaggactttatttttaagcacctgtagaagtacttgaaacataataggttctcattatataatttttggttatttcttaacttcaggaataaagtgattaactgtcttctgggataagctcaggagccacaactggacatattctaaataattgtagtagttccgtggtttactgaatatagcaatcactttttttacttttccttagtgaatatttatttgtgtaattggaatagttggaggtaaccaacactagctttgttgttttattgtgctatttgtcttaaagatatgggaaatgatgataaagcagaaactagagtctcttttccctctagcccatcattatacttttatattaatagaatttaaaatattaagcatgtaaatggagtaattctatatagtttgcaattgatggagagagatttgtttgctctgtggacctcaagtataccttctctctacagaatcaaataagattaggatgaaattactctgcatttcctaggcaaaaacacaccagctcatggagccagtgaaactatatgtgtatatatgtcaatgattttaactaacagttgttaaaagtgaattttgttagttgagaattaaggagattgaaagcagatgcagaaatagctatatccacaaactagcaacattaggatgtagaaaaattatcacaggtgaaaaaaacagtgagcatagcaaagcacaaattaaatgggtgaatgtgtgtattatcaatttatagagtgagaatggggaatacatgcatctcactctaagagaaatgcatttttacatagtttgaaaataacacatatttgcaagcaaatacatccaaaatgtcacaggacatccgtgaggccgatctgtttactggtgacatgttgctacagtcgtgcctacatgaaacagaggagcagaatccacaactgccaaactaaaccaagattcaagacctacttctttctacctaattttaatctaccatttcttttctgctaaaatcaacttaaaacattagcataaagacatggatgatttttaggagttgcatattatccagaaacttcctcgttagtgttatctttattaataatgtagcattttgaaggattataatttgaattgcattttatgattctcttactaccaccttctttcacccataataaatatttttttaaaggaaccaagagtatgtaatgcatggtaaacattatagaattgctttgattttaagtgctaaactgactacttacagatatatagtgattctatataactgaattgtatatatacacatatagtcaacagttttacagtatttacattattagtctctcttcttttccttttttaaattttttattcattttagtttccagtacctctaccttaagaggagttgggtatggtaatctgaaattgtctataatttttaaaatgtagtatttatacatattttcatttttcatgtcaagctcgttatctaagatatacaagattgattcttgttaagtgtgcaaggatcatgtgataaatattttagtgatttgactataaactttttttttgtttggtaatttgagtatactgtctgttggatataggaaaagcaaatgttcaataaaatattctcaagtgggtacttttctcatccctaaaatactagtaaagttatatgttcaaaaaaatgactgttaaaacaacagaatataagcacagtgtcttaatttggtaaacttaatgtttgttgcttctttttctttcttcttctgattataggcctagttgcttgagatttacataaaactttgacagtcatctgcaaatcataagtgtttggtggcaaacctccttgcatttcaaggtgaattttttgggagcagtaatttaacttaaaagaaaatttacaatttttttttaaccacaaataaggcccagattttcagtctttaaattatgtttaaatatagtccaatttaatagtgaattataaaggaaaaaatgtaaacacaaacttaagtatatatattttagccatgcgctttatgactgaagatataaaaatagaattcagatcttttaatagctatgtagttttctcaattatatgccacacactgctatatttgtaatgagtgccttggataaaaggcatttgttttgaagcaaaatagggtagatgctaggttttaataaatctgatgggaaaaaataattcattgagaatactagttgccaaaatgagaaggattatttttataaattactataagtacctctgaaatatgtagattatcggaagaaactttggacaatagggagaaactcatttttgaaagaaatatttgaaaatagttaatgaatttacttttcaagagtttatgattattactttctttttaatgttttgcttttttatttttgaggcaaggtcttgctctgtcaccaaggctggagtgcagtggtgccatcacagctcactgcagcctcaacctcctgggcttaagcgatccttccacttcagcctcccaagtagctgggactgaaggcacatgccaccatgtccagctaatttttgttattttttctagagacaaggtttcaccatgttgcccaagctggtctcaaactcttgagcttaagggatccacctgccttgatctcccaaaatgctgggattacagacaggagccacagtgcctgggccgagcattattttcttaataaaatttgtctatgtggagaattcatctaactttatagttccttctgtattcttaggagatacactggtgctaaataatatgcgtagaaaaggcgttaattattttatatatattattacagccaatagcagtatcaaatattagcatctattaagaggaaacatgttctgtatagggtgcttactgctgaggaaaaattttagcactgagaagattggtagcattcagttatttaattatatctcataaataaaaacgttacaattatttggggtagtttaggattaaacaggttgtcctttaaccttagtcatagtctaactaatatacaacccttcacattgtgtctttcaggaagtttcctagagcaacattcttaaattgtattttattaatgtgaaataatgttaacatattttgattaacataaatactaaatgaaaagtagctgcagttactgcaattagtgctgacaattgtgagcaaaaagaaatacccataattcaaacagctttgtgtgcgatagaaggtgtattagttttctaatattatgtaagaaatttctacaaatttagcagtttaaaatatcctttatcaacttcagttctgtcagttaggattccaggcaccacgtgactgaattcttgttcagggtcttagaagattcagatgaaggtgtccaccagactagactcctttctggaggctgtagagaacagtctgcttccaagctgaccagggtcctcaatctttcagaactgagttgttcatttccttgctggctgtcatccttagactgttctcagcttctagaggcttcccacatccattggcacatggcttcctgcattttcaaagccagaaataaagaatcaccctcctgttgaagtatctctcacactttgaaatttctctgggtttaggaaggacccagtttatcttgtgggctcacttgataaagttagacccacccaaatatgattaactcaaagtcaactaacctaatcatgggagtaatatcccattagatttcacacactcgaggagaggattatgaaaggatgagggacaattggagatcattttagaattctacctatcataaaggaagtgagatcactagtgcgaagataaaagaagatacagactttaagatattgagtagagagacagagaataggttggtggaaagggacttaggtttctggaagtaaaataaatgaagaagaggaaatggcagaaagctataataccaagacaaaaggaagaaagaagaaacatgtagggtttaatctgaaatgtcgtcatttcataggacttagtaaactctgttacacagcttgatggcacatatccaaaaggcagtgaatacaatgatacttaccttattttggagagtaatctctccatgatgttactgcaaatacagtgttcagtgttgtgcagcatatctccaaattatgaataccaatgaggcattgctaaagactgttgtgatattatgagtatataaaagttgcactatataattgtcagatatcctaccatgcatatcacttcatgtgttcaatgtccagtctaaggcttttactttttttaaaataaaatagtattagaaattcaataagggatatttaaaagtttttgttgttgttgctgttgttgttgtttttctcattggaagttagcatccttacacggatttttttttttttttttttttttttttgagatggagtctcattctgtcgcccaggctggagtgcagtggcgggatctcccctcactgcaagctccgccttctgggttcacaccattctcctgcctcagcctccggagtagcagggactacaggcgcccgcccctgcaccccgctaattttttgtatttttagtagagacgggatttcaccgtggtctcgatctcctgacctcgtgatccacccgcctcggcctcccaaagtgctgggattacaggcgtgagccaccgcgatggtccttacatggatttttatggcctggagcctataactagcctagttcttacattttttggagtggttcaatgactgcttattttataacttatcaattgtgggtttcgtctcattattaactctcaactggttgggtataggaatacttcctttctcagcagtgccaacttgccctttctctcaattctctccccaacattttaataaaaaggaggagagatattattaacagtatattttagcatttcataaatgtgaaaaggtaccttgcctaataaacttggaagccattttgtactatactctgcccttggagatttagaattcatatttgtgtattcatgcattgagaagtgctgcaacattttttatattttaatattttcatgtactgctaatagatcccttataacaagaaattgagaccattattttgatcttgctttacttttcagagtcatttaagatttaggttatttagtaattccagttcacgtgaagctctgaacttgtattgcataccttttttgtttttcccagaagttatgggtccaaataatgagctgttattaagaacattttgccagctcaattcctaaagcaatggtaataaaaagaggtaagaagctgtaaatagtgtgtcgtatggtatgctaattgacatttcaaagatcagtgagaaaagctgaaaacagtcttttctacctatccacttctgcctcttttatcctcacatttcactttcttcaaatatcttaatacccttcttattttgccatatataaaattaatgcaaatctttgaataattagttgactgtagctctgcagctttaagttagagaattaaaatcattatttgtattttttaaaatagaattatatctagtgtatttttattctaaaatgtctcatatttgataacttctcagaaatttgaatgttaactcagctttattgtgattttaggactccaaaagagtttgtagttgacgtttcagtaattaaattccttaaaagagtaatttgctatgttccttcaagtataaatatgaaacaggtttttattcaataatgataaaataatcttttttctggatcagttctggaaagagtggtatttggcatatatcatataaaacacactcagcacttgtctgaggtaaagtgtgaataataaacacttgctttgatacctataatttttgaaatctaaatgtatgtctatgtctatgttttttgctttaggagtacaagatcctcagcatgagagaattattactgtgtctactaatggaagtattcacagcccaaggtttcctcatacttatccaagaaatacggtcttggtatggagattagtagcagtagaggaaaatgtatggatacaacttacgtttgatgaaagatttgggcttgaagacccagaagatgacatatgcaagtaagtgatcatacttgaaatcccaacaatgtaacaactgttaaaagtctttcaaattgcttaattttgatgatctgattttaaatgacatcttttgttttatttttctgatgatctaagaaatttccagccttattgaagctatgttttatttgaagtcttcatttaaaatcggaagacacattgtgcatacaaagtcattgttttctacctacttctaaaattatttaatataatttatggtaaaaaagcatacatggaataaaaccatttaaaataaggattagagaatacaaagctgtataaaggactgtagttgtgctagaaaaccaaagttgcggttactgctaaaaatcttatatttgaccttcctcatagccaaatcaataaaataaatgataagctactgaaagaaaaagttctatccacaggtacatattacctggatacatacccatgcacaggactaagaagtttgaatattacatcacaaagaagaaatatagttcagaaagcagcattagatatttaggctaacgttatgccttgccaggtaggaattcgtcataattatcctagaagcattcatgaaccaaagtcagctggagtatttcacccacgcaaaagaccacctactgtatgtcacacaaatattactctgtaaatcccatatgaatacacttgtcaaggttgggtggtcttactgaagatttttcacttcaatgacatttgtataacatgaaaatattttacttgaacttcactggattttttattttctctttgatatacaagttaaaagagaattttcatctcatggtatattacagataaatatttcagtacaaatgaaataaactttgtacttgctgtcatcacagtttttatctttagcacttacatagttacatattcttcacatttgttctttctgtgactgtgcatttcatgttgttgtttttccttacatctataattttagactttgagaactagaagctaccctgattatctttagaagactaccagaggagtaaagcagatgccctagatctcgttcagatttggtacctaaacaaatgctaaacccatttttcctaacacctatttaggcagtttttcatcatgctgtactgcacctcttgtctttttttatatataaacataatcttgtcaaaaattgcaaggggtgtaagattttgccctacttgcaaagtagtaagtaatcctatcccttttgtggatgctaatgaagacaggagacttctgggtcagagacaaaggacttcattacaaaagtagcagtcactggagtattattagcactttcttgtgctttctcctagagttccagttcccacaggttaacaccaagagagccatgtgacaccagctacccatattccttcctgattacaccttcttgtcactgcaaatataatcattgtcctaaattttgttactcattctcctgattttctctataatttcataagaagtacatatttctctatgtgtgatcttacaaaaatagttaattccttggctgttttgaaatatgtatcaatggagtaataccatgtgctttcttttatgatttaacatatgtttcagaacaagcaaaactaaaaaaattatgctttaaaaattagttcatattgaggcagatagcttattagatcatttgttgtctttgacgtataatatttcatcatagaaataatcaaccttttttgtgtcttctgctttgaggaacgtttgacttgtttccagttctccttgtgcaaaagagcaataaaactttgagactttctgacaatggtttcagtgttttaagacatttatattttcagctttactaggtagagttaaattgttttttcaaaattatcagtttatacatttcccaacaatatacaaaaatttttgttgcacagcattctcaccaacttctgatctgtcttttaaaaaattgtaatatgggtaagtgtgaaattgtaccttatcattggttttattttgtttttctgattactaataaggttgagaaatttttatatttattatcagccattcatattacctttttatcatgcctgcttatgtcttttgctccttttgtattgatctgtttggctatttaaattttgcctttaatttttctttatttatctggaatttatttatgttggtggtatgaggtttttcaggagggtatccaatagtatgccagcatcatttattgaatagtcattgttttccccagtgaaatgcaaagtcagctgacttgcagatcgggtttctatatgtagtctgctctgtttcttctgttactttggtcaattttgtttttcttaaatgaatgacactgtcttaactgctgtagcattctagaagctttgtgataagcaaatctcaccttattttattcccattttggagcattgtggatgttttgctttttagtataaaaataggtataaaaaatgttgtaaagatagtacagagagttttgtatacttttaacccaggttcctccaatgttagcatcctacatactttggcatatttgcataactaagaaatcaatattcatacagtattattaactaaactacaggtcttatttggatgtcagcagtttttccagtttgtcaccttttctgtttcaggatctttttcagattaaactcattgcatttagttgtaatgtctcgttagtcacctagaatctctgactgtttctctttccttgtgtctcatgactagacagttttgaagagtacggtcaggtattttgtagaatgtccccccagtttagattgttcacatgttttgtcatgcttacactgagattataagttttggggaagaattccaaataggtgatatgcccttatcatatcaggaggtacatacaaccagccttacttattagtgatgatgttagctttgatcacttacgtatggtggtatctgctgggcttctgctctgctacggtaatatatttttctttcatattctattatttggatgtatgtagctaattctagcccacactcaaggagatactgattacactccacctcctaaagggtatatgcatatattatttggaattcttcagcaaagaaggtttgtctgtccttccttttttcatttcttccttctgtcatttatattagtaaaaattaataatatttattttattatttgtgttataagcaaaatctatcattattaactttcttgctgaaattgttctgtctgcagccgttgggactaaaggatttgctcttaacatgtcaatattgagtatgatggttgatgaaggtttatgttttgttttccttcaatttactttttcatttgaagtgctttccttcgtttttattttgctaagaggcattttccccttagggaaaatatctttattattcttttcttttggatttaaaagtaagctgccaacattatgacactttgtacccactgtgtgttgtttaagaacaaggatatttcccatcgaacattagtagcagtatcaagtgaaataaatttaacattaatatgaaactcttacccagtgtttcccatcatccccaaatgttttttaatcattttttcatctttttgatctaataaaacattataattgcatttggttattgtaactctttcgtcttctttagtctggaagagtcttcttgtcttttcttacctttcatgacattggtcaggaattttgaacaattcctgaccattctacagactgtctctcaatattaatttatctgaatatttcttcataattagatctctcaatattaatttatctgcatatttcttcataattaggtcctgcttaaatatattggccagaatgctctttgtaagtatttctgattgcttataatgtcactttcttgcattatcagtgacatgagtttgatgactatccaccagatttctctgttgtggatgtgctttgtttttccacattgtaattaatgtgatttatggggatatacttcaaaaacatgcaaatcttgttctgtggcagtctatcacccaatttttttagcatccatttatgagtccacttttaaagacagttattcattttatgttttctaggcatttttttgaagttttcagttttattgtcattagtattttcacaatgtgtccttattagattttaatttctgctgcatctttatgtcttttgttttattactaatattgttttgtgctccctcctcttcattttgctttgcttttctgtttcctcacttagtcttgcctatgatttggtttattcattgttctttcaaagaaacaaattttggctctgttatgactgttaaagaataatgttttcaaaaggtaaaatttgacttctctgtagatattaagtaaacacatattaaatgttttatttaacttactaataaagtggtcaatcagatgttataaccagtttaataacaattcaaagaacagacacaattatagattgggaatatagaaataaatgtgcaaatggaggcaaaattggcctcttccacagtaagggagagaactccattaaacttccactggacatagtttatttatatgtctatagacaataattatttttatttgatataaatcatttataccttactgagttgtaaaatagttcaaaggcaataaaaggtgctgagctccgacagaattggaattagatagccaggagggaattattcaaagcagaaattatgaataattttccacaaagcacaactctttctccacatggctagcttctctctctgtatatatatatatttttaatttattttcttacattcattatgtcctttgttctcttctgttatgaagtactttctaacttctgaagttgaatgttattttaattgttttatttttaaattgttcatataaacttaataatttctttatagatattgtgtagaggcgccctgccaattttgataatgtggtattttattttcggtccagttcaagatttttacaatatctattgttctcttcttttaaagcatagattatatagaagcaatttttaaattttcatatatatatgagtttttaaaatgcagttacagatttctaagttgtgttttgaataaagaattaagttgtttgaaatttaataattgcttcatttgcttcagatatttagttttttcaaatattctttgttcaaagaatgcatgtttttgcagtagtgtatttatgttcctattacatcaatttttgcagttgtgcacagcatctgtatcttttctgatattttctttgtgatacatcaatttctgagacagttgcattaaattattttaatagaggttacatatatttgcaaatttcaccttgttggtctgttgaaagctttatatcatttaaaattatgttagttgatgcatacaatttcagaaatgtaatattctttattgttactaatcttttgttttagcctcaagaagtatattacgcctaatgttaatgtagcaaatcaagtaattttggttatttttgtccggcattctttccattcttttactttcaactttcttatgtccttgtttgtatgtgtccagtcatgttagtatgtgtgtctgtgtatgttatagttgtctctctagaaaggaacatgagtagcattaaaaaaattccaaagaaatcttcatattttcactgtggaatttaatctagtacgtggattgtttgtatggatattttggattctattctattacttcttttgtactcattttctgttgcttcagtttcctgtcttgcattcatttagcttgttttcttattccatttttcttttctactaatttagactgtacatcaatttctattttgaatgactactttagaagtgcacactgaacttaaaaatatctaaagccaatcaatgtttgccctatgccaaataatataactgagaacaatttaactaactaaatgctagcttctaagacaccatgacactatgttgagaaaacagagctgagtttatttgctttctgtggtgatggaaaattttacattgacagatttaatagtgaattggaggaagaaaagctaaactagattttgttaatttggagtttggtctaagatgaatttttcagtgtggggacttgattaggactgggcaagaatcaggatataatagtttagaagaagcagaaatagcaaggcaaggattttgaggacaggagttcagtagtattaggtagtaaactattgatgcttcagttgaaggagttaacagttcttttgggaagttcctataatgaacagtaaagttattgtccttggcaagaatctcctggagtctactgaagacaataaaatagataagttactgtaaacagtgaactggggagggtaggtggttttggtccttattgtccaagctggttttggttctcaccacagttactaccactcctgagaatatgtaactgggttttggactgtaattcacaatttcagtcttgttcatgatggcaggaaaaagacaggataaacaaacaaacaaaaaattcagtacctctttaagatatgttgtgggaaccctactataaagtcagctaagaacagttgcccggtgttgtggaagatgctatggttcctttctgtggtatgcctacctcagccgctggcaaggggaaggggaagcagattagcttaaagtgttcgttacatatccccaagacttgctttaggagcccatctgtgctggagcacatgcatggtggttactgtctcatcctgtttggactgctgtaacaaaccataaactgggtggcttataaagcacagaattttatttctcacagttctggatgctgggaaggccaagatcaaggcaccagcagattgtgtatctggcgatggaggaccagcttcctggttcaaagatgactgtcttctctctgtgtcttcccattgttaaatgggtgagggatctcttgtgggcctcttctataagactgctgatcccgttcatgacctaatcatctcccaaataccctaccttcaaataccatcaccttaggggttaggatttcacatatgagttttgcaaggacacaaacattcgaaccataccagtgacctaaacaaatcaccaaagctttaaggaagaagaggagggtgtgttgtagttgtgtaggcaaacatagtgtctgctacagtgctgtggctttaaataagaagtaatctaagtattgaagcatagaaagattagtcataatgaggagatatatgggaatgtaatgtatattgggccttgaagaataggcaagacatcagtagctgactagtacctaatggacactcacgaacagttactgaaaataaaataacaggtgggttacagataaatgagaactacaaatagtgttagactggagatagagaaaataatttgagaacaatgtgtttctctggagcctgagatgccttggaggtgtggtaagtggtgggtgtgtaatggtagagaggatcaaattgtgaagaaccttgactactaagctgagagatttgaacttccctttttaggctatcagaagaaatggttttgttgcagaacagggtcatgtactggtctatattttaggaagagaatgctgatagaagcatgcagagtatgttgaaggagggattgaaggcaatccctccttggagggattttgttatgttttagttggagatattttgttatttctcaaacacaaaactttagaggtatatattttctcagacttagagcttggctaatttttttttttctgcttgatggattaatagaaagcatgttgctctattaccactacttttttctttgttatcggtctgggtaggaatgggaatagggttgcctgtgcacttgtgtgcaaagaaaacctttaaatcgtcccagtgctttttatttgaaagatatattatcttttgccccagagcacaagctgtgggagaaacaaaatgaccaatttcaatattattgacattataaacatttatactgaagacaaaccaaagaataacttagagtgttaaatgtccattctgttatagaagagatggcctttctcttttttcttcgtgttgaacagggaaattttacatgggacctgagaagaggagacaccaatattgcatcagatctagaaataatcataccattctgctagagatatgccataataaaataagtttcctgaataggtaaaggcttacattgaaacatatagggattcatacaaggaagtgttaatttaagactcttttatcaaatgaccacagatagttagctagtgtattagtccattctcatggtgctatagtgaactgcctgaggccaggtgtggtggctcatgcctgtaatcctagcactttgggagaccaagataggtggctcaccagaggtcaggagattgagaccagcttggccagtttggtaaaaccctgtctctaccaaaaaaagaaaatgagctgggcatggtggcacgtgcttgtaatctcagttacttgggaggctgaagtgggagaattgcttgaacctgggaggtggaggttgcagtgagccaagattgtgccactgcactccagcctgggtgacagagttagatcctgtcaaaaattaaaaaaaaaaaaaaaaactgcctgagactgggtaatttgtaaaggaaaaaggtttaatttactcagttccacagggctggagaggcttcaggaaacttacaatcatggtggaaggggaagcaaacacatccttcttcacatgtcagcaggaaggagaagtgctgagcaaaagaaggagaagccccttataaaaccatcagatcttgtgataacccactcactatcatgagaacagcatgagggcaaccacccccatgatccaattacctcccatccggtcactcccatgacgtgtggggattatgggaactacaattcaagatgtgatttgggtgaggacacagccaaattatatcattcctccccagcccccctcccaaatctcatgtcctcacatttcaaaacacagtcatcactttccaacagtcccccaaaatcttaactctttcaagtattaacccaaaagtccaagtccaaagtctcatttgagacaaggcaagtcccttctgcctatgagcctgtaaaatcaaaagcaagttagttacttcctagatacaatgggggtacaggcattgattaaatacacccattccaaatgggagaaattggcttaaacataggggctatagcatgtaacatgtaatataacatgtaagtccaaaatcccgtggggcagtcaaatcgtaaagttccaaaatgaacccctttgagtccatgtctcactttccgatcatgctgatgcaagacgtgaactcgcatggccttgggcagctctgcccctgtggctttgcagggtacagccccactctcagctgctctcaaaggctagcattgagtttctgtggcttttccaggtgcacagtgcaagctgttgatggacctacaattctggggtctggaggacagtggccctcttctcacagctccactaggcagtgccccagtggggactttctgtaggggattcaactccacatttcccttctgcattgccctagcaaaggttctccatgagggctccacccctgcaggagacttctgcctggagataccagtgtttccatagatcctctaaagtctaagtggagattcccaaacctcaattcttgttttctgtgcacccacaggaccaacactacatagaagctaccaaggcttggggcttacactctctaaagcaacagcctgagctgtacctttaccccttttagccatggctggagctgctgggattcagggcactaagtccctaggctgcacacagcatggagaccctgggcctgacccataaaaccatttttccctcctaggcctccatgcctgtgatgggagggctgctgcgaaggtctgtgacattccctggagacatttttcccattgtcttggtgattagcatttggctccttgttacttatgcaaattgctgtagctggcttgaatttctcttcagaaagtaggtttttcttttctactgcattgtcaggctgcaaattttccaaactcttatgctctgtcacctcttgaatgctttgctgcttagaaatgttttccaccagatactctacataatctctctcaagttcaaagttccacacatctctagggcaggagcaaaaaaccgccagtctctttcctaaagtatagcaagagtgacctttaatccagttcccaacaagttccttatctccatctgagaccacctctgcctcgacctcattgtgcatatcactatcaacattttggtcaaagccgttcaacaagtctttaagaatttccacactttcccaaatcttcctgtcttctgagccctccaagtctcgaggaagtttcaaactttcccatattttcctgtcttcttctgatccctccaaatggttccagtttctgcctgttacccagttccgaaattggttccacatatttgggtatctttacagcagcaccccactactcccagtaccaatttactgtattagtccattctcacgcggctgtaaagaactgcccaagactgggtaatttataaaggaaagaagtttaattggctcacagttcagcagggctggggaggactcaggaaacttacaatcatggtggaaggggaagcaaacacatccttcttcacatgggggcaggaagaagtgcctagcaaaaggggaaaaagccccttataaaagcatcagatcttgtgagaactcactatcacaagaacagcatgagggtaactgccccatgttgggagaaaagctgagtgttgggagagaagctgaggcagggcttgcatatctgacataatgtaaaagagtcttggaacatgtctggggtccagggtctaaaacctcttgtggcctttggaatgtgtctagacttgctggctccttgcttctagcactgccattatctcaagtagccatatgtttcaaagaaaatgttaaaccgtcacagctttagctcagtcgcttaatacaccgcttcctttcaacccccacatcctcaccatctgtttctttgtttgatcaccaataaatagcatgggcttccagagctcagggccttcgcagcttccatactagcattggccccctggtcccactttatctcttaacttgtcttttctcattcctttgactcctccggactttgtagcccccatggcctggtgttgggtctgatcaccccaacagccccagtgattcaattaccttccacctgttccctctcacaacatatggagattatgggaactaaaattcaggatgatatttgggtgggaacacagccaaatcatatcagcaagtgattgtaactagtaaaaaaggaaatgtttagattatgatactgaagattttaggcatagactttatttagtatctaaaatgatgccatcaaatctcttttggtatttttctctgcctctgttgatttctctgttgatttttctctgcctgtatagatttgcattctactagttgacttcattctctatcaggctgtcctcataagatagcagagaaagtcatgaaagtgtcaaggtatttagcacttaaatgatctttgaaagagacaaaaagttttccgcaaaagctctaggaagaattgtgattggcctggtttggaccaagtatccatatgtgagccaattgccatagcaggaactaggaatatgtgttcctctgattggcaagatttgggttacatgcccaccctgagagccaactgttgtcctatgattggtggagaaatggcccctgaaagcaaaacattcctttttctttaggaggaggaagaggtgctggtggtacaaaaataaccatctctgctattggtgcttaggacagataagcattgacaggcagctttcaaatttagttactgtttttactacgcgcacttctggacacagaataaagttctctttagagtgaagattttgccaatgccctttccagcaactcttttgaatgtagttagcccagtggcataatttatagctttgttgtcctttgactctgtagcaattacttttgtaacttaaaaaaaaaaaatcattcccaagagggcttaaaatagagggtggggatctgaccaagtctgagatcaagggattctgctcttggctaatgagatgttttggttttatattttgaaatgttcaaaatcaacattccaagtagagaaagaaagtgtcctgtaactcccaacctcctgtctggctcaaccactgtctcactaaccctttacctattttcctgcctcttatcctctcctcttctattgtcaacacctccctctcttctctagctttctttctctagcttgtctgtttgatattgcacaaagatcacttccttgcatcaattagaagagtttatgctctatgagcatttgggggattttggaatgccattttttgtgtcatgcccttactttccataattgccttgataccactgaaataatgatgcagtcttttatttgagtcttccagttggcacaatggcttaaatatgaacaatttctagaaccaaagaaatattcatgttactatctggctagctagctagttatctattgtagcatttaccaggaaaaaaaaaagcaatggcaatagaacacaaattagcattattgttattattactgagacagagtctcactctgtcaccaggctgccgtgcagtggcacaatctcggctcactgcagcctccaactccctggttcaagggattctcctgcctcagcctcccaagtaggtgggattgcaggcatgtgccaccacgcctagcctagaacactaattattaaaaataaagtacttctaactgtataaatttaaaaatacactgtaataattctgttttggcctttcttgtctcaacctcatcaatgttttgtttagatatacctccagtattgaaatattaatatcatattcctatatgagctttcaaataacattttctgaaattcacctgaccttgttaattcttgacccttggagtactagattctgttcaggttccagctgtctttatggaacagcctcactcctaaagaagccaatctttaaataggctacctcttcaggcttttataatacaggcagattctgacttaaaatttattcctaactgactgattgattgtttttcattgttattttatttcccctctaaggattttgtcacaatgactaaaaaaaaatcttttacaaaaaaaatttattgttttcctatacagtaaagaaaggttaaattaacatttaacaaagtccttccaagttaaatgtaaagcaatttcattgcatttgattcacatgtgaaggtacagaatggaagtaaggacttccttcccaatttcatgtaggtcatacttacaccttcattttcagcagaagaaatgatatgaatattatatcctagtcagtgtttactgtaggtaaggcagcataactgtgagtctcaggaggatgattctttgaaggcagaggcaagtattatcattaaccaaaacttttggaaagaaaaaagaataagggttttcagttggtatatagactatttcttagaaatcaaggagaaagttattagattaaaatatgtaaagaaaaatttatgaaaagatcctcatttaaatgtaacttttttaagttaaatcaaggggaaaaccttaccttaatttagtgcaatgctctaaagcaggatttacatagttgtgagttgcctaccgattcactgaaacttgaatgttggtcatggcagatgctcatatcacccaccccctggcttaagaacaattggtgagacctctttgtattcaccaatattcatgcaaaggtgggaaatgaaggaggagaccagaggttcctgctcctgtggggtaaacttgtcctctgtgaactccagttcagagcactagattatgtcatactcctttttatgtagatatagaaatacggtcttgcctagaatactgtataccttcattaatttttatcaataacatgtttaggttatcagtacaccgaggtttatgttcctgttcccagtaattaaaatcccacaggagactctgaggagagaagattgttcttcatgcatcaaggtaaaatcctgaatgcatttttcagtacacaaagtattgggattactagtttggaaaatgaagagattttctccaggtgccatactgattgcttagattttttggtaggacaaattggcagcatatttacatgagggagttaaactgactggtaaaaacactggcgtgtgatgtttccagttcagttctatcacttactactaggaatatggccctggttaaattactttgcctattttgtcattgtgtgcttaaaatataataggatttttaaaatataatgggattgggttattcttaaaatatagtgagattgggttattgggttaaaagaaaggggttgacttccagatgaagattcaaatcccttctagcactagaagatctggttcccaggattatccacaaatatacagagacactaacatttttttttgccttcatccaagcatataatgtttataaaagctcttttaaaatataaaagtttaaataatatgattcagatttcttaaaatgttgacttatgtatgatccttcggattaaaattcattttcagcttggctgaactaattgacattcccaacaatattgaataggagttcccttttctccgcagcgtctattattttgtgctttttaataattgccagtctgaccgatgtgaggtgattttcattatctcatgattttcatttgcatttctctgatgattagtgatgacattagttttaaatggtaaatgcttaaactgctgataaactctatttgtaatcagtttaagaaaatcaattttctggaaatgtcacttctgtagcagccctctccgaccctatcccacacctcatctaaatgagtaatataacattttacctagtcccattctttcatatttttgagctttgagaatctttttaaaaattaaatataatatggcaaaaattttactgcttaaaaatctatcaagctgttcagttgtgttttttttttgccattttcagactaactatatgactcaagaccatgaaaaattgctcattgcagtggaacccactattcttttgattcaacatgctactgacagttatgaagtagtaaagggctttctattacccataatgcattttgaaacttcagtgcccagagatttttttccccaaaaacagttattcctcttagctgtttcaagaactttgaaaatgtttgaataaattttcaaatctcaagtaagcttttctttctgtctgctgagagacatagatcgtctccccatatggcagctgatttaaccccctactcctttctcaccagaaatctcaccagaaaccccatgcactaacttcaaaaacatcgtctacttcttgacctttctatctgtagctctccatctcagtctgtcactttgaataagcaagctagttcatgatatcaaaatatttgtgtaaatggaaccagtcataatttattgcttctaaaattatttcatgggattgtggtaggcactgtttttgctgaggtattggggttaatctcagtggaaatgaggcctgcattgtatgttatcttagtgtactttgagaaaaaaatgtcaaattgcagcagtttacctactgtttatctggattaagaacatccaaaaaagtgattataatagtttgatatcatgctgcaaattgtgacactcctctttaaaacttagcaagattcagatatttgtttacatgtctcaagatctgtaatatgaggattttcccaagagataaaaatgaaggtccaaaattctattccaagttttctgtgtaatatacaaagaaggaaaaagagaaggtatgaaataaaggagggaagtagagagtaaggaaggaagaaagaagggagggaagaagatacctctcaatgtttcaggccatttgcactgcattcattttctgatgctctcaagttattgagatcctgggtagagaacccaagcaaatagttgttatgtaataaatgctacaatatgttgattcctactatttgccaagccttgaactaggttggttatccacaactctaatctttacagcagtccttcaaggagtaggtatcattattccctattttacaaggaagcttacttacaggctgaaagaggatataaaaattatctaagtttaaagagcaagtaaattgtagagatagtattcacacctttgctctaagatatgctattatataagaataaaattatcactttttctattagctgttaaattatttgctaggcaaaacgaaaaagttactgtctttcctgttcatcataaaactaaataaaaataacaccttgttaaagagtgtaaattattaagtaatgtaagtttaatcacataaacaatttactcttatttgatgattttgacaataaagtatgtggtttacagcacataactccattccaaaactgtttgcaaacaggcatttatgttcctcaaatattttaagattggtgcaaagttaaagtttattctctctgtttcattgtgcagcagttagattatgtgaacatttactttcctatagtcacagacttaatacgtgcttattgaatatccactactaaagaagcctgagttacacagtagaagcattaacatagtctctgcctcagcgaaccttttaactagccggagatatctatgcttgtgaaacaagaaagaaacaaaatcttattaaattaaatgctgtgttgtgaagaataaaacatatttgcaaaaggtagaagtctgaacagaaatgtacagccttgtggaggccatcagcaggcccactgccaagaaacttcaaaagttgatatttgccttcagaaattcaccacttgaatgtggccttttgctgggatgactcaaaatctgatttcaacagtacattaaacagtgatcagtttctcaatgacagatccatatgaaccaaactctcaaaataccaacccgtaagccagaattaaatggattacatttaactgaaaagtataagtagtcccccaggggccagccagtcagaggattggttgcaggactgcccacatacacccaaatccgcatatactatagtccagcagcaggccctgcagaccgacatattggaaaagtcggccctgtatatacatgggttttgcattcctgaaatactgtactttgcaagtttggttgaaaaaattccacataatactggacccacgcagttcaaacgcccgttgttcaggggtcaaccatatactgctagaaatcctggttagttaaagaaaataacggccattgatggtttcgaatgtggtatatgtggcttatataccacttgtgttttaagaaaatggcatgggccaggcatggtggctgacacctataatcccagcactttgggaggcagaggcgggtggatcacgaggtcaggagttcgaggccagcctggccaacatggcgaaaccctgtctctactaaaaatacaaaaattagccaggcatggtggcgggtgcctgtaatcccagctactcaggaggctgaggcaggagaatcgcttgaacccgagaggcggagattgtggtgagccgagatcgtgccattgcactccagcctgggcaacaagagcaagactccatctcaaaaaaaaaaaaaaaaaaaagaaagaaagaaagaaggtggcatgataaaatgaggcctgtttttaaggaagataagccttgaagtggtgtggagaaatagtgcatggagggaggagaagaaagagtattggctatagatgccttatgggagacaactggaataatttctaatattaagttaatgaggaccagtaataatggcatttccatattaagagagaaactagaaaaaaaattttaaaagagaaaactatttgaagtaacagtttataggatggggtgtgtgtaataaatagaccatggaattaaaacccagcaagttgcataaactgtataaactagtgtgccaaatgtatatagcaaatcaaagtgctcactgtgggaatagtgagcatgtgagaagatgaaggatgattgatattataataaggtttgaaaaattgtatctaatttattactcgaaatacagtctagtgtccttgtttttaaaaagccagttacatttttttttcttttttcaagagacagggttggccgggtgtggtagctcacacctgtaatcctagcactttgggaggccgaggtggatggatcacttggtcaggagttggagaccagcctggccaacatgaagaaaccccatctctactaaaaatacaaaaattagctgggcgtggtggcacatccctgtggtcccagctattcaggaggctgaggcaggagaattgctgtaactcgggaggtggaggttgcagtgagtcgagatcatggcactgcactccagcctgcgcgatagagcaaggctccatctcaaaaaaaaaaaaaaaaaaaaaagacagggtctcattatgttgtctaggctggcctcaaactcttgggctcaagggatcctcctgcctcagccacccaactagctaggaataccagcatgtaccactgcacccagctaaatttttagaaaattaggtatacttatatttaatgtgaataaccacaattagagaaaaaaatgttcaagagtacaaatattggttatatggggatatttcaacagcacaagtgtaattttgactagtcgattgcctactctgtgcatatttgtgtatgaacatgtatgttactctattatgtatgtgcgaattcactcctctgtctatccatccatcactcaacagtcatatagtcctctctatgtatggaggaaataccatgctaaatattggggatacaaagattattagatgggcccctggcctctggaaagcattgaatagtaaagggataggcatacaaaaaatataattctaaatagtcatgggtgtggtagggaccatgctgcaaagacattgcaatctctgcctataggactcacagaaggcatctctgaggagtaatatttagctgaaatctgaaggagaagtggaagtgggccaagtgaagtggagaaagttatagtattggtagtaaataacttaattgatcacatttttcaatattgagcatggaatcttttgttttaaagaattgcatgctcgatattttgaaagccaccattagatagtttttaagaatatccaatgaaatgtaccaccgtatgtgcttggaacccattagtcataacttggtgatataaagtacgttcttgacctatgacaggactattattgctggagttgctgtaccaaaaaatgtgatcatatttgccatctggtgaaatatactgtctcgcccaggttgaggtccacaagtgactaaatgaccaaaatgactaaagccctaagtagcccacaattactcagttgcctgtaggtccacatggagaatggaaagttgtgtttcatcagatctctgaactgaaggtcatggtgggggcagggaaaggatgcacagtgctttatcttttattttcctttgtagtttgaggtgcgtaagttctcatatcaaccaaatggaatggtataatgctagtgccatagtgtcacacagttgacaaggtctgaggacatgaagttttttttttttttaatgcaattcctgtcttcaaagagcttatttttagaattgtatttgctgtatattttaagacacttaaatatgtacttttcatattttaattctactttatataaaaatacttataatttttcaacttagtaattgaaatcagagtaagtaaattgctacaaatggccaattgttggacctcagttttgcttatatgtgtaacaattaacacagcttttcagatacatttttgaagtaatgggccctgtttctatttggttctattaaattagtgaagtagtactagtgggaaggttctcacactaccaagtggtttgagactcttgtacttaatttttatttttgttgtctataagattaataaaattgagaagtgatgcacgattgatccttggtgtttgcagagagggatattgaggctcagtgaaataaatgggtagataaaaattctgaatatatgaatataactcacgagataataatagcttttatttaaaagctatcctacctcttctgtcaaggagagaaaaatctaagaaataacatctgtaacaaaagaggaaatgaagtgagtgatataattgaaactgtcaaaaactgccaaattttctggtgacacaagagactatcaaaggatatggtaggaatcctagatattaaagcactttgaaggggtaattttaacaggataaagcaataaataaatagagagcaagaggaaaattttaaagtgagaaaaagaaagtaaaataaacctagggccaaaaaatctctgcctagggatattgcccaggatggtagatttagccaagtgggcactcggcctagaatttcttatttcccttttcatgctacaaaatatgaagtaatagccttagcaggacttattacaatgatgaaatcacctaacaatctgaaatgctgcttccctttatgtgaagatatttgttttgttttgcttcttgagaaatggcagtctgtctttcttcttaattcctcgttcaacaatccatttctgtgaaaaatataatcctgtatattccataaaccccttggcattggaaataagagtgatgatcttagtagatcataagagttagaaagttgttttcctacttttaacatgtgataggaataagattacttctatttctaatttctcaaattctaaatttctcataatagaagttaaattatttttcttttgttcaatatctgaagtttcagaaaatattaatgtctgtacttcactaaatttccattaaatagtttagtttccacagaatcccattctctagtgaagattgattttcttaaaattgctaagtaaactttaattttaaaaaatgtgtatacccactttagctaattctgcctctggagtctgcatttttttggatatttttatgttgtttacagtattccaagtgattgattttattgattggtcatgaatattcttaaagtatatacaagcttacttaggaagtaatatataaatgaaagtgatgtaagtagaattttacctgttctatctgtacgttaaatataccataagagcacacacatgctaattatatttccagaatacaattatatatacatgcatatatatacacacacatatacataattacatatatacatatgtatacacacattatttttataatggtcactgaagaaaagggagaaaaagcaaaaaaccagtcaaaatttctgatagctctttgagtcattcttgtaccttaaattagaaaacagaggtaaatttctttcctagaaatctggaacactaatggagttttcattagataattaaaacctctgccacttattaagcacggtcttgatgccggatctcatctgtcattacttcttgaaactgttctgattggctctgtatctgttaagaagtaaaggacataatctgtatcagaagagtgagatggggcatgtgtcaggtgtatcccaaagtgtgcttttgtgttctaaacggtgaccttttaaagtgtgatttgcgctgcaaaatgtataagaaaaaggattttgtgctgttagaaggcacttgtggtctgcagtagtcagagatctccagagccagagtgctccctcacccgtcagcactttggaagagttttgtgaaagtgacagagtgagaaagaggtattatattatataacatttccggcggaagtagcttcatttgcctcaatgggacgagagcttctcctgatctttggcctgcatgttcggaggagaggccttgcaaagtccaggactccactgtttcacgcatttgctttgcctcttaacactcccatgtgtacatgtgtgttttcttatttcctaatagcaaatctttgaggacctcatcatatactggtgtttatagttggttgccatggattggatattacttgtagaaaattattgtctttggtgataacagtgctgtattgaccttggaaaataataaaattttctggcaaatgtagtaatgggtatgtgtgtgtatgtatgtacgtatgtgggtattgcgtaagcatgtagtctaagctgcatattttttgacataacagcacacatctaactaaatgtgattttgttcttaaacaagaaaaaaaaaactaagatttaaaaaaatggtccacaggaccattggatttagttttttgttttgctgaagaggaacctgaagtctaagccatttttatattgaacacctacttctttagaatcatcagtcatcagtcagcattgaaatgctctgctcatttgcttgcgtttgtcgaagtacaagtgtatcaatctgttattttttttttttttgagatggagtctcactctgtcacccaggctggagtgcagtggcgtgatctcccctcactgcaacctctgcctcccacattcaagcgattctcctgcctcagcctcccgagtagctgggactacaggtgcccgccaccacacccggctaattttttgtatttttagtagagacgaggtttcaccatgttagccaggatggtctcaatctcctgacctcgtgttccgcccaccttggcctcccaaagtgctggaatttcaggcgtgtgccactgtgcccagccaatctgttcttactaaaggcaaattttgaataatgaattatcttggatgaacagaatttttcttaagcttcagagagtatttttccagatgcatttataggaaaccatttcattatagaatagatattcattaaacataaatgcttaaaatacttcaaaaatgctcatatttgggaactgtacctgaaattctctaatatcctaaaaggaacaatatttttatttcactttggtttgttctaaaacaaactcatttttcattttcatggacatcaccaagacctaaatttgtatatataaatgaagaattaaaatggcttatgctgctggtcagctgtttaaatattttcttttaaaatcagggttgaagtcatggtattgctttgataggcctttaatccttttcaaattttattatcatgctacttaaatgtttctctcagctttttataaatccatatctaaagtccatcaccttttgcaaatgtagcaataatacagagcagataaaagttgaaagaatctaacctatagtaaatcctttaaagatgccttgattaattgtaaaatgataaaaatttgactcatcttcaccttaaacagaaaataatttcctttacagtcaccaaaaattacaatggcatggtggctcattcctgtaccccaacactttgagaggccaagctggatggaccacctgaggtcaggagttcaagaccaacctggctaacagggtgaaaccctgtctctactaaaaatacaaaaattagttgggcgaggtggcaggtgcctgtcatcccagctactcacagctactcaggaggctgaggcaggagaatcgcttgaacccgggaggcagaggttgcagtgagccgagatcacaccactgcactccagcctgggcaacgagagtgaaactccatctcaaaaaaaaaaaaaaaaaaaaaaaaaaaaaaaaaaatccaactcaaagctggatatggtggctcatgactgtaatcccagccctttgggaggccaatgtgggaggattgcttgagcccagggtttgagcagcagcctaggcaataaagaccccttctctaaaaaaatttgaaaaattaacctggcctggtagtgtgtacctgtagtcccagctacttgggaggctgaggcaggaggatcccttggggctaggagttaaaggttgcaatgaactatgattgtgctactgcactctaatctagatgacagagtgagactgtcttcaagaaaaaaaaaaaaaagaaaattgcataatcatactaacatgttcctgactttttatagatatgtttaggcaacactgttcagctatacaaagaacataatttagttgagaggaaaacagtgtatcaaagaaggagcagcctatagggtcccttccgacagagagtaaactacaagtttcttatacctggaacactcttgccattgggtaggtgagagaatatatttatagcccttctttcttttcttcttcttcttcttcttcttcttcttcttcttcttcttcttcttcttattattattattattattattattattattattattattatttggagacagggtgttgctctgtcagaaagtctatagtgtggtggtgagatcatggctcactgcagccttgacctcccattctcaagtgatcctcccacctcagcctccccagtagctggtactacaggcaggcatcaccagcctgggaattttttttttttttttggtagaaacggggtttcaccatctttcccaggctattcttgaacttctgagcttaagcagtctgcccaccttggcttcccaaagtactgggattacagacgtgagtcaccacgcctggccttaaatttttatgccctttaagtatgccttgatgtggacattcccatctctatattcctagataccctaaactcagtagttggaatgcatttgaggagggcctacccttttcctgcatctgcctacctcgactgtgttcaaagtagaaggggaaatggcaaaatgataatccatgaggtaaaaattttacttaaatctagatatgttaattttatttcttaaatttagtttctcaaatttctttcaataatgcggtgatttagttgttggcacatgtattaaggcattatgtctatgaactgttacttaattatgactgatttaatagtgactcactctatatatgctctacagacagccacataccacagggcatcacacccagcaggcctaaatattaatgaggtttttataaaactaattacaagaaagtctctcatggagagtacagaaggtggtccctagaagagagaggactatgaatagtgtcctttgtcatggaagccatctctcagttaacattagatgtattagatgcctaaatcttggcattatttcagtaatagtacaatggtatgaggtgatgtttccgtaaaagtgcttatctacacataggtagtagctgactgaagataggtaatcacttatgtcaggaactgatcagtcataggaaagaaatgctgagccaagtaggtgagcactttttatacatgaatgcatttaatcctatgggttacaaaatgcagaaacaaaaattaagtactcaatatttttgctagttgttgatgaatctgtcttctactacagtgaagggagtgttaattatggtaaacgtgtatatatatgtgtgtgtgtatatatgtgtgtatatatatgtgtgtgtatgtatgtatgtgtgtgtatatatgtgtgtatatgtgtgtgtgtgtgtgtgtgtgtatatatatatatatatatatatatatatatatatatatatatgcttacattgttctagacgggttaaattcaggacagttactcccacagataagaagggcaaaaagcctagttttggagcctctttagttgaaattagtgatctttgctcacagtgtagtgcaataggttactaaaacttattcctacagtctaacgaaaactttgtaccctttgatcaacatcttctctttcctcatccattccaactccctctaggctctggtaaccacctttctaatttctgtttctatgagagcaacttttttagatttcacatataaatgagatcatttagtacttgtctttctgtggctggcttattgcaccttgcataatgtcctgttccgttcatgttgtcatgaatgaaacattttcttctttctgaaggctgtatagtattccaatgtttatatatactacactttccttatccatttattcgttgatggacacttaggttgctttaatatcatagttactgtgaatactgctgaaatgaacaaggaagtgcagatatctcttcgacatattgattgcagtggatatatactgagtagtggtattgctgggtcatatggtatttctatttttctctttttgaggaaccttcacagtattttgcacaatggctgtactagtttacattcccaccagcaatgctcacaacatgacattgtaccccataaactcacactattgtatttttcaattaaaattattttttttaaagtagtgatctttgcatgaggagctttgtgatctgctttgccacagaggtgaagtcttccataggttgcatgtattgttgcaataatagcaataataagaagagaacaaaacaaaactatcacttactgagtaacttattgctaggcactatgctaaacactttatatacattctccctctgtttaatcttcacaacagtcttgtgagttaataaatattttccccattttacagataagggtctggatagtttaaattagaattttcacaagtgataatgaatagtcacattttattttatttttatttttaaactcagagacagggtcttgctatgttgtccagatgggtcttgaactcctgaccacaggtgatgtgctcagctccgtctcccaaagtgctaggattacaggcatgagccaccctgtccctggccagtagtgacattttaaactggatgattctttgttctgtcctgtttagctagagaagtatcatgtaatggttaagaatatgagctctgggctgggtgctgtggctcaagcctgtaacctcagcactttgggaggctgaggtgggcagatcacctgaggtcaggagtttgagaccagcctgaccaacacggagaaaccccatctctatgcctgtaatcccagctactcgggaggctgaggcaggagaatcgcttgaacctgggaggcgaaggttgcaaggttgcagtgagccgagatcgcaccatggcactccagcctgggtaacaggagcaaaactccatctcaaaaaaataaataaataaataaaagagaatatgagctctgaagcttagagtaaggtttctgctccaggtctattacccttacctatatgagttttcccttgttacataatctctgcatatgtctaatgtgggtataataacagtaaccagatggggctgtgtttgaagactggatgagttgatatttatgaagtttctggttcataatatgcattacatgttgatttttatgtttattattgtatatgaatattttacaagccttattgtgattttgataaaaataaattcatgcctttttgtcattcagtaatattgtatgtgcttcctcatacagtaatattgtatgtgcttcctcatacagtattcacactttattggttaaatttattactatgcactttttttttttttttttttttgagacagtttcactccgtctcccaggctggagtgcagtggcgcaatctcggctcactgcaagctccgcctcccgggttcacgccattctcctgcctcagcctcccaggtagctgggactacaggcgcccaccaccacgcccggctaattttttgtaattttagtagagatggggtttcaccgtgttagccaggatggtctcgatctcctgaactcgtgatctacccgccttggcctcccaaactgctgggattacaggccactttttaaatttcactatgaaagacatttttatccctgatattcaggttttgtttttctctgtcttaaagaaaaatttttgatatttgtatattggtcctaaattcagtccctttactgaattcccttattagttccagatagattataaaagccagcagttttggaatcatttttgacccctgtcattctctcataccccacactaagttctgtcaaatctaccttaaaagtatatccacattggcagccaggcacggtggctcaagcctataatcccagcactttgggagccaaggcagggggatcagttgaggccgggagctcaagaccagcctggccaacatagagaaaccccgtctctactaaaaatacaaaaaattagccaggccatggtggtgcacacctgtaatcccggctacgccagaggctgaggaaccggaatcgcttgaagccaggaggcagagattgcagtgagccaagatcataccactgcactccagcctgggctacagagcaagaccctgtctcgaaaagataaaataaaataaatatacgtagagagtggtggttcacatctgtaaccccagcatgttgggcggccgaggtgggagtatcacttgagcccaggagtttgaaaccagcctgggcaatatagtgagacccttatctctacaaaaagttaaaaaaaaagaaaaaaaaattcagatgtgatgcctcgcacctgtagtcccagctgcttgggaggctgaggtaggaagaattgcttaagcccaggagatcaaagctgcagtgggctgtaattgcaccactgtactccagcctgtatgacagagtgagacggtttcaaaaaaaattgtatactcacactctctcacacacattcacacacacacacacatacacacacacacacacacacacacatacaacaggcaacattccttgggatgtctcaactttcatactatatatactccaagccatcttgtcccactcctgaattattgccaggctcttctagcctctgtgcttacccgaccacaatctgttctcatgggaatctattattaactaaggatcgtttgtttcttctgtatctattacaactttttatcttattctgttactaaaacagctagagcctttttccaaaatattggaaactaatggtgagaatggccagccctatccttgttctaactttaatgagaattacctttaatttgatccaatatactgcctctagtttctgttgaataatgttttaccttgatttgaaattttatgctattcacagtttacccagtttttatctaagttgttgattttattatattgtttcagtgtttatgagtatgatcatatattttttttctcctcttactattctgaagggtcattcttagttcatcttcatattcatgaactaaagccatactcagtcataaagtattacaggcgtaccttggagatattgttggttaggtaccagatcactgcaataaagcaaatatcacaatacaatcacgtgaatattttggtttctcagtacttataaaactgaagttcacacaatactgtagtctattaagtatgcagtagcattatatcagaaatttgagttctcatctttttgctcacatcctgcctcaatgtggtggctgctgactgatcatggtggtgcttattgaaggtttgagtggctgtggcagtttattaaaataagacaacaatgaactttgacatgttgattgattcttacttccatgaaatatttctctgtagcattaagtgctatttgctagccttttacccacagtagaacttcttttgcaattgtaggtcagttctctcagaccctgctgctgctctatcaactaagtttatggaatattataaatcccttgttgtcatttcaacagtgttcatggcatcttcaccaggaaaaatttcaaccttgagaaaccattttgtttgcccatccataagaagcaactcctcattcattcaatgtttatcatgaaattgcagcaattcagttacctgttcaggttccacttccaattctagttctcttgctatttccaccacctgtgcagttacttcctccatcaaagtcttgaacctgtcagatttatccgtgaagattggaaccagtttcttccaaactcctgttaatgttgatatgttgacctcctcccatgaatcatgaatattgttaatggcatcaagaatggtgaatcctttccagaagattttcagtttactctgcccagattcaccagaggaattactatccatggcagctattaccttgtgaaatatgtttcttacataataagacttaaaactcagaattactccttggcccatggactgcagaatagatattgagttagcaggcatgaaaacataaatctccttgtatgtaaatctccttatacgtacatcttcatcagagctcttgggtgaccaggtggattgcaaatgagcagtaatattttgaaagaatctttttttctgagcagtagtacgtttaaaatatttagtaaaccatgctgtaaacaaatgtgccatcatccaggctttgttgttccattgatacagcataggcagagtagactgagcataattcttaagagccctagcatttttggaatggtaaatgagcattagcttcaacgtaaagtcaccagatgcattagcccctaacaagggagtcagcctgtcctttgaaactttgaagccaggcattgacttttcttctctagctatcaaattactagatgtcatcttcttccaatagaagactgtttgatctacactgaaaatctggtgttttttttagcatatccacctttatcaattatcttagttgatcttctggataacctgctgcagcttctccatcagtacttgctgcttcaccttgcacttttatgttatgaaaatggcttccttcattcaacctcatgaagcaacctctgttagcttccaacttttcttctgtagcttccttacccttcttaaccttcatagaattaaagagagttaggaccttgctctggactaggctttggcttaggaatgctgtggcacatttttttaatttgagcaattatttcaaactttttcattattatgtggcaaggtcctctccctctccttgagcctccttattccctgagatacaagaatattggaacaaggccaattaacgctaaaatggcctctaagagttcaagtgaaagagtcactgtctctcactttaaatcaaaagctagaaagagtgggccaggtgcggtggctcaagcctgtaatcccagcactttgggaggcccaggcgggcggatcacgaggtcaggagatcgagaccatcctggctaacacagtgaaaccccgtctctattaaaaatacaaaaaattagcctggtagtcccagctactcgggaggctgaggcaggagaatggcgtgaacccaggaggcggagcttgcagtgagccaagatcgcgccactgcactccagcctgggcgacagagcgagactccgtctcaaaaaaaaaaaaaaaaaaaaaacagctagaaagaatgacacttagtgaggaaggcatgttgcaccagttagacaagttgtgactgcaaaagaaaagtagttgaaggaagtgatgagcacaactccggtgaagacactaaatgatatgaaggcaaaacagctccattgctgagttaacacaaaatgtgacccaggaacacaaagtgagcacatgctgtcagaaaaaaatggttccaatagacttgcttttcacacagggttgccataaattttcaattgtaaaaaacgcggtatctgtgaagagcaagaaaatgcattgagtgtatatcttttaatcaaattatatttgattacaatttacttgggaatttttgcattttattctatttaagagtgaaattagcttaatttttagtatctagtattgccatttcaaagaactttgatacaagatttagcctagaatttttttttttttttaagacggagtattgctcttgtctccgaggctgaagtgcgttggcgtgatcttggctcactgcaacctccacctcctgggttcaagcaattctcctgcctcagcctcctgagtagctgggattacaggcatccgccaccacgccaggctaatttttgtacttttagtagagatggggtttcaccatgtaggccaggctggtcttgaactcctgacctcaggtgatctgcccaccttggcctcccaaagtgccgggattacaggcatgagccaccacgcccagccctagcctagcattttaaaatttaatggggaggatagctgcgctggtcaaattaaaaattgttcatataaaattggaatgatatgttcttttagagttaaatagaactctcctatgaaactccatgttactgcatcttttttcttaaaagagagagggagacagggtctttccatgttgcccaagctagtcatgctctcctgacctcccaagtaatccttgacagtccttttcatttcttctagagttattagtatcttaactttttctacttttccagtaaatattgatactttgcattttcttagtcatccattttatctaatttttcaggtttaattagcataaagttacataaaatatacttatacttttaaaatatagtcttacttgtgattatatcttcttcctcattgctaattttgtaaattctcgatttattctctctctaaccccttgttgagaatcagctttttgttttaattctgaattttaactttaattttgattatatctcttacagcttttgtctttattaattttcacctgatattttgttttgatttgcttaatttttctagctttgtaagttgacctcatggtttatatatttgtagtttttttttagtaataacatgattttaaatgagtagtttctcaccacataacatttgtaagcatttctcacaagtagaactcttcatggtttcatgagaattacccattcatgtgttgtgagtcctgtgaagcatgcctattggttttacttacacatttccaagtagggttaaaactcttcataaagaatttagagtggctgttaataaatattaccaaattaattaaaataaatctctataaaatttataggcctaaattaccacattgactattcagttttatctgtatggccctaatatttctccagtcgctgaaaaagaccttttggccaatctgaatagagatacagaaattctctgcagttaggccttaaaataaagcagatataattatataggcatattttaaatataataagcaatgtggcttagcacttaagagcatgggctctaaggtttgactcgtgagaatgaagccttcgctttgcagttagttgctggtgtgaccttgttcaagttacttatcttttctatattttgtaactaatagactggatggaggaaaagtgttaatttttatgattgttgtgaggattaaatgagttactatataaaaagtacctaagaaaaaacagtgtctgtcacataggaatcacttagtaaatgtaattattattattttttgaattatttttattataatttaaagcatagataaacaatttgctgttgaagtggtaatctaatacttctatttttgtgtaccagttgcattctgctaaactaaagcataagccaatacacactgtagaatgtttgtcatcttcttaattttattacctttctcaacaagcttagactccagttgacatttgcagggctaggcctttttaaaatccacattcatttgttggcagggtttctttcacactactgacaggtttgataattcatagggtagatttaattgacagggttttagttagcatgaactagaaacagcctgttttgcaggcttggtttatttttgctgaaagaagctgagtgtctgacaattatgtttactaatgaattcatttctttggtatactccttaaaattctcaggagtaagaaagacgtcctcatggcctcacagttttctaattcccacatgagaacgaaaattttgtctacaacaccagacttgtttgttaaacataaaagaacgtaaatcctccacaggtccccaggggtgtgttagagaaagggagtgatcattataaaccacttagccctgtatgctctgtatcatgttgccatgagaaagtgatgtttgattggctcataaaataggtttagtaaatcctttaaatactgacgtggccaattgtgcacattggaaattaatacctgagagtgtattataaggattaccatgtctccagagcagtcacctgggcatgtgtagatttctgaatttaaggatgactgtgttttgtgatttcacttttatgtgtcaatattgcttagttttatcatcctcttttcatttggctatggcccacagatacatttttcatcattgttttctctcttcattctcttcttgatgtttgggctatgttagcatatatcagccaaccaacctttgctgtgaatcccatattctgcaaatggtgttgtgtcagaaaataagaaaaatatcaagttgttaaagcagacgacctgatttaatgcattattctttttctatcctcactatgcattcccaaaccagttgaaaggaaatatggaatgaagtgacaacggggtgtgtgtgtgtgtgtgtgtgtgtgtgtgtgtgtgtgtgtgtgtaaaaaattatttcattaataactttaaattccatagatgtcttaatagttattgtgtgtgacgataaaaattaatggtagaataattgcatgaatttggaattatatatttttgtatgacacgagttctgagaaaatcttgaaatgcctaatttattatgaaactattagtagcatatgctaagttctactgttttatagacaacacagtaccttattagatgtttgtttcacttaaactttatggagaacaaaactatatagatttttcaaagcactgtcataaatatatgcactagacttgcatgagcatgtaagaattagttgccagctgtctcgctgcaaatccagaaattttcataaggattattttccaaatggcatcaaattcagttggaaatcttcatgaaataagtaataatatgctcatcacccttctcctatttacaggacagtggattttgtatcgacataaatcagagaaggcaaaagttaagatatttttgtttcttaataaagtgttaacattttaatctagatatttttgtgtcgttaaagccctttttaaaatacttttaaagaagttacagatcatataacatatgaggtagtttatttttaaacagaaataaaaagaaaataatatatagtaaagtagctatttgagttgttaattttagacttcctgaagagaatattcttttctctttaggatgctttttttattaggaagattaaaatggttattttgaaaaatggtctcaagaaaattttgtacacaatgtgttctgctgaagcagtgtattgaaatgacttcatcctggccaaatccaatgatactttttagttttcacctctttgatctttctttggcacttggcattattgaccactcctgcttcaggtgaaattctctcttctctgttaccttaacgtctgcaccttccctcacagtggcttccctcttatttccctgactgctccttctcaggatgcttttgttaaaggatcttttctattgacccacacttgaaatgttactgtttcctcgaattcctcgaacatgtggtgattacctgtctgtgttactcccctctatgaagcctccagcggctctgcctcttaagtgcaagggtggccaactcagatgccaaagagcaaatataagtaaatgaagataatctggattttttttttaaatcatagaaagtagatagagatttttaaaaactagaaagagcatgcctcatgtgaagcatttttcatttagtcccagcctcagttgctatgaaggccaagtattcattccttcactcaccaaatactgacacagcgtttactatgtgcctggggtgtaggtgctcaggataagacagtaaagtaagcaaagatatctcctttgctggagctgacacgaattctggagatgagccctcgtggagtcacccaaagctaatgatatttattattaccagatcttcaattttttaaaagccgaacatccaggttttctatgaaattccattttttaaaacgttgacaaattttttaaagagacatcgagcccattggaatgtgcctacatgttttcaacattggcctaccaaataatccaatgtcttattaccatgcaataccaagacctcacctgcatctatttgtccaccatgatctccatctgatttttgtttcccaccctcagttcacaatggaccatgcttagcgctttctttcttctttacatcttatgtattgtacttcttgctagaatgcattttcatcccccacccctttcaccccttgtcagtcaatactctgaaagcccaagtgtcaagtcctttgtaagctgaccttcatctcactgtataaaattacactctttcttctactattccacagtatttcttacatactctaattagagcacttaccaatgtgttttatggacccagaacccaaaaaaagctttagttatgtgtttgtatcctgagaatctagcagagcagtttgcgccaaatcagtgtttcataaatccctgtcgaatgagtggtggtaacctgcatcacacaggctcacctcccaagcacagaacaaacagatccttatgaatagaaactttgtttcatgtgtagacaaccctgatgtaaaaattaccattcgataaaaatgatgattatcaacgtttctgccaaatagatctgaaatatctacttaggtctgctatacccaccatccccgaaccacacacatacactgcctaacccttccacatcccgcacacacatacactaaaactcctggaatggttatactggctggcttatgtatatgtaacttataaccctggacttctcatgtgatatagcaaaatcatatctcctctttgtctttgtgttttcttatttactgcttttaagcttccaaggttatgttaaaaagtaggtgtgcagaggttggaggggtgcaggacagagatgggagacaaactttcttgagtggcagctctgtgcaaacaatgttttaggtgctgcacatgtgctgtcccatttttcctttcttcaaatgtctctgagttaggtagcattattcccagtttaccagtgaggaaaatgaagctgaagtagtttaagttccatgccttaagagagttttggatacttcagatttataagtataattgtttcattatacactttgtcttttttcagcaactttttctttcatatgtttaatgttacgtaaaatgtagtatttttggtagtctggtatctactgaatttaaaattttgaaaaaaatctatcagtggtttacaaccatgtcagacttcgttttaacaaaagttttgcaatgccctgcttagtattctgaaatgcaattcatagaagcagttatctgtttacatgtgaaattgttttaaaaataaatatattgtctgcatgttatataaatctattaaaatagcaaagtaatttatattaaaataatctgtttcaatatataaatgaacagtaacaattaccctagaaaaataaagggaaaatgttagcatcttttaagtcgactcattgcgaatgtaacagctataaatatagactaataagaatatgtttgttttagttgggatgaaaatggtatatctagtattcctgttagtgacatgtttttccaagtgagtaactcttggttaagtttaaaacaaaacacagaaaattccctcaatttactctatagttgacgttatttaaaatttatcttaactaaaacagtgcaaaacatatatgcgtttatacatgagatgatgtaagatgatgtttatagttagatgaactgtagtagaatttgcacctgcatgaaatgtccagtgaaatatttgaaaggcatggaggacatggggcaaatactcattttcagaactttccattgttgggcattcgtggaccttgcctgctacatttcaatcactcccttctcacccccaattattgagacaacctaaaatgttcccacagatttgtgaaacagtctgtcatggggcaataatggtctcagtgaacaccactgatccaaaccttccaaaccaaaagttgacatgtgtttaaaacaatcatttattcctctgtttaagatactgtgtatagtgaaatgtaaaatagaaatatgtacgaactggttcctttcttcaaggattaacagcctaagaagatggatcacttatacacatatatggttagttagaaatatgtgtttatcaaaacgagaaagatgacagtgagctgagaacacccaggaaggtcacagaaaggaagaacagtaccaagtgaagtgcgaaagatgcgtatacaatgaagtgactctaggaaagcttgcatcacagatgaggaaagagccaaggcccctggccaggatgaaagagttactctcagaaaataaagggcagtaataataggaattaagagtggagtcacactgtcatgtccaaatgaaaattatattcaataattcatgaatcgaatgtcagatagggttgctccttacaaaatgtttaagttttaggatggttatttaatgaatttggaattcgtaaacagaaaaactaaggactccaaagagactcatagttcttcaactgggccctcattttcagttgtgtctcttctttagaattcttaattatatgttcccggttaaattttggattaactcactgctgtggtccgtagagtcatagcacccacagacatgaaacttgtaattgccagaataacagattatgaaatgatgtctctttccctttgtctttttgcaggtatgattttgtagaagttgaggaacccagtgatggaactatattagggcgctggtgtggttctggtactgtaccaggaaaacagatttctaaaggaaatcaaattaggataagatttgtatctgatgaatattttccttctgaaccagggttctgcatccactacaacattgtcatgccagtaagtaccactttcagatccccttatttaattggatcagctttttgtttctttttatttttctcctcttacacatgagaatcagaaaaaaaatcagaaaacaaacctagctgggatttcatttttatgtaaataaaaactcttacatgccaagccagcaattcattaggcaaattagaaaatatgaaatcagtatttaccattttatatcatattcatgtgtattgttaagcagaaatttccctgtttgattgctcaggagtctatgaaatattatctagacaactgattaaataaaggaaatttaagtattggttaagggtatagctaaaaagaagcaatacaatgcaaactgaattttgaaaatgacaatttattcatttagtaataatagaatcatttatcatgtatgattgaagttaaaggagaaatctctgaagtatgttataaatgttataaattgtgtatgttataaattgtgaattttgatcagttttattatgtagcttatttaagatatcccaaactctactccattctgaaatactttttgccagtatatattctgttccattttctttgttcctttccaaaactttttaaagtttaatataatactttaatatttttaaatttatttaataaaatgtaacaattctacctgtaaatgaaaaatgttaatgatagacaaagatgtacatttttattaataggcaatagtttaatactgattatttgcttgattaaagccactaagaatctgtttagtatacttttacagtatcttgtttcacagaacttagtgagtttaatattttttaggctagggtggcgttgagggccatggatacactttcacaaagtgaaatatttctcaaatatttaaatatgggatatattaattgtagtaaaaaacatactagcaggtctttgtgagagcaaaggttttattcatcccaaacatgtgacaaaataaactttaaattaaggatattatttatattttaaatgaacttctgtctatattatattaatttaaatgtgtataaatagcaatctactgtcctcctatagaataaaacacaaaagctaacgtataaatatcactactgaaggtttttttttctgattttgtgactacatagattatctggttgtataacccaaggagttatatggattaaatcaaatatgtaatgataaaagcatactatatgtatgtattacacatatacatagtagacatagtatatgtatggtatttatagcagctagctcagttctgagcacataatagtctctcaataaatacttgaatgctgagttgatcatgcaattcagtcacccagcttaactaatacaggattcactgtatatgtgtgaaagttgtcagattcataagacttgtgatgaagtaagaacccaaaggttgattgaaagtgccatccatcctcttggctaagaaaagtcctgtcaccagggttgacctattatcagagatttactgtgactgagaccagacaccacatctgggagactttaggccaaatgtatgtcattggttccattattgaaattaaattgaccacatttttaaatgattgtttaatcatttaacaatgattggtaaattgtcaatatggacttcaatgggctattgtcaactctcctggactctattgagccaggctttgtgtggcaactacattgacctattctgggctgtagataatggagacatgtggggagtaaaggcataggagttcttgtaattaaactatgtttaggaaaacaataggcttttggactggaagaaacaggagagaatgaaggtagtgtcctacattgcctaataagtgtaagttggtgattttcatttttaagattgctttctggagaaattatatgaattttacaatctcacaagctttgttttttctgtgtttaaatttacgttgacaattaacctgccatttcttcagccgtcctttgtcttggttccatatatccattcatctctctacttacagccacattcattctactcttaataaactgtctgcagaagggtgagatctgatgagttagaatttgacaagtggttatgctgttaagccttgcagaatgttttgaattatcattgtgtactcctaaattacacccctccctccatgcaccccctccaccccccacactttgctaacagggtgcaatccatcaatcttatctgtgtaacagattaatgaaagcctaaagcaagaaagtgtgcctcctggacagcagacttaaaagttcttgaggcctttgctcaggggcaagggtccctccaagcccctggatcatctctgatgcttttatttttctctttttgctctggatgaacttcatgtcagcacactctgttccccagaggcaacggtctcattgattagaaacctacctctgcaaaattccactttagattccactggccacaatgatttctttgtaatagtaaaaataatattaactactagtttatagtagacaattaactttctgcattgaggtttgtcaggagtgcctagcacaatgccattcacattgtagctgctcattaagatttcatagaaattcagccatttcatcttagagttgtccaaaacccacagggagctatactaccttcctatttattatatgtcacctttgttcctctcacacaacagagataattcataaaccggaacgcagtagactcacaggaatgacaccagatattctgctgtcctaatatattacgctatattaccaaagacacattcttgcattagctaaataattgccctggttttctttttaggggaggcagtgaggagtgggaattagtgggacatccactgaagttaaagaattgagtgcatactaatgattttataaacattagtatatacagttaacattatctacttttcataatcaacccaatgaatattttgcatgcattactatacagaaaaaattttaagtgagtttaatcacatttttttctaggacaaattatgggttaagtttattttaaaattctttatatttcacaggtaaagagataaccctgtagccttctttgggactataaatggatatcgggttctggtcaacagttaagactccttggttctgattaccatgtgtcttagaggcagagttttaatacattagttaaaattttcagaaacagtttttgccacacaagttgccattaaaaattatgttctcccttgtaagatgatttacccactctttttttcctcagtttatgaataacagagcatatagttaaataagagatgacttgttcatttgaataaagtgatgctgttctaatatttaaagattttacatatttattataaatatcagtactttcctttacaatattgggatttccatatcattttcttgattcacaggtaccttacaataagacataattaaaatttctctctccattttttcatttggtgttataaactaaacctagttttagaaataactttagcatatgttatttacttgaggttatagctagttatagctttttaaaacagtagtactagaattgctacataattttaaaattacagcatttcaatgatattttagagaattatttatagaaatattattctccagtcatgctccattaataactaataaaaaataaatttctgcaaattgatgccaaatgatacatacagtgttcaacttttatgattgtgcctaaggagttaatgtctttgatttttttccctttctgctaaaagagaaaaaaaaaaaagacctggtagattagcagtgagagattgtttgggaagaaatgaagcaaaactgaaataaaacagtgcaagcttgtttctgtttggaggccacacacggtgagagcccagaacacatttcagatcttttagaaagaaaggaaaatttcttgtttaattttggagtaatttataatagattatatatgttttactctgtgtactgtagcataagcaccattatttaaaatgataagaaacctaaaaaggctgaaataataacttttgctccagaatcaaaagactttattaaaagttttatttctcagttctaaaagtaaaaagtactgcatattttttggtcagaaaactgcttcaattaaaccatacctatttttaagtaaaatatacaaatctaaatctgaatttttaaagttattttagtcttatatttagaactattcttcttgagtacagtgctatttgttgtttttttaatgtctgtgagatttgaagattttcttattctccctccaatttggttaacattatgaaaaatgattaccactgatttttcttaaatggttttaatgaatattatatttttcagtctcttagtctaaggtttctgatccaaagtaatgataatgtttacaataatttatttacttttttccatttaatgagtatatcagtttatattaagagaattagaagttatagccaccatacaaattgagtcaatgtatatttaccctctttttctttgcctgataagctgggcagggggtggatgaactgaagagtactttaactcacaacacttcagtgaacttcatcttcctttaagttgccgcctgatttgttctatcacttctatgattttacattttaaaaaactatgtataatcagtgatacttgtttgaatatacaagtgaatcttgtttattcttgttattaaattatatacaaagattaataatatagtatagtatgtaagtattatagccacattataacccccactgtgtgtttttcttaatggtgattttgtaaatgacttatccagagttcagacggcgtactggccagcatgccctgtggaagggtgtagggtttctgtggggaggggttagaaggacacttgatgcctgaggtgctattaaggaatgcatgactgattgccaaagtggttattaattatgcaggatatggtgaacaaagcagcacagtgaatattgaagtgagagggggaaaagaggagggaggatattttttttcatcccttctgacatatgccagtaggttatttcactgttaatatcatgtcaagaaaagtcttaactgaaagccaaatttgcttttatgttcaggttaagaaaaactccaaccaactctcaaacaaggcttcaaatatattaattcactttctttcctaggaaaaaaagcagcatgcctggaataaaaatacttagagcaatataataacaccaatcctacaggaaaaacattagtggtgggatgtactcaagattttttaaaatgttaaattttcataacttattgcattgcattcccctattgttaaaccaattctaataagtcgacatttatttgaaaacttacttaaaaatagatttgtatttacctcgagaattaagagaaaatttgatgcttagaatttttttgtatttagagactggaagaggtatttcaagtactatttatctacactgtagtctgaagcacttgttgaatgattagatttttattaaaatatacaatatacttgtatatttatgcaaggagtcttgagatgacagtattttattgcagctaggaaattatataattgctatagagactaaactcttacttggctaagaattgcttaatatatttttcaattccacttctccatgggcacaatgctctctttcatatgacgatcatggtgtctctgtttcatttctactgattccttttgttccaattaatttcttgctaagaaaaaatttcacagatgctatgatttgtagttagaaagaaaaacgcaattagcactatgtaggaatggtaaatggcagacagattattgtaagtcattttataagagtgttgtaaataaaatcgtagattaattgaaaccttgaggtttgattgattcatattttatagctaaagccacaaagatttaaaagcttggagttaaaatggcaacctcacaactctttccatctaaacctgatggaaggagttgttttctagaaataaatatggtgcaagttaaaattataaattaaatagtttttcttcaatattcctacccattcaataccctaaatcccttaattatcagatatttgttgagaagattcaaagatgtatataatatctcccttggtctctgataacttatctcgttttggaggaaaaaaatacctataaaaatgcagtatgtgagtgtcatgttgagtggtttggaaagattttgagaaggaagatgggaatgtggagagcagagggatgtcataacccttagattaaagaaaaaaatcaataagcaatcaaacaaaaagtccaggagctattcagtataaattttttctcaaatgtgttataaaaatctctcaagagcatattaaaaatgcttgttaccagattagtcagagatcctcattttcttggtctggggtgatactcaattatctgtgttttcatcagatatgcttggagattcagttgctctaaactatagtttgatcagaatacgattacttttttttaacttgccaacattagcagttatttatttatttgtttatttatttatttttacaattacttttatttcaagattttggtgaatttttttatattcaaacaaatgaattttatatgaatagattagaaactctgcacacatgtttaatacatgtgtatttttcagggttacaaaaagagtgggactttcccataaaattaggtagatatctttcagtttctagcacttgtatttattgtaccaactcttccaagcattatattaaagactatcaattttgtcaacggtcagtgtctgttacccacagaactatgaaagattgtcctctgctgccttttctgttcaacactaaacttgtttggtaattcacagatgacatagttccagcattgaagcacagttctggaatagatattcattcattctacaatgttagatactgttagtaaaataagacatttccagttgtcaagaaatattctttcattttctatatacattttttacatttaattttaattttgtcagttaattttgcacctgtttctaaatggcaaatatttctcttacatttgttacaaaaatagcagttcataccactttccccttcctaaatgatttttctgccctttgtaggcaggcacttccaattttttgaaataactcttttgaatttacctctacgactctatttaacatgcttttatatctacttcttcactcttttacaaattacctatcgatttctcactggaagataaagccatctttcactttctgtcaccctcctgcctttaccacacatacagatatttcccagcaccccatcctctattatatcttgattatatcaaatccaaattcattgtgtacattatggtggctctgtagtcatttttcacagctgagccttgaactatataccatgactacatttccgtttctgttctttttatgtttcccttagaattattttttggcttgtttagcttttatattcatcactgattcatcctgaaactgttcctcagattgtgtaaatctcctctcagtacactcagacacatttggttttctaataatttcatcttcttcaagaaatctttgctgcaatcatctggcctgctccaatgtggactgcttgccctttagaatggctgcacaaaccgtcatccttgcagtctccttctgccatcatcctgagtattccttttgacgttttcttgcattagatcctctgtttgctggatcttttgtcttcctgtgtctcaatttacttccttgtttgcgaagagagtaaaacttccatgaatatactgagaaaatggagcatcagagataaaatttttgcagccttgcataacttaaaatgctctaagtattaaccctcaaacttaaatgaattctgattaagtctagaatttaagctggccacttaaaagttgattggacattctgtgcctgtggatgggcttgcccactattgtcttcactgtactgcgtgctggcttagtcagtttcttcaaaacactctgattcctctcatctcttttctaagagtataaatactggttaccaatgttctgaactaggagctgagttgattaacactgagatatttggcattgtatatatctaatatatatgttttgtgtatgtaaaatgtatatgtgtgtgtgtgtgtgtgtgtgtgtgtgtatgtgtgtgtatgtttctactctaccttctccataccctcaactctgcttgggttttccacagaacgaatctgaactgtcttctgccaagaggaaagcagatttggggtatctggcaatttcattaacagatttttagtcattcttttattgttcctttatgtatatttaattgcttcttgtctatgcccctgccaaattttgcaaagcccaccaatccaatgacgacacatccaactcctttttagttttcagaattttattgctgttgactcctttctgactttctttggccttaagggtgtaagccaaaaagtatgtgagactgatctcaatcaatttagaagtttatgttgccaaagttaacgatatacccagaagaaaacaacacagaatcatcaaaacagtctgtggcccatgcctttctccaacgatgaatttgagggcttcagtatttaaaggggaaaggtgggctagaggggaaagagggagtatatagtaaccacatgttgcaagaaaaaaggggcaggtaggaaaatagacaattatgtatttgtctcgggctcactaatttggctttttgtgtaacataaggtgaacatagagtagctagctacctgtgaagatatttaaccttttatctgtcgctgtctacttaggaacaaaaggaaaagcagtgtcttgtatgactgaggtttcagcttaattttttgcttttagcataatgaattggggttctgagtttttattttcctttcacaagtgattatgcattttacagacacctttagaattaataatttcaggagagaacagagccacaattaccatttttgcattctttctttattagtggaattcatatattgatgtgcatattaaagattgactttatatttgattaataaaatattcaaaacactgcagaagtatattaaggacatagtatgtgccaagtgccatgctctataaatggcttccaaggaagaactctccatttccctcccatgccagataaaataacccctagtaggagacgctttgcatgattatcctaatattgtgtttactttttatatgcaagaaaggcatatgtagaggttggtactgtcaccctccagggggctctttttgtcaagtgcccagatacagctgatttatcaagacaggggaattgcaatggagatagagtttaatgcacatagagccagctaaacaggaggctggagctttattattactcaaatcagcctccccaaaattcagaggctagggtttttcaaggatagtttggcaggcaagggaatgggtgctgctgactggctatggatgcagtcataggggcatggaaatcggtccttttaccctgactctgcttctgggtgggggccacaggacctgttaagagtctgagtggagctattggtcatcagaaatgcaaacgtctggaaggacatccaaaagaccaatcttaagttctacaatagtgatgctatctgcaagagtaactggggaagttgcaaatattttgaccttgggaataatggctcataatcctttacttctacaccttaacaaagttcaggcttctctcatcctcctaacctcatagtgtttcattcattttacagtgacagttgagtttggggaaaggtgtattaaaacttaagctgtaaactaaatttctcccaaagttagctttgtctaggaatgactaagggcagtttggaagttaaaggcaagatgagggttgattaaatcagagccctttcactgtcataatcttctcacagttacaatttttgtagacagtttcaatattgatgagctatttagcatgtcttgaactctgttataacattaatgtaatgtctagttgtatccactaggatgccaaccctgcttcattcataataacgtggcaagtgtcaccaaatgacttaccatatgatccacacatttgagaaaatgctactctcatcagtattctcataaataatcaacaatttgcctattttagtaatgctgttaatatatttaaatgctttgaacattaaaactagagcttttaaaattttacatatctctctaattcagatgatataattgtatttttatttacttaatattactttgaaatcacatgaatctgattttgtatataactttccatttttatgtcctctgataatcttagaacaaagctaaaagataagtatgattagtgttatatatttctaaagatgttaattttgaaaggctcatatattttaagcttttggaaagaaaatgcttaattgtatcaatttgaaaatacttgagtcaggcaaaagagaatgaacatagattaaaataagtgtgccttatggtggttttaaaaaatatattatttaatccccatattgaaatattactaccattttgtagattaaaactcaacatatatagagtgaagagagttctctttaaaatcagactgcctcttgactggtttggaaaataggagaaagatcattgagaaagaaacaaaaatttaagatctcttctgaccatttttgttttcctattaaaacacctgtatgctattcctgttgattatgatgtcatggatactttggtaactttgaaaaaatggtgaactaattagaatttaccaattttttttagtagtgacaatggtgataaatattgagggttaaactgtagtgtctccacacggtaatctataaaattcaaatccaaacaagaagcttttttaaaaaaatgtcacctggagtctaagaaaaagtaaaaatatgaatgcagtcaatatttttcttatcagtcatatttcatcaatattagcaaaattacccagttccatgatgtatcttagcaatcttgtcagtgccaaatttttcagaactgtattcttatagaaccttgtaaggctaaaatttagctaagaaataggagaataaaattggaaagcaagtatttctagtgaataggctgtcttctattaaacacctcagaatgtgtcactctggtatgcaaaagactcagagcatttttagtttgaaattatgcaatctgtgcacagtatttgaaatataggcactcctacagtaagtttggaggagaaaacacaaatctaaggactaatacaatttttttttcggctttttgcaatgtgaccacatgtaggccaccaaaggcctcagaaaactgaggggggaatttccaagatgtctttgtgtcttggccccagggcaaaggtcctgtgtctgcatagatgttaccactctagttaagtcaggttttgtgtaagtgtgaataaaagccattatggaaatacctggctgatgcctttccttgtgcttcttcaccacaagtaattattcaggcaagagatcaaggctgtcatctcttgctttaaaggagtacatgaattatcttaggttcttccaaggcagattgcttaagaaagctaaagtttatactaaaaattttgttttatgggaaaataataggaaagacattgaggtagcaattatctaagactctaacataaaatctgaggtaggcattggacataaacgtaggaggctccaaatcagcccaggcagcttccaatacctcctctgaaattgggtttttaaatttgtgtagcattgctaaagaggaagtgcctttttttccagtggaataacattctgatagagttgaattttaaaagggcacttttctgctgggtacaagttaatgaaatagcattaagtgtaattagtttttttagagaaagaaatatgcaagcactgaattgttagagagacagagaaacactgcatgccaaaacttgactttcaatacctgagtgaggaggtattaaaatatatgacacatcctttggatgagattcttgagaagccatctcaagctttctgacaccaatattttcctttctttttggaatatgatgagtgatgttttgtggtatcctaatcctattactgataaaagtaatatgaagaactctcacttctacccaggcctacagtgttttgttttgtgttaaagtcaggggaattctaataggattcccaattacgtaaaagaggttcacttgccattcactgtttcctctaccttgctacagtctttatttggcattaagagcaatggcataatttcatgtcactgagcaatttgcagattttaactctctgaaaggtcatagaggcttttggtgtgatcttagaccttgctgttgtgatgccctttgcatctgatttttacttctcttaaatgaggtttagcctaaagctgcctctttaaggtttttgttgttgttgttttgtttttgttttgttttgttttgtttttgtgacggagtctcgctctgtcgcccaagctggagtgcagtgttgcaatctcggctcactgcaaccttcgcctcccgtgttcaagtgattctcctgcctcagcctcccgagtagccgggattacaggcgcccgccaccatgcctggctaatttttttgtatttttggtagagacagggttttaccatgttggccgggctggtctcgaattcctgacctcaagtgatccacccacctgggcctccctaaatgctagaattactggcgtgaggcaccgcgcctggtctcctcaagtattttaatgtcggtctaaaggtttcttcttacataatgaactgtaacctaactagatgtgtaaacagactgtaatctactcttgtaaggagtagcccagtctcagccaatcacagcagccgtacttcaaccgctcgcaggtgaccaactccaagcttgtccaacccatggctcgcgggccccatgtggcccaggacggctttcaatgccgtctaacacaaacttggaaacttccttaaaacattatgagattttatttttgtgattttactttatttcattattgtagctcatcagctatcgttggtgtttattgtatttaatgtgtggcccaagaaagttcttcttcttccagtgtgggacagggaagccaaaagatttgacatccctggaactttaaaccatgttcaaatgcagagctgtgaccaatccagctgtttctgtacctcacttctgttttttgcgtatcactttcctttttctgtctttaaattctgtcagatcacctgacagtgctggagttgctctgaacctattctggttgaagtggggtgtgggcgaggggtgagtgtgctccttaattcacaagtatttttttgctcaattaagctctgttaaatttaattgtctgaagtttttcttttttttttcttttttttttttagactgattgtcgctctgtcgcacagggtggagtgcagtggcgcgatctctgctcactgtaagctctgcctcccaggttcatgccattctcctgcctcagcctcccaagtagctgggactacaggcagccgccaccactcctagctaatcttttcgtatttttagtagagatggggtttcaccgtgttagccaagatggtctcaatctcctcacctcatgatccgctctgctcggcctctcaaagtgctgggattacaggcgtgagccaccacacctggcatttttcttttaatactttcttctttgtcttgcaaggttgtagcaaattgtgactttgcttaaagtaagcattcatttgacttagagttatatgtaattttctataagtttatattaagttgatttaaaaaaccaacagcctatccatagtaataatgatagtatgcatcatttctcgaatacttactattatattgggttcctgctgtaagtcatctcatttattcttttcagtaactctatgctaaatcatcaccattttgcctaaaaggaagtacactcagagaatacagcttggctgaggttcagagaaaataaatgggaaaaattatagtgaaatccataatttcaactacagcacaatgcctcccaaccaatattgcttgaaaagaacttacttaagttttattttgagataattgtaaattgacaccttttgtaaaaaaaaaaaaaaaaaaaaaaaaatacaaagtggtcctgtatactgtccgcctaattttccccaaggataacatcttgcatgaatatataatagtataccacaacctggaaacagacattgatacttggtacaattcaccaaactcaataggaaattatgaataaataaaaatataaaacactatgggggtactaaataaaaatattatataaaaagatatcatttataagttaaaaaatgtttgattagtgcatagttttaaaaatggctcaatcaagagtatcaagaaggagggtataattttgtatcactaaatggctttagaatattaacttgggtaaggaggaaaactttttttctgaagtaggtgattttataatctttatctaaaactctgcagtgtggtgcagaaccatcattgcagcttggagcacaacatctatcatagattaaagattacaaagtcaaaaataataccacaaatcactcctcttgatgtgggattcagagtaaacgtgtgaaacataaatagtcactataaataaatccatgaatgaggctctgctgcctccacgacagagattaatgaagttttaggatactaagagctcaagatataatctacagctttaaactgatgtcaagattcagaactgattgctttaaaagcccttcatttttctagaaaagattgatgactgtagtgcagctaaatctctcccatgcaaaatttatgtaatttggttccaacaggtatcttatatggtagttttacatattaaatttaactatacaatatgtaaaagttaaactgttttcaaagcagtccacattaacacatgatattttcaaagtatttcttaattttagaattcattggaagtctgctcatgaacatatttggggtttgtagctggaccattagttaacttgagtagttcaggtggagaatcataaaaattatgtacatattggtaaacatttaattttaattttaccactcatcatttagggcctgtactttttttttaaacagggatttgccaactggagttgtgttgtatttcttccaaaaattatagccacaatgcctcaattatgactttcagtttggttttctttgagttaaattgaaaacttaaagataccttttaatgcaatctaagctcagaaatcctccatgattttatgaggctttccttcctgtatttcacagttatctctctcatacctgacttaacagcagttttttatagtaactcattttatatggagtccttccaaggcattcgtctaaattttcaaagaagcaataactcatatttaattgggttacataatatttgaataacttagtaattaaaacaacaggtgctagtgatataaatacttttgggaacaaatacaagtgtctcttggtaagtgtaagatttaactgctggaaacagaaaggatgccagtaagcagtagtgttcagtgagttgtcagtgtcaacagtcagtatgcttcacatgcataggagaagtggttaaaccaggtcagcgatggcaatagctgctgtcctttgtcctttgttctgtttccatcttgatactgcatgatatgtcattggaaaatcgtaaattaaatgcatgcggtcaatagagaggtgattggtaacgtgtcttggtatatatatatccaagtagctagtaatatgcttgacaaaatgttgatatttaatatatttttgttctcttccatgatttttttctataattagcttcactagttttcaagctatttttctatgtagttgcaggcttctttgagtttgaaggagtgagtgttctactagaatgataccctttaatagaattccagatgaaggtatataaatagatatttttatcttattaataaaaagcaaaaggtcttgtaaaaaatattactcaccaaagtaaaggaaaagcagagtttccttttcttcctgtcttccttcctccctcccttcttttttcttccttcttctctttcattcttatttttctttctcttcttaaatgcttccctatcttaagctacttcttggtttgtgttactttgaaagctaatatttcaaaattttgtccagatttccctactctaatgcttctttaggaaagaggcaaacttttttgtttttaaattcttctgtaagttaaaacaactccttagttaaaatcacacattctattttctaatatataccatgctcttccaatatagagcatgtcctgatttaaggagaaagatggttgaatgtgtaagctgtaagcagctaagctgcttcagctttcccagtgtgtcagcaacgccagggctatgaaaagatcaagctgaagaaacacggtttaaagttatctcaggtttattttccttacaagctgccataatccacacatagtgcgcagtcaaaggtgctggaataggacaatgttttatgatacaaattatatcatccatgttaacagtagtacttactcttctaagaccttggatgctactaaggtattagtagctcctcagttactgaccttaaccaagatcctttactgaatctcactgcaagggtgttgtgttcttataaccttgagtgcttcacatttggcttgaattcccatcctaccatgaatctacctatataaacctgggcagtttttttttttaatccaaaaatgtgaatgacaaaaatttctgccatatattatcatgaggattactatgaaatgcttagcccagtgtttagcatgtggtagtcaacaagtatgtgttacctttgttttaaggtcaggtttattgacatgttctgattccaggccactgcccccctgattggtatttaaaaaatttttttgcccaagaccccactataaggacaaattttaaagtgtgatcatgtatacacacacatataacattttaaagtgttttatatatatatatatatatatatatatatgcacataattcatatgtattataaaatagtacttaaccttactatatgaaattgtttttttttctcaagaatgctggtcacaatgcactaaattgatttcacaactccactaaacatgtcacaacgtgagtttgaaaagtcttagattataaaagatgtatcatttgtacatgaaagagtatgctctttggtcattttacgtccctttctgggaaaagattgtataataacactaaaatatgtaaagattaattcttatagtccccaaaattgatattaaaaatagtttccattataacctgctacatctaaaatggactttagaaaatctagattttaaagtcttctatcaacatttgactccttttaagaatttgtgcttgatgatagcttttcagaattttactgtttaatgaagataggaactatttattgaatgtctacttgtattctatgatattaaaatagacagcttgttgaagttatgccctgtggttgagtttgcttcccccttatttgaagaactcatcaatctctagtacaggaatttcaggttcaattagtagtttctgattcaacactccagagtccatctgtcccctgtaactgtttggtgccaatggcaatatgcggaggtgaaggtgagggtttccttcataccctctggaaatctttaagttttcagggaaacaaaagaagaggcaagagtgatgacttatggatggctgtctcattgtagtgcttataaaatgcaggtgtgtgaaatttgttctctgcattataattggaaatgcagattaaaggttttggaaaccacagttattcattgtttagataggtctgtagacttcctgaactatgcacactacgtggaattggcctttagtggtatttgctttgtgtattaatggcatttctgcctgaagataatggcatttctgcctgaagatagtgtatttttggtagaaataacttgtcattcaattgaaacattttgcttgtgagatgctggagtttcaaaatatttatctgctcatgtatgcacacctgtttccctgcttttctgttttctgatcttgacacgtttgtttttgtttttaaaaatgtgctctgtgattttttgtggaatgtgacttttacattctaactcaattccaaattggctcaagtgtcccaccaatacactacttgtttaattcatattatgaataaattatattgacagttgtcttttccttcatatatttggattgtacctccagtggaacctgtattttttacacttttatccaaattgtatattatatagatattagtatttatttaatcactttcctaaccactcacccaccagattcagtgtgctacttttgaatttagaacattaagaatttcagttcactggtcacatttgttttaagcagacaaagatcctaggcgttttccttggaccttgggattgacagaaattttttacagatgttaaccatggtgaaattgctttttaaatatccctgttgatctctttgaataataaacgggaggatttcattagatatatcaaagtttccaggctttcccgaaatatatttgaaagttcatggccaaatggagattaggttttcaggccaatcctaggcaaggtgttaacattgctgttaccacactcatatgtattactcagtgaagacatgtttttaatatgttttaagatttgtctttgtaatgcatctttgtaaggttaccacaactaatgtattttattactcttagggaaatttcagtgtggtacgtgggatgctaaataattaaagctaaatagttaacatgtaggaaacaaaataaatacatataattttgttttaaaatttaaatatgtaaaatctatgtttgcactgctttgtatttagcagatattcccccagttaatgtgtgaatcagttctttgaaattcaagctttatcttaaataattcttctttattaggtcatttcagtgcattctttacattatttcctctttttttttttaaactgtcctaaagctgttgttactatatgcttgattaaaagaaaatttatttttgaggttctctgagcttggatattttaaagcatgtcagactcaacataatcatttctgagtttccacgttagtaataaatacacgataagctggatatcaacaataataattgtactcttttacaggaatgatggcaattcatccaaatgtcttgagatcagagcctgtcttaacctttgtattttcactttatagtggggtacctaggacatagtaagcactcttaaaattttaagtgaatgaatggatgatagatccatctttccttggtgttctggtggcagagacaaatgttcctgtgacagcaagcagcacaaggtcattaagtagtactggctgggaaaatgccaggctttgcattgtattgtggtaaaccaaattcctgaagcccaaagccagagagccgcagccctaagctccatatgaatgttgatcctaggaaaaatccctggtggtttgcctgaggaatcattggcaccttcaagatgtgaaattgatgccaatgtaggatgtaaaatgcaaaagccaggcaggaaaaaagattcagatcatgtggagtaataaaaaacatccaagttcctaccctgtgccagaggaacttaatttattggcttgccccgttctcagtatggcatcacaatagctgtacctaatttgtattgtgcctttcatgttacagaatatttcacatgcacaaacatgtttagtgaataattaggatgaaaaaatctcaataaataattggtataagttttggagttcacatcttgaggttaatatttttgttgagaaaaattgggatggatagaatttgcaatagacatacattgtttgctgatgatcaatttagggggaagattgtcttgtgttgttaatatttaaacatgtttattctatccaaattcataaagtttcaacatttggagaaacctttaaattgtttttgcttatcttccatctgattcacaatctcctttcctcccaaacaaaatgactttgtgaccatggcataaaatataagaattcattgtctcttagctcttaagtccattccatttttaactaatattgttttcagaaagttctttcctgtattaaacaaaaatctttcttctttcaacttcctctcacaggtccttatctttcctttgaagctacttgcaataattttatgaccttcaccattgctaataatgcatgcttattatgttttaagatacaattatgtgcattattttatttgagctgcaaaacaacccattaaattagatagcttatgtgttattatctgtcttacagatacatacactaaaatacagagaaaataaataattggccagtgatcacactcataaaatgataaatggtgaatccagggcctgtgcccaggtcttctgatttaaaattccatgttcttgccatgatactatgtttcctcaaagtattctttcttttttttttttttttttttttgagatggagactcactctgtcatccaggctggagtaccgtggcatgatctcggctcactgcaagctccgcctcccgggttcacgccattctcctgcctcagcctcctgagtatctggaactacaggcacccgtcaccatgcctggctaacttttttgtatttttattagagatgtggtttcaccgtgttagccaggatggtctcgatctcctgacctcatgatccgcctgcctcggcctcccgaagtgctgggattgcaggtgtgagccactgcacccggccagtattctttctaatttttagtgatgtctcataaagtctttacttcttcagattatatatcctcagcttctttagtttctcgattttgtcagccacttctcaagtgacctgattttcaataaaagcagctagatgatgagtgctagttggtgtgtgtgtgcatgtgtgtgcacacgtgcagatcttgagaaaagttcatagacttctggctggtatttataaaatattttgtagttacacccagtctttgaatgcccccgtacacacagcttattttttgtttagctgagtctatcatcttaagtaaaattttatgtattttcataaacaaatttgtacatcatgtgccttctcagaggcaaagagttttcaagtgaagaattataggcctaactctttattttctatgttactattttgtcaaaccagaaaaatgtattttttctaggcagctgtttaagaatcataagtttttctgtctgcactccgtatttgattagagggaaaacctcacatcttaccaacttcattcattctggctagcacagaaaataaatgttttcagattgtagcagtggattcaataaaacaaaagtatttccagtgttcacttagaaactgctttgtccagtagatacaggattataccaggatctaaatatcagaggaagaggttacccttgtgtcaacaattatataattctatactcaaaacccaagaacaaactaaccacttcctaaattatgaatagcagtagcacaagctgaaaccacagttgatcagtgcatataaaaccagttttcctagtacttgtatataattattttcataatattttgcacaaaataatcagaagtcagaaaatatttctgcatcagtgaataaggaagacatttagcaagataaattcttttaaagtaaccatttctgaaaaatggttttaaaaacggcattgtatttgttgcatgagcattcatattaaccaacttaaatagtcctctttaaaactgatttctcagaaactctactgcttacactgaatgtttcaagtcccttgaagctaatactttgaaccaaataccctttctttgaggctaattggttagaagatgattaaaattcggatttgaatttcaccagttttccacattgaataagaagcagcattgaattcattgtgaagacagccaattgctcagttcaagtaaggatttttggccctgctaagtttctgatactgaaatttaactttttaattattataaacttttatcaacttgtcttcaaaaatttctaaaataccgactcatgaatttaatctctcttagccaagttcttaaagggccttagtaacaaaagttgccgttgatcttggtagcttttcggggttctggagattctctgtggacacctaggcattcttccttcagctttcctgtgtatttgtctttctttgctctcaatgtgttctgtgtgtgtttttttttctcctatcactgcagcatttgcttagtttgacttcttatcggtgagactccttgtccgagattattggccagcacacttgatttaagaacgctctggaaatactcagccacagaattatgcccccacaccatgaatgttgtccatgaatgaaatgctgttgtcattctctagacctgttttagagtcatatgttctgtagtgctactgtccagacattcggcatcttctttgtctatcttctctactcctctcctagactgttaccttacattttccctctcctcaagcctctggcattatttctcccatcctcactcttagatggtaattttttttctctgtcacaaggagattacaagcaatcagaaaaggacttctgaacactttcctcacgctacttacctgcatgtctcactggccctcagcaactgactttcctcccagtgaccctaggcgaacattgtttgtcttccttactccatctcattcatctcttgaccactcaagtgtgcctcctgcactcttctctctctctcctcctccttcttcttttttccattggccattctattggttcattaccctcagcacatcaataaggctattacttctcccatctttaaaggaatatgtgcttctcctgatcccacatcgtcatccagctaccacgcatgttgtctcctctcttctcagcaactgctcacgacagttatgttgcattcactgccctctttttattctcttctaaactcatgctcatcatattttttgcctcatcatttgtcagaatcgcacttggtactccatgatgacgtattgctaaattcagtggaaaatcctcaatcctcctcttatcagacctatcatcagtggttgacacaactgattattcacttcttttcactgaacactttgacactggtatccagatcagcactctctccctgttttccacctatctctctggccactcctcagtcctcttcactggttcctccttctctctctctcaactggaattatgacaatgtttctagattcagtcccctttttaatagagatcactttataaccatggcacctcttcctaataacattcatttgacaatcttgtccagtctcatgacttttagtaatatccataaacctctggatctcaaatttatgtatctagcccatgtaacctagaatcttctcttgaatacccacacacctctcaatctttccatttggattattgaaactacttctaagtggcctccctgttgctaccattgccttcctgcattctattttcagcacagcagtgagtgtgatccttttaaacataaggcagatgatataactcatttccttgaaactctccaatagctcccaactacagttgccaaagtgaacaaatgaaaacacaggattgcctagttttatatgtgaatttcagctaaacaatgaatgattttataattttggggccatacttatactaaaagattatttattgtttatctgaaattcaaatgtaactgggcatcctctgttttatctggcagctctactccccagtcacccagagtaaattgctaatcctcaccgtgacctacagtgtccccttgtagtcctattatctccaacctttggtccagccacagcgtcccctccttgtcattccttgagttgaatttacctaacatacttccaaacagattatttgccctgatattccatattcatgggataatcttcctcacatagccccacgacttcaagcgtcaactccttaaggttttgcttgcacgtcagcttctcacagaggccttgcctgtcattcttgtcttcttcctgctttactttttacttcttcctgcttttacttttttcctgcaatacactttaccatctaacattgtatgtgcattatttatgttgtgcatggtctgtttttctccaatagaatatgtattacataaaggcagagatatttacttcttttgttcactgcttgatcctcagcacctagaagagtgtctggctcgtattagttgctcagtatgtatttattgcaaatgaatatatattacataaatggtgacaagatagataatcaagagcctattagtgtggttatgaatgatcatattatgttgattagggtaatggtgattagtttcacagtaccgtatctgaaatcagctgaagcaatgaaagttttagggaaataaagatgatttcagagcattgtacacttagggcaaagcgatacagaatagaggggcagggtaaagaacaaggcaaagaaaagaatgtaggaagatattttttcaattgaccttgaactttgtgggaagatattgatcaactgacctagaactttattaaatctcactgtgactttgcacctcctgagtattctagccctgcccaatgtagacattagattctacatggaaaaaaatgtgcattattttaatagtcccgtaagttgatcctagttgatagaattttaccttttgtaactgcatgaatgttacactttgaagagtcggtcatctctcacctgtactgacaatgctgttcagtcacccctttatctgatgctggctgctccctttccagactgttgtgcacccagtagattccttgcatatcagattgagaactgatggatctacttttagaagtttattaaacttagggccgggcacagtggctcacatccgtaatcccagcactttgggaggctgaggctggcagatcacctgaggtcaggagctcgagactagcctggccaacatggtgaaaccccatctttaaaaaatacaaaatacaaagtgcaaaaattagccaggtgtggtggcggacccctgtaatcacagctacttggcagcctgaggcagaagaatcccttgaaccctggaggcagaggttgcagtgagccaagattgcgccactgtactccacacaccagcctgaatgacagagtgagactccgtctcaaaaaaaaattcagaacagtaagatcttagcctgggtgtccttagtctctgcctatgcagaatgtgaatcatcctgtttgctttatagtttatatcacagtggcaatcatatccctgagctgttagggatcaaagtttctacattgttctcatgtacactaaaaattattgagaataaaatggaccactgtacatacataaagtgtaatcatttatttaacagccttccaattatgaacatttgttttaaattttatttttaattttctctattaataatgctacaatgactatccttggattatacttctgattatttccttaagataaaaattctgaatatggaattacaggatctgaaaaaatggacacttttaagactgcttgtggaaaatattgttgaattgtcttacagaaatactttgacattttagtcttctttacagttcatgagaaaaatatttttgccccgtcttgatctacaattgacattaactctcctctgtcttctgatttcttttattcattggccttcttttctaattgcaaatatacacgtatttctgtacttattatattaagcttttttctaatctttcttctcataaatctatgattctttcttatttttttctccctgccaaacttaatgaaaaagttctacttgctttctccatttcactgctttttaacggccccctttcttcctttcttacttcgatgaaacttctctattcctaaggtcacagaacaccacctgtggaatagctacagtggcctacttttactcctctttcttgttgatctttccattactttgatgttattctccctcttctactcctcaaaactctcttctccttgggaggaaaaatcactaagacctccaggctctcttcccgacccttagattgatctattttgagacaccagtgctggttgatccagtgccttggccattggtctaagtatggggaaatcccattttcctgtcttctatcctcttttcttttcatgtgtgctcttagctcatggctttaacatttgacatttgtatatgttaatgattatctttctctattccaagtgagtcctctatatttaatgccacaaaaatgtttgcagttgtctgctggatatatgcgtgtcaatacacctccacttattataaattgacccaacctgaacttttccttctttcttaccaattttgcctgtattacatagttatgtcactgttaatgcattccctgaagctagaatcatttaaaattaagcatatctcttctctccctgattccccatcccaccagctaccaatcctgttggttctaccatggtcatgtactttgccacccttcttttcatttgttttcctcaatggtggtaatcaatcagatcataaagcatactctttttagcacttcattaatattctgtcagatcctgaatactattggagatcaaaatatccaaaagacatcaagatttggccccaccatgaaagaacttcgaggcaagtaggagggacacgtacaacaatttcaatttgatgtagtgctagacatatgaacagaatggtggatcacaaaggtcgaccagcttagaggtagtcgtgtatatatagagagaggtctcactagtggaagcctcctggagaagctgagtctttattagtgggtagtgattagccatgtgacaaggcaataaaagcagttattattaacaaagggcaacatcaggagcaaaggttcagatgccaaagccttgttcatggctcccaccagagtctgcacacccccttctcccaacccaaggcacctcctcacctaaaatagaagtagaaagccagaaaaattaaacttgtatgtatcccaccttccttaacatctcttttgactcttgtactgctttgtgattaaatccagattccatagcatggcacacacaaagccttcccaatcagaccccaattcattcctgcagcctcaccttccaccatctactctccccctaatagcaatgctttgtcacagtcttcatctttttcttcacccaacaccatttttttccaactcagtttctttgtaaatatctaaagtgcttctcccttctaatctatataataattactttctaattctctaagctctagattaactttgatctcttctttgtatcacctccttaattctctaggcagaattaatcacactcacagcacttgggtttttacttccgttatagtcattacctaaaggacacaggtttttccatcaagagatacgaacctcacaatggctatattattcatattcttcatttgttgtgagcacgtgacaggagtataatatagtctactgaatgatttaactttttatctaaccctgttttcagagccatatcttgcttgtatcaatagaagaagccttttcaggtgtgtttgaggtgaccgtaccaacttttcacaaaaatattctatgttctctgttgcccctggtgatcgttttgacctgcccagaattctgaccgtgagacacaatctcattttagtgtggtgaccgacatgtaaaaacatgaccaaagaacatataactgtttatgcttttattttttgaaagtgttcagatctgtgcatgagtactaaagattttatggcagaatagggatgtcacagagtgatttaaaaatgtaaaaaaaatgcccaaacacttcacaaaataattatcatttatatttttctccattgttgaaataggaacggcatgctaactagttactttacagaagtttcttttaatgtaacaccgtacactgtaattaagataccagtgacatggtgggcctcagagttgaaatcctgcattttgcataggattttttgttggtttcatttcatataaagattttataggcaaagaatatgaattcagaaaaccgacataggataagtgagcagccaagggtatcattatgcttattttttaagttctttagcacagaggtattcgtagccataaagattaatttgctgatgtgtaatgcccatttctccctccagaacaactactgaatataaatctgttttagaagagaaagaagtctgtttcagaattttccttgtagggttggacaagctctgatttgccacatcagtctagaaagaatgttgggtggagatgtcattgaacgctgcctaatgaggtcatgccactccatgtaacacagaccaacatcaatcatgagctatattttttaaaataattatttatctttgctaaacttggtacaacttgggtaattaaatatataataaaaatgtgtatgataatccctaaatatgtatagtgctgaattgtttattaaatttttaaaatatgctattttgcttaatccttataccagttttcctaggtaggtggaatcatccctcctttgaatacctgttcctacagacacacacataaatgaggtgttcaccatgtaattttgacaaacgccccattttctatggctggtaggtatgcctcccctaccctgaagaagagagtactgtttgcattgtcagcagtaggagagttagtgagtgccttctgacaggataaaatgtacctgggagggatgaatggcaggttgcaggaggcatactgcattaaccgaggcttgtgaaatctgtacaaagcccttccattgagttccactgtgaataatctatagaatgtttaaaataaaggccattttttaagtttgaaatttaaaagcaggatatttttctagaaaagtaattggtatttttactaatactctattgaccatttgttgtagaatgtgtaaatttctgttatttaattcagacaacaatggcaaaggcattgtttaacagggagaccagttagaagactgtttcacatgttggcctgaattgtaaagtggcagcaatggaagtagggaaaatggtcagattccagacatagtatgaagattgagccaagataacttgatgtgggatatggagtgtagcacagaaaagagaggagcaaagtacgactgcaaattacggaattggcatttactgaaatggtaataatgtgttgataagaaataggaattttctggtagtccgcgtataaatgatatgcaatgctttgaaactatagaagatcaccaaggggaagcatgtagacagaaactagaaaaggtccaagcagagatccttgggacactccagcatgtaaaaagaaggtgataaggaggaaccagcactcagagctaaggagaagcatcttgttaggtaaaagaaaatctgcagagcacagtgtgtgaaaagccactttcacacactgattggtcagttagtaagactgaaaaaacagaccattggattcagccatgtgggggggtcattgctgacctttgcatacattctaatggcttcccctgaattagctcatttttcccctcaaagcagttcactgggggatttttctgttgccctctcagtttcagctacttaacactctttttatactgtcaagacattttaaagtaaataactctgtacccttatttcttactccaaagtaaggccttccactcaaggcacatacaaagctagaatgaagttgagtgtattatccaactatttaacttattgaacatataattgacaatgtctaccaatatagccactattcctgagctagatttccacaaaacattccacgatttcccttaatggtggttgagtgatacattgaataaatattgtactgtaggataaatttctgtaagaaagtgtcttcaaagattttgggtttgaggtatatattctttcatgttttgcagtgaaggtgtgtttttcttccaatagttcttagtttacattttctttcattggaagttcatcactgttaggcgttatcttgagtattataacaaagcaaatccacaagtattcaatataagattaggaaaaaaattcctgcgatactttgttgtcaaacacttgccactgatagacgttattttagcttttaaggcctgtcacattgtttattcagaggaattgtttttcaaattttagtaaaaaaaaaaaaaaaaaaaaaccttaattttggcttcccacagatgccattgtggaaagcattcttagtactatgttatttagtcatcccatggaattctagttttccacattgattattacttataacccgcagtttgacctaggaagtgggaaactgtgtattgactctgactcaccagccaacaatgagcctgctctgtggtggagttgacttctgtggagaccttcaaatctaaagtgcttgcactagggtgaatttttttctttagtttgtagaccaccagtgctttaggtgagaaggtgttgagagtaacagtgttttagtttgtaaatctggttagatagtaatggttctccagtttcatgatgacgggaaaagtgagtccgtagcagttgtttcatctatcaagttggtaagaaggtctacttagtaaataaacattacttttatttaagacaacactttgggcaaaattagccatctcttttttcatatatccattcttctcaggaagacttctgctctccggggtttttctgaaaccatgaaactcatggcctttgaaggccagttgcaggtttgagccttaaaatgtattgcttttaaatgctggctcatacgcttttcatactggactgttgctgtgatgggttatatagatatgtcaagttttattcaattgtcatgctctttgaataagaacccctcaattttaagccttgatgtgaatataattggccaccttccctaggatttctcacttaaatatataatctgcattactcacaccatattaaaacatctgttcttgagtaggaatgcaagcatttgcttttcattgccggcttaaaaataatttaaaaacatgacccagataactttttgaatgaattcggataagaacatagggaaaggcaaagaagcgtgtttaaatgaattgtttcaggacattcttgtgtctttacagaacctcccgtgagttgttcctggcaggcatttgtgtctgcatgccctgtctgctgcttaggctctttaaaagtaagacctctgtacaatatatcagtttgacattacataaatgagattggagacacctttaagaagtgatgttacccaaggctggacatttattgtcttctcttaaacacctgatcattttataatattgttttatttttaactccgacaataaaacctaatctgcattcctaaccttttgttaggtatgaatgaattgaaaactttatcagtttgaagtgtactatatgcagttgactgggaaagttgcaacataaatctttgtaggccctaatagttttgcaacagttgctatgctactcaaggtaaacatttatatgtgtgtatttgtccaaggaagattcattttaagtgtgtttttaaaattgcactggccacaaaaatcctaataaaatgacaagctatggttttttagaggtaagtaatgactgattgtgaaattataagtagttcagatagtactattccaaacaggaagtcagcttttcttttttctaaaaaaggggaaagatgttaacaagtgcagaaaatatttaaggtagccataataaaatacaaaacagtaaaacactgatttttgaaaagaacagtggaaaagtcaataagaaaacttaacttttgcagccaaacttgctgtcttgagcttgttcctatggctatgattttgtctgaactcctgggctgccagttatttttcattaataaaaatagaaatatatttgtttttcagtaattcttacatactaagttcactttttttctggtccacattcaccaggatttgtgtgatacttgtttggttacttgtgtgattcataatagcagattctcgttttggcaagagaaaactctcttctatgatgcagtatacttggcttctcacaaaggcaagcattttctcttgttttgttaatagtgctcacctcacaggtttttacttttgttcatttgccttattttttatttttttattttttattttttgaggcagagtctcactttatcacccaggctggagtgccatggcccagtcttggctcattgcaacctccgcctcctgggttcaagtgattcttgtccctcagcctcccaagtagctgggattataagcgtggccaacatgcctggctaattttttgtatttttagtagagatggggtttcactatgttggccaggctggtcttgaacttctaaacctcaagtgatccacccgccttggcttcgggaagtgctgggattacaggtgtgagccactgcacctgtgtgagcccttacaggtttttaaataaatgcttgttgaatgattgaacagacatggtgtaatattatcctttgtttgctcctataatagttaagtggagaagttgatggcatgtattagcattctagggctgccttaacaaaataccacagacttaaacagtggtgccttaaacaatggaaacttgttttctcaaaattttggttgctagaaattgagatcagggtgtcagtaggtttggtttcttctgacacctctctcctatacttgtagatgttcattttcttcctgtgtcttcagatggtcttccctctctactatgtctatgttaaaatgttctcttactataagaacaccaatcatgttagattagggtccaccctagttaccttattttactgatctctttaaagaccctgtctccaaatacaggcattctgagatactgtgagtaggactttagtagaatagaaattttgagtgaactctaattcagcccataatacaacgtgtgtctatattcatttaaacatttttggtatcagttttctaagcacggacttgtttccttcagatttttaggaccatactgcttctatttataagccagacatgcctttctaggatatttgatgtcttaaagagcagggtaaacttcatgtactctcaaaattttatatatatatgtaaatgtagaattatcccacagttgtaccacagggcagtgtttcccaaaactcactcatctgctaaaacaacaaggagagttaaaagaaaaaaaaaatagagttcagtcccattatagacttactaagttgtttattatatttttgaagctctcaagataattttgctgaagctgtattggaccctcttgtatctgataattaagtagaatttttacatgtaaaagctggcaagaaacttgaaggtcattgaatatagctaccatattttgtagtggaggaaactgaggcacagattgattatgcagtttagtcaaactctcttccctacatgtgagtatctctgggatttagagtccagttccttaactcctgatcgtagttctctcattatcatgttgtcattcagagtaactttcatcagagaattttaaagacccgattttgcataggatccttatctcatggagctgacatcttagaaatgtactctttggcaggacacttcatcacatagattgtagatgcttttctgctctttgacaacctgtccttacaaagtaataggcctaaaagggtctaggctagggccacaccctcaccaagcttgtcattactgccctgcaggtgataacacagaagcttttctctggctgaataagggttttggtttagttgtctacattgcagaacaccaagaaactctgcttccggtttgtgtccattgctatccactaaattgtcttagcacaacctatagcttaaaagtacaccatcatatttttatgaagaataaaagacataaacaggaaatgtgaaaatccaagtcaaggcgtattttgcatattctaaccagtttaacagcccaatcataagtgtttttaaatatcaaaagtattgttagaattttctagatactaattatgggagaaaatgctattagtctgtaatgaacagtgttactttgttagagagaaaagtaaaacttaaaaattcaaagacatttttttttctgtaacttctttttttcattgctcccccctttctctctgagagtccctttaaacaacttagaaaagcagaactttgaaactgaacaactcggctctttcttgaaccagtgggtggagggacagtcatgagaaggcccttaaatagaagcaccacttcccctgttctgtccagggattgattctttgaatcctgggaacttatgttcattcttctttcctgttttctgggtggggaccactgtgtgtggggtgtggtggggaaagagttgtctttctaaatttatcaaattttaatttaaatatttagaagcttagagatttgtaacaccaactgatctatacatacagtaacagaagatgcttttctcccaacctttcacatttgaagggatgggtatgcagattgcagatacttcactggacctaaggtgtgcatcttttgtttgcccattattacaggcttatcttgttttgccttcttttgtgttaatattttggactgcatctcagcaatattaatttcagttagaactttgtattgcttcaaaagaaatgctttattcagagagtctccaacagactggaagcaaaataagccaaatcattcttggattacagtctaattgaaattaccctacatagcaattatattttatgcttaaaatatacatctgcaccctgacaatttaataaataatgtatactttttgtattaacttgctagcaaccacttattttatctgtacagattttgaaactttccatttgtaataatactgattctttgactattattgaccccttaatttttactttataaaacatttgtatacatatataggcttatatttttgaaatatgcaaaaatttgcgttaactttttacaccataaatttaatcaatagtagcttaattagctaaattaaaattaaaaccgtttttagatcaatgtttatatctataatagagttttcagtcatagttctgtcaaagcaattttgtgttccttggacaattatagaaaacactgggtaataaaaacatattagggtaataaactctcaaagtttaacagactaatgggtagagcaaaaatatcataaaataattagaaaatatcttagtcctaatattttagccagatccttgacattattgaaattaagtctttaatagtaaccattgtactgtatatatatgtacttacacattttccatgtatctttgcgtatctttgtttattctgtaacatcatgtcataaacctcagatatacaaaataaaacttatttaaaaaacaaaaagatgaaaggagtaacagctgagtggagacttggaaagtacatgtgagtaatccaggcaaggaaggaggccagacattgtcattccactgtgcttttctcataatgcacacacaggccctggaacactgtagttactcaataaacttttgttaaaaaaaaaaaaaaaaaaaggatgaaatcattgttggcccaaggctgccacgttcatttctgccgattataccctgtaagaatgttcccctgtgggcagcgggacacccacaaagccaggagccccacgagggttgtgcctgtccagaggaaaggtgctccttttcctagtttactgggcagcttctgctcttcaagccaagtgctcacagagcagcccacagagggctgtgggacagtgatgaccctgttgtgccaggtttcatggatgaattggatttttgaaaaggtcattgtaatggtaaagatttatgatgtggatcaacggggggagagtttttgcatgtcaggtatggggacagatttagcataagttacaaagtctgagatgatattatatgtgcagtagtcagtgaagagactagactgattggaacaaaatatgcatgtctctgatgagtagcagattagagtggaaggtgagcagaggtcagtttttgagggctctgaatgctgtgtaaggaatttggattttatcctccagatgagaaatcacataggcatttgtccaaattcatcataggatcagtaatatcttatttagtagattaacccaggattatgcagcatagaacaaaaggagagaaaaatgattaaaggtaaggagataaggttagaagctgctatttatagtacatgtttttagtatggagcccaggatggaagtaatgagaatgaaaaggaagagccgatgtgttagtgttttcctatatgtgggcatttagattgcttccagtctttctaatcattgaacatatttccatgtgcataagtgaaagaatattcagtgcttatcagttacatcagctaaagtgttgtgcctacgtacactaacttctgcaggcagagcagaggagttccaatttaatcacatcctcagtaatcctttttaaaattcttgcccatctcatctgtgtgaaaaagtatccttttttcgtatgtgaaataatatctctctttggatttctctgataatgaagttcagcatattttcatatgtttattgaccattcaagctttttatctgtaatatgcccatttttcttccattgcatttgtctttatttttgtatattctggatactaatcttatgacagtcacatagtttgtcagtgtgttctccagtgtccctccgatctcttaatcttgtttattaggcattttatattaaaaatatattgtaggcaatttattaagctgatcttttatgatttagatattttctatcttgattaataagttctttaatgtcaaatgatttctaactattttgttctagatcttttgggttaattatttcttattccatttttaatttatgtgacactaatttgcataactaccaggtaatttttcagattaaggaaaatgaaaagtggaaaagaaaaggaaaatttggtaaactgtattatagttttcattctaagtttgtaattgaaccatgaagatatttttaattcttttatatgaccaaaagatatccatatccctcacggttggtggtaatgaaaattaatgtctttctcattgattttacaggaaatctatcagagttcatcttcatgaagtctttgcagagtagttatttctaattggattcaatacaatttcccttcacacatatttccagcctcagtctttataatttcttgcatatgtccagaaggaatacattgtcgtttttaaaacagttaacacaggattcattttactttcagcaattcacagaagctgtgagtccttcagtgctacccccttcagctttgccactggacctgcttaataatgctataactgcctttagtaccttggaagaccttattcgatatcttgaaccagagagatggcagttggacttagaagatctatataggccaacttggcaacttcttggcaaggcttttgtttttggaagaaaatccagaggtaagctccctcttcagattagaacctcatttaattttcttaacagctaatgtttcagattcttctgccacagcttctaaagggtagagtttaaaattcatcagtgatatattcaatacattttcttatcatttgagcatatttatatattgaataataatatatacaaaaggaggaacttagttataacccagtgggtgtggaaaattgaaagggggatacttctgaaaattccagttatatattatcttcaaaaatatcattttgatgaagtccttcattgcattttacaaaaatcactgcttactcaaacctaatacttggaatatgttgattttgggactcaaaagaaattatcatagctgcaaaaccaggttagggatagaaaaaggggatcctctacaaaaatgtttgtctacagtatctcccatgggtcagtattatatgactttgcattttctaagcctagacaattctaagaactatgaaaaatggcaacgacccaacataaaatagaattcatagttttcaaggcaggattcatagcaagaaaacaagaacctaaaagaacccacaccataataatttttaactatataaatttgctgttgaaataatcacttttgcccatatgggtgtatctttctctaagagtgaaagtgatgttaattaaacctaattctgcatggccaagaaattggaaataatcttaactgagttttctataaaattacctaatttttttagtaacattggaattggaaagcatccatagcagacacaaatgaaaacgtatagaaataactgtttaattacaatgcactcaaaatatctgttttagtctgtcagaaacagtgaaatcgactgctttggagaatgcagtgacagcctagagaatttatatgaaaggaataatgttcggttaatttgagccattcacaagggcagattgcaccagacttgctcttctaaaccttgtcagaaggaaacccgattcctgccctttcctgctctaagagttgcagcttttttggatcatgagctttaatctcagcaggtcatgttcagacttgcccagccctggtatttcactatgccaacagacgtggtttccttttggcaatatttgaaatcagtgttcaagtgcctgggcagttgagtcctgtccagatgctgaaagctgttacatatttataagatttgatcttgatgaataacttgatgaataacttacgagcaacacttcccttccctcccacttaggaacaggaagatgaagatctgcaagactagctgaaatatccatgaatagagcccttgttagcaaatttgaagttgattatcatgttgatctgtaagaagcaggggcagtgaatcaggttctaaactgagatctagttttttgacagctgatttctggatttgagcctaaaaacctcccttctagccaaggctttatgcctgaaaatgtacgcctggtgctcaaagatttggccagaggctagcctgcattcaaaagcatcggaagctgaacagatctttcagatattcatttaacactttcaaaattgaagccctttgcagttttccaaatttattaactttttaagcatgcaaaaagtgtgagaaaagcagtgtacatttttggaactttacataaactaaaatacaagtgtaggataacatctatatagacaaaaccaactcccctcctgagagtatctctacaaaggaataaggagtcaaacttttaaaagcttctaattagacattgaaatagatttcccacagaataaacatcacagtgttaccacattcatcttagaaagaccaccctcagattacattacagtaatagactatctttggactgaatatcttaaaagaatgaacaactaacaaagaaaaatattactgttttttgtagcaaaacgtataatattaatgacatttgcatttaaaaataatgattttggttggtgatgtgctcaaaatctgcattctttagaaaaacaaactaatacctgtatttgttttcttaggagataattatgaaaaggaaaaaaatctgaagaccaacttttacaaatatttggcagagggaaacttctttaatattattatagttaagctattcaaaaagtatcctttggtacattatctttctttcttcttttcctttttctctttatttgccttccccccccaaaagtactatacaatgtttcaagaatgtatgacatatgacttaacttaatgaagcttatatgcgtttgaagccttagcagtaggcagcataaatttcaaaatgaaatgccaaatttaaaatccttagttatatttttagaaaactgtggactgcataaatgctttacttttttttctttcactttcttcctctagttcagggttttcattcataccttgctactgctacaaaaaaatactgtattttctaagtcaagcttaactagtacgtaaaaagggcttttgacttttgtgtcaaacatgataaatgagtggaagctaagttaaaagtgtgtttaaattttcacattgtagcaggtatcacaactaagttcacttgggaaatctgtctaaccttttattgtggttaagtaaacattttaaaggaaacgtatacaatctcattttctattatcatgaaatagcatatttaaaactacttgacataggtgaatatgctttgagagctgagagcttcttcactcacattctaaagaagtataattcttaaataagcattgaagactttggcaaccagattttgtgtttgtgcatattttaagtcttcttcctccttgcccaggcattaaatactagagaaaagcttcaaataagctcatatatagttttaacaattaaagaggaatgtatgcatatactattagatcagcaaaatgaaaccaggtaaaatatgtgataccatttagcataatgagctcattacttttattagggataagttggcctattcagagcatttgaaagaaggatttgctttaaatatttaaaagctttgccttcacaggatcattttcagattaaaaagaaatctttcagtagccaaatgaaacaatgactttcccttgagttagaaaaataattttttagctgaataaggtgttgaaatggactcattgaattgggatttctttggtgctttcctatacttgactcaggttttagtctatcatatagtttacatacatttctaatttacaattacctatgcataattttataatacgtttcttaaaatacttaaattatcaaagacaattaagacaatataagtattaaaaacacctgatcacatgtataacaaatccaagaaaataagcatttgattcttaccttgtcacttaaaaattaataaaacttagcttttaatttaaaaaattggattacatcgtgattatttctacttgaagccatctttaaccagaaaatagctttcttttttttcattcatgtctgtgttatccatattagtggaaaggtatttaagtaggtttattatattttagataatatttctaaatttttaaaaaactttattaggagaaaaaaaccctgaaggcatatatgttatctgaaagtattcaatctcattggaattgctttatttgaatatttctaggggaaaaaaataggcagagatgtaaggcagaaaataaattatattagaagtctttatcctaatagtaattacctactattcatgtgatatgtataaattcacattgaacatggcatgttatttcgatataattttcctgaggcagaatcattttgtagttaaaaacaatggttctttgaggatttactgcaataaagaatattttgttaggtcctcaaaagtaggtattcttcatagaataaagcacaaacagcatagttaaccaacttgctaaaggagtagaggctggggttataaattagataaattaaacatttcttccacccattagcaggggaaggataggtatctgaaggagtttagtttagttagtctgaatttccaagatgggaaatcattcaatgcatttgaagcattgccttccaacaacttctgctcttataaagtatgtcattttttttcactcatggtctacacagctgtcttcaaatgtgcgttctcttcatgctttttttatattttatgatggttattgccatagagattatagaaagagctgttgacacatttcaataaattgttcttcactaattgtatgagcctaaaatccttttaagaattatacttgttttttaatcaaagcattcatcatcttgcattttattcttctctcctgtgttctccatgtctattttttttttttttactaaggttaaaacgtgtggccttttttgtctgtataaagtttcctatttatagctttcaactgttttgttggctctgttcttaatattacacaatggcatctctttactggtcgctaagtcataatgaagctttgtttgctatgaactagaaggtccaatttgtagttgtatatctctaaaatctacttacaataagagcggatattgttatggatattgttcatgaaataacgtaagatttctttatgaaaagagcttaatgaaatacattcaggctcaaagcatcaacatctatttttctttgctttcttttataccatatagtggtggatctgaaccttctaacagaggaggtaagattatacagctgcacacctcgtaacttctcagtgtccataagggaagaactaaagagaaccgataccattttctggccaggttgtctcctggttaaacgctgtggtgggaactgtgcctgttgtctccacaattgcaatgaatgtcaatgtgtcccaagcaaagttactaaaaaataccacgaggtaggtatacaattttctttttggtttccttcgggtattttatgtcttagaacaaaacagtgaatctgaaatgcgtttatgtttggaaaaaagacgtagtattcatggggaaaaaaaagaggtctacaaatagtttatgtttttgttttttaaaattagcacctttaattaaaattccagatattagggatttagaaagtatattctctggtagtataacatgagtggtcagtgaagtttttgcctctcataccaaaaataaagtgttttctgagggaaaaaaaaatgagtaaagtttttcaacttttaaacttttcaaaatatgaaggaaaaatatttcaaagacaagctcagagataaattattgtctactttggagaaaggagagctttgatatttatttttctacttgggacaacagagactcctaagatgacatattcataattataataaactttgtattattcatgttgcttcaaataacatgttaaactttgtgtggatgttttaacctttcatctctttattctttggaataaaagaaaatataatatgacatgttagtaattattgttttttagaaccctggaaaccttagaacttgtacacttaatgtttttcttagtgatggagtctcccaattaaatcccaacacctcccccagcagcatcatacagcatcattctatcaggaagccatccttcttgatgagtcaacttgaatttctacaaaacattaacattagaccaagtcaaaatctgcccttctgacatcatttcaatatgactgcctttcctttcatttttccattaaataagaatacagaacaaatatctaactaataaataaaatgatttttcatatgcatcaagatttcagtgaaatccttaatgaagtgaaagccgagctctagaatggaaacagggtcccttgtcttcgcgaatccagtgctttttttcccactttatcaattgccaacacaatattggtgaagggcaggaaaatcatgtcataggaagtgtagtttaggaaaccatgcatgtttaggttacctaacagatgagggtttcactgaacactttatgcatatgaaaagtcattttatttattaagtaggtatttatttcatgttattttatttagtggaaaaaagtaaaggtcatggagtaatttttaaatgaagccagaagggcagattttcattggtgtaatttaaaggttttgtaaaatttaaagttgacttttcaagaaggatggtttcctgatacatgtatggcacctgatgctgctggaggaggagatgggatataataattgaagaaaactaaaagatactgaagcatgataatgttattaataagattcttactttttgtgtcaatcactggatctctttgtgggaagacattttagccaaataaatatattttcttaatgatttttctaagttccacataagaattttcagaaaagcaagtcaggaaccttatatatgtataaacttagatgttgtatcttcattgaaatgctggtgtcctaccagtcctagcatgactaattcatcctcagtgcatctgtagggcttcaaaggtactctattagagaacttttactatttcaaaattattgtctatttttctttgtttctattgaattgagagctaaggaaaacaaaagtcacattgcagtgtaatgcttgagaacacaaactccaaagctagacatcccagttttgaacctaacatttgtttgcatgtgactttgagcaaattgcttagccctcgtgcctaaattcctcatctataaggtgagtctccaaccctcatactttattgtggggatttagtgggttgatatttacaaaacacttagaattaagcctggcaattttcatgccattaatatatattagctgctctctcactcatctttgctttttcactgtgcctagtcttattctttggttatggtaaatgatcaataaagatttaatgaattttgccctgaagcaggaaaggtattctggccaaaagatctacaggatactctgacaatagtaaaatattcgttcctttttctctgttcttacttggcttaataattttcatcttgtttatatttttacatatttaattttttatgaaataatagtcttacattcttacattatgtctgtttgttttgcacagacaaacctaaaaatctgtagcattcagttgcctgattctagtgctgaatccctgttcccagtgctctgtggttctcaaaagttcaaggtcattttgtttgaacgtgttgagcaatggtccatgagcatttgttccttgccggttctctctgtgtcttatctactatcttccacaatctctggctcagcttctccctggacattccttttcatggacttatcattttaatttcaacctctccgtctaaattttctgagatgaacattagccctgtttcttttctggtggcataatctatgtccttttcctctttaatattgtctgggacctgctgatcattttccaagtctatttttctccaccaaagtcaaaactttcaaaatgaattaaaaacaagaacactaattgtgtcctccaccattagaatttcttatccaggacttaagtttctagaacataagagattcttctgctatttgtaaatctccatgagcatcagcagacaaagacaggagactttgattcagcaaatgcatcttggcatatgcatgctagaggaagcaaggattgcagcctggcctgactgttaggaccgtgtatggtggcctctctaatctttaccttacatagtaatttttttttccttgctgaatgggaaaatgcatacaggtggacataggaattgaagacgttgtctatgccaatattgcaatttatcttacccacccacccaatctcattccagaaacaatttgcagcaagactgtgataaggaatagtgccaatatctgaaatgtagttagtctgacacactaaatttttcaaaaataataaatcagtactaacataaaatagtattcagtagccattgagttaaatttcacattaaagaaataaagtcaaagtaatttttattttagaattgtgaaatagatgagaaaactactttaaaagtttagaatttctaatagttattacaagactttgaagtttatctcttcaggaagaaagttactaaataaatagaatgtatgagcagtgatattctgagtctataaaattattatctatctctctaataattcatctctgggctaggtacaaataaaggctgtgtcacttactctgtctaagcctctgttcactcatgtgtaaaataggggtaataattgtaaattacttcatagaattcttgtgagttaaagtatgtaaaaacgttattattgtgcctggcacccagtaagcattcaaaaaatgttagctaattaacctctgatattaccacatactccagtgaggtatgcattctctgtttttcttttaagtctttaaatagaacagtcataagacttgacttgtgcctttttggattaatgaacatttttaggactggtagcttttagaaatggctttatgaggttatctatgtcgtatccaaaaagtagagatgctagaaaatttcatattattttgtgctctggcctttgttcataatccaaacaaaatacaatttcctaaactttattgtttctatcataagaaataaaatgtaatacacttaaataggtagcaacaccaaatactttaattaatattttatagaatacacaactgcatctttttgtcatagtattaagaggaaatatgtgtagcataagtgtcaatcttgctgtatttttattaaaaccttgacaatctgaactgcagataactttatttaatagaggcatcattgttattattgccaaacctcttctcactgcacagtaggatccagctgcaggaagttagctgtgactggggctgatgtctatgaagtacatctaatccatctcatcaagtttatagaggacttgaagtgtagccaagaaaattaatgagtggcataattgagcagactcagctgtggagtgatcatgtttctttccacagtatttctgcacttgagtgtattgcatcaagtataaatatttgttaaatgtgtgaataaatgaatgaatgaaagaaagcgacaaacagaaaaacgaattttatattggtagttccaaaatacttaaggtgaaattctaaaatagtcagataaataaaataacaattgcgtggtgagtctttccatttaagtactgttccttattcagagacagaatgcttccaaattgttggcattaaaatgtctgtgctttcatgaaatgatgatttttttttttttttttttttggtgggagagtgttttcataatgcgtgctctaggaaaaattaaaatatgtgtctttcttgggccccaagattcttttctaaaacgttacttgtttataaaagccagtcatagacattcgttgatttttaaaagtggcttactcttattccctttcaggtccttcagttgagaccaaagaccggtgtcaggggattgcacaaatcactcaccgacgtggccctggagcaccatgaggagtgtgactgtgtgtgcagagggagcacaggaggatagccgcatcaccaccagcagctcttgcccagagctgtgcagtgcagtggctgattctattagagaacgtatgcgttatctccatccttaatctcagttgtttgcttcaaggacctttcatcttcaggatttacagtgcattctgaaagaggagacatcaaacagaattaggagttgtgcaacagctcttttgagaggaggcctaaaggacaggagaaaaggtcttcaatcgtggaaagaaaattaaatgttgtattaaatagatcaccagctagtttcagagttaccatgtacgtattccactagctgggttctgtatttcagttctttcgatacggcttagggtaatgtcagtacaggaaaaaaactgtgcaagtgagcacctgattccgttgccttgcttaactctaaagctccatgtcctgggcctaaaatcgtataaaatctggatttttttttttttttttgctcatattcacatatgtaaaccagaacattctatgtactacaaacctggtttttaaaaaggaactatgttgctatgaattaaacttgtgtcgtgctgataggacagactggatttttcatatttcttattaaaatttctgccatttagaagaagagaactacattcatggtttggaagagataaacctgaaaagaagagtggccttatcttcactttatcgataagtcagtttatttgtttcattgtgtacatttttatattctccttttgacattataactgttggcttttctaatcttgttaaatatatctatttttaccaaaggtatttaatattcttttttatgacaacttagatcaactatttttagcttggtaaatttttctaaacacaattgttatagccagaggaacaaagatgatataaaatattgttgctctgacaaaaatacatgtatttcattctcgtatggtgctagagttagattaatctgcattttaaaaaactgaattggaatagaattggtaagttgcaaagactttttgaaaataattaaattatcatatcttccattcctgttattggagatgaaaataaaaagcaacttatgaaagtagacattcagatccagccattactaacctattccttttttggggaaatctgagcctagctcagaaaaacataaagcaccttgaaaaagacttggcagcttcctgataaagcgtgctgtgctgtgcagtaggaacacatcctatttattgtgatgttgtggttttattatcttaaactctgttccatacacttgtataaatacatggatatttttatgtacagaagtatgtctcttaaccagttcacttattgtactctggcaatttaaaagaaaatcagtaaaatattttgcttgtaaaatgcttaatatcgtgcctaggttatgtggtgactatttgaatcaaaaatgtattgaatcatcaaataaaagaatgtggctattttggggagaaaatt

SEQ ID NO: 38434 - DNA, 28092 bp, Homo sapiens
cgagaagaggacagaggagactgagcaaaggggggtgggctccaggcgacccctagcccaattctgcccctccatcccaaggggcagagaaattgtctttctttgctgactcctacgaggaaaaaaaaaaaaaaaaaaaaaacaattaaagggaaagataaacggagacggaggaaaggtggcagccagattacttagagaggcacagaggagagagatcggggtgagtcgccatggggactcccagggcccagcacccgccgcctccccagctgctgttcctaattctgctgagctgtccctggatccagggtaaggacatgagactgtgggggtgggccccaggaaggcgtccagcggggtcctccaccctcctttctcttaatatcctgggtcttccgagcacatgggggaggggagaggcacagctgatggggaaggggcaagccagagctttcaggcttgaacccgaagccccttaaccctcaatattgagaaggcagagaaatgaatgagagaagcttttagcagtgtctcaggggctagatccaagaaggagggctgggaaagttggggggatgtctgcggaggcggcagaagcatggagggacctgggtgggagatggaggtgctgagagagatgccaggcgctgtacacacaactgttcttggatgaatggacaaagacagatgagcagaggcagggctcaaagaccagattttcagtcccccactctgacccccagccagactccagggaaggaggcagagactgcagaggaccagagagagagagggtgggggggagagagagagagagagagagagaaaagacagccacactgcagagacagaaacccagagagaaagccaggcactgcggaagcaagggctgggaggtgcggccagatcctctgcagagccccagggttggggggagatcaccactgaggtgaaagggaaggcagcaccggcgacccctctgccttgctggcgctgtccagggtccataagagctaaggtgttcaatgaaggcccacacagcccagggagaagggagaggggaggggagagaagaggtgtgggagtgggagtatgagggcagctgggagcccctcctccgatcttggccctcagtcgagcctgggaccatctgagcccctgcaggcccagctgatggaggagggaggaagagttctagaaaatatctctctggagaaggaaggggtgtggggaagtggagaagctcacacaacttcacctcctaggtctgcccctgaaggaggaggagatattgccagagcctggaagtgagacccccacggtggcctctgaggccctggctgaactgcttcatggggccctgctgaggaggggcccagagatgggctacctgccaggtgaggcccccagagtggcaggagtggcctagaggcagagggagggatatgggctcagggagatggggagccaggctagagaagagcaggcagagagagactgcagaggaaagagcctgcattcctgtgagattcagggaacacagaacgagactgtcagagaaagtcaaacctgggcacagacagaaccagagagacagagacagaatgattaggtgacagtcagacagaaaaacagacacatagaaacagagatggaaattcagagaaccagactcagagaaatggtggaagacagagacagagagaatgaaacacaaaaactagtggatctcgaatcatgaaatcagagtgcaatcagaatactaaacagggaaatggggaaataaagagttcgagagagaatgagacagaggagagaggagataaccagagagagaacgtgatctgagtgaggaggcagagagagaggctcagggagaggagtatcagggtggaaggggctgggtggagagaagggaccagaagagaaagaggggggactcaggctgtggaagccttgggaggaggtaggggctggggtggggaagggaaaggtggggggtgctgtaccttgtgcgggaggcttttgtggtatggcaggggaacccctagcttccctcagccctgctccccacccaaggtcctccatgtgctcctcctgtgctctgatattccctgcactgtcccaggatctgatcgggaccccacgctagccacccctccggccggccagactctcgcagtgccctccctgccacgggccactgagccggggacagggcctctgacaacagccgtcacccctaacggggtcaggggggcaggccccactgcgccagaactgctgaccccgcccccaggaaccacagccccacccccacccagccctgcctccccagggcctccccttgggcctgagggaggagaggaggagacgacgaccaccatcatcaccacgacaactgttaccactacggtgaccagcccaggtgaggcgacagcaaggggatgggggtgggaggaccggagaggtacacgctggggatggatgggagagaggctgctgggaactgtggaaggagtcctgggtacagatgggagaataataataacaaaggtagcatttctgtacccttactatgtaccaggcagtgttccaattgtttcagctatataacagttgggaaagggagttctggctcaggtgggagagggagcattgcttaaagatagtgatggacatggtggctctagcctgtaatcccagcactttgggaggccaggcgggcagatcacctgaggtcgggagttcgagaccagcctgagcaacatggagaaaccctgtctctactaaaaatacaaaattagccaggcgtggtggcgcatgcctgtaatcccagctactcagaaggctgaggcaggagaattgcttgaacccgggaggtggaggttgtggtgagctgagatccagccattgcactctagcctaggcaacaagagcaaaactccatcttaaaaaaataaaaataaaaaaataaaagatggtgaggggggcacagcagcgcacagctgtaatcccagtgatttgggaggccaaggcaggaggatcgcttgaggccaggagtttgagtccagcctgggaaatgtggcaagaccccatttctacaaaaagttttaaaaattgtctcaccatggtgatgtgcacctgtgggcccagctactcgggaggctgaggagggaggatcacttgagcccaggaatttgagactgcagtgagccatgattgcaccactgcactccagcctgggtgacagagcgagaccctgtctcaaacaaaacaaaaagatgatgagaagtgctaaggagaagggagatgaaggccagagttgcttggctgggagggcaaaagcacaggcattccttccatcccagccatttgtatctcctcagttctgtgtaataacaacatctccgagggcgaagggtatgtggagtctccagatctggggagccccgtcagccgcaccctggggctcctggactgcacttacagcatccatgtctaccctggctacggcattgagatccaggtaactggaccaaagcatgtgactgtgcagcttccaagccttttcctctgggctgtgggtgtgcacgggtttggcctgggagccaaagaacctgtctgatgactcaggtgacctcaaaaactcttctagatttctacaacttgggcagcagcgtggtgccttttgggctgctacacacagggcaaaggcacaggacaggggctttggaagtcaaacacctggctgacttgccctggcgggtctgtgtctggcttctctaggtgcagacgctgaacctgtcacaggaagaggagctcctggtgctggctggtgggggatccccaggcctggccccccgactcctggccaactcatccatgcttggagaaggacaagtccttcggagcccaaccaaccggctgcttctgcacttccagagcccacgggtcccaaggggcggtggcttcaggatccactatcagggtgaggagtttgagggtgctgctggaagggcaggggccatactgcatacactggacatctttttttttttttttttttttgagacagagtcttgctctgtcgcccagactggaggtcagtggcgtgatctcagctcactgcaagctctgcctcccaggttcacgccattctcctgcctcagcctctcaagtagctgggactacagacgcccgccaccatgcccagctaattttttgtatttttagtagagatgggatttcaccgcgttagccaggatggtctcgatctcctgactttgtgatccacctgcctcagcctcccaaagtgctgggattacaggcaagagccactgtgcccggcctatagaggggacatctttaagaaccatcgaagcacagggtgccgaagggggcttttcctcctgactgcgaccctggggggcagggccctcagaggagacccatgcatacttatctcacacactcacagatctgtgcacacatccgagggacaattcatccattgaatccaacaaatgtttatcaagtgcttgcttcataccaggccctgtgttagccttgaaggaggaatgaacaaaccaggtgtaaatctggcttcaacgagctcagaatctaggtaggaagacagatgagtaatcaggatggttataattcaaggagataaggaatatgatggcagaaacaccagcgggggcagcacatagccaagggacctaaatttctcccaaggaatatggggacatcttcttggaggagatgatgactaagctgagacctgaaggataaattcgccagggaaagggtgggagggagggagagaaggagggaggcagatggctaagtggatgaaaaagcacactccaagacccagagagagaagacatgacccccagatgaggtgaaggaattcagcatggaagatagaattgtcctagctgtgtgacctgggacaagttacttaacttttctgtgcctcatgatctcatctgaaaaatagggatcacaatacttagtattatggggaagatcaaatgaattaatacatgtcaagtgtttaaaacagtgtgtggcctggcgtggtggctcacgcctataatctcagcactttgggaggccaaggctggtggatcacctgaggtcaggagttcaagacctgcctggccaacatggtgaaaccccatctctactaaaattacaaaaattagccaggcatggtggcaagcacctgtaatcccagttacttgggaggctgaggcaagagaattgtttgaacccaggaggcggaggttgcattgagctgagattgcgccattgtactccaggctaggtgacaaaagtgaaactctgtctcaaaaacaaacaaacaaaaacacaaacagcgtgtggtacacagtgagagctcaaaactgtcagtcactgctattactttcaaagcacagaagcgggtgaaggggaaatgggccagagaccaggctgggaggcaggtcagattcagaccataaagagccttatctgcttcagtaagcagtccagactacttcaacctgcaggtgtgacaggcagatatttgaatttttttttttttttttttgagacagagtctcactttgttgcccaggctggagtgcagtggtgatgacctcagctcactgcaacctctgcctcctagcttcagatgattctcctgtctcagcctccccagtatctgggattacaggcacctgccactacgcctggctaatttttgtatttttagtagagatggggtttcaccatgttggccaggctggtctcgaactcctgacctcaagtgatccacccgccttggcctcccaaagtgctgggattacaggcatgagccaccacgccaggcctcctaatttgaattttatttatttatttatttatttatttgagatggagttttgctcttgttggccaggctggaatgcaatggcgcaatcttggctcaccgcagcctctgcctcccgggttcaagcgattctcctgcctcagcctcctgagtagctgggattacaagcatgccccaccactcccggctaactttgtatttttagtagagacggggtttctccatgttggtcaggctggtctcgaactcccgacctcaggaaatcctcctgccttgacctcccaaagtgctgagattacaggcgtgagccatggtgcctggcctgaaatgttttaagcaggaaagtgaaagcctcagatttgcaatttaaagatccttctgacttctgggggcaggaaaggggggctgtattcacgcacgactgcatttgttaggacctatgacagatgacctgcacatgtgtgtacatccatgcttacctgtgtgtgcgggaaccttcccacagtacaagggtgtgttctagcagacatgtgtgcatgaggaaaggggcccagccagtgccctgttccagaccccactgtcttcctatgcttcatggagacagagagaactgtgtgtcgggccaatgcccccttcacatcaccgcatggccttggctggtgtcacgcactctgccctccttgaaagctctgctgaccgcagatgccttgtgtgcctcatgcagggtacaccctgaatcctattctcatgtcctctccagcctcttttgaggcctctgctcaggacctgccttaggggctcatgtgtgcatagcaaaggtgcctattcatcgggggccagcaagctgggggacgtgtatttggcagtagggacctggttattggggagcaagagcattcctggagggcctgggccaagtgctggatttcagatattgtgaaatctgaagatatggctccccactggctcctttaagcagccacttccccagggcactgaaaataggactccttaggctaagtggaacatttggggaagcaggactattgcacaaattggccttcattgctcagtcttccctgcttcgcagctgcactgggtacctttgggaccaaggccctgtttcagcccttcccaacctgcactagctggggcctctggtccagagtggcctcattagtttctctgaaaagccaaagtctccttcacccctcaccccaagttcagcaaactttcccattacaaagccctttcaccaaccttagtttcatttgcttctcacagaaaccctgagagtggccattgtcagttctatctctcaaaggaaggaaaagactcaaaggttatgtagattgctcaaccatctgcacgtttattgcagccagacaacagatccccgagtccctggctcccagtcattcattaattgaggctgaggggtgggtgattaacgttttctcagcagcttctatgtgccaggtgctttgcgtgtttcttttatttaattttcaggccaatcttccctgataggaattattattgccgttaataggtgagaggcccctagagatgaagtcacctgctcaaaggcatgtagttagtaagttctggagctagaactggaactcaggtctgcctgatgacaaatccagtggtctttgcaccgatccatgctgcctcttggctgcacccattgatcagccaggctagcccttttttttttttgagacggagtctcactctgctgcccaggctggagtgcaatggcacaatctcagctccctgcaacctccgcccccttggttcaagcgattctcctgtctcagcctcctgagtagctgggattataggcgtgtgccaccatgcccagctaattttttgtatttttattagagacagggtttcaccatattggccaggctggtctggaactcctgacctcatagactagccttttaggacacaaaataaataaggcttgggccagtgtagacagtggttaggccaggtatggtggctcacgcctgtaatcccagcactttgggaggccaaggtaggtggatcacctgaggtcaggagttcaagaccagcctggccaacatagtgaaacactgtctgtactgaaaataccagcacagtggttcacgcctgtaatcacagcactttgggaggccgaggcgggcagatcacgaggtcaggagttcgagaccagcctgaccaacatggtgaaacaccgtctctactaaaaatacagaaattagctgggcatggtggcacatgcctgtaatcccagctactcaggaggctgaggccggagaattgcttgaacctgggagacggaggttgcagtgagccaagatcgtgtcactgcactccagcctgggtgacagagcaatactccgtctcaaaaaataataataataaaataaataataataaaaataccaaaattagccaggagtcgtggcacacgcctataatcccagctacttgggaggctgagggaggagaattacttgaacccgggaggtaaaagttgcaatgagctgagatcaagccactgcactccagactgggtgacagagtgagaccctctcaaaaaaaaaaaaaaaaaaaaaaaaagacaatggttaatgtgatgacaaaatcatgcatgcaggactgtgtacaggtaagagaacaagtaactgttggagagatgtagagtcaggaaggcttcctggaagaggtggtacataagccccccagtctgatctcttaaaagatgagaaagtagggggagagcacaagcgaaaatatggaggtggaaaattaaggagtcacaaaactgtgttgtgtaggctatatcggtcttgggagatcaaccctgaacctggaatgtgctgggctgcatttaactatggaaggggcttgaatgtcaaactaaagcattcagacttgattctgttgggcatgggcagccattcccaaagctaccatttattgaaaccactttgttctagaaggttgttcttatgttcatctcagtagacaatggactcctgaggacaaggcctgggtctttttcctgacctcaggtgatccgcccgcctcagcctcccaaagtgccaggattacaggcgtgagccactgtgcctttaaagactattttgtctttaaagatcttaatactcagtggcctgtaaatgaatcccccagtgaaagtgaagtcaggaggtctgaagagatcaggagttcgagaccaccctggccaacatggtaaaatcccatctctactaaaaatacaaaaattagctaggcatggtcgcacacacctgtaatcccagctacttgggaggctgaggcaggagaaccgcttgaacccgggagacggaggttgcagtgagccgagattgcgccaatgcactccagcctgggcaacagagtgagacttctcctcaaaaacaaaaacaaaaacaaaaagacaaaatagtcaaatttcctcaacaagtttcatgtttgcttgaggccaggagttcaagaccagcctgggcaacatactgagatgtcatctctacaaaaaatttaaaaattagcggggcatggtggcacaaacctgtagtcccagctacttgggaggctgggtcaggaggattgcttgaggccaggagttcaaggttccagtgagctatgatcacaccactgcactccagcctgggcaacacagtgagaccctatctcaaaaaaaaaaaaaaaaaaaaaaaaaaaaaaagaagtttcaagtggttcttctggatggaagctgaggagctgagggtataccacagggcaccttggtggaagaaaggctgtgtgtgtggagggaagaaaaatcaaaagagacatttaataacttggagcctcagtgttcacacctgcaaaacaggtcacataatctttttttttttgagacagagttttgctcttgtcgcccaggctggagtgcaatgggacgatctcggctcactgcaacctctgcctcctgggttcaagtgattctcctgcctcagcctaccaagtagctgggattacaggcacccaccaccacgcctggctaattttcgtattttttagagacggggttttaccatgttggccaggctggtctcgaactcctgacttcgtgatccacctgcctcggcctccaaaagtgctgggattacaggcgtgagccagcatgcctagccaggtcacataatctttgtctgctgacctcaaaatctctgtgtggactcactttgggagctgaacaagctctgcaaatactgttattacagctggatgaagttcagagtagttcattgatttgcctgaagtcacacaacaaatgagtagcggggtccagaataacttgtttgaacctcagatacctcatctataaaatgggggccaacgagggtgaattacaatgagtgggggagataaggggtgttggagtttcctgttcgcgaggcaaggtgcctgtgtgaggagctcttatttctcggtatgtacgccagtatggagccagtgtgtgcccctggaaggttggcctgaaaggagaggggggaagtgctgggggatcagtatgagagggtggcatgggaaagtgagccctgctacccgctgtctgtctggtgcagcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatgggtgagtctcctgccacagtgggtggggcatctgttctgggaaccccattgggagggtcctatctcgggggtgtccaggtgtccacctttggggaaaacccattctgaaggggtgtttaccctgaggagtccccatcctggggtctgcagccagagctctttgtgcggagggtctctctccttggggtttctccatccttgggtggtctccatctcggggtgtcccactggagattttattttgggagtcaccattctggaggtcccttctggggtagcgtcctcatcctagaggaagccatttttagggttcatgtccagagggcttctatcctagagagcctcttactgggattcccatcccgtggtgtcttcactctgaaagtcctgtcctgaagatttcccagctgaggctttgaattttagggatccttgtaactccccatcctagagtatccgcagttggagagtcttcattttagtggtgtctccatcctaggaggtgtcaatcctggggttctcccgtaccggggctggtttctttcctggctcatgcctggagaaggtcccatcctctggagtgactccatgggacagaggccagccctgggccgggtcccagccaaatgtgtgaatgcaacagttctgaaaacgggccgaggccccgaggagaaggacagttcacctcaggctggccttaacgtacccctcctctgcccacagcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggtaagggtctgggtcttgggtcagaagtccccaccttggccgggcatggtggctcatgcctgtaatcccagtactttgggaggccgaagcaggcggatcacaaggtcaggagatcgagtccatcctggctaacacggtgaaaccccatctctactaaaaatacaaaaaaaaaaaaaaaaaattagccgggcatggtggtgggcacctgtagtcccagctactcgggaggctgaggcaggagaatggcgtgaacccgggaggcagagcttgcagtgagccaagatcgcaccactgcactccatcctgggagacagaatgagactccgtctcaaaaaaaaaaaaagaagtccccacctcagggaagtagggaggctaagtggggacttggacacagctggggtggatcctggttgagatatgcatcacagcttagtcctaagcctttttttttttttttttctttttttgagacagagtttcactcttgttgcccaggctggagtgcagtgccgcagtcttggcttaccgcaacctctgcctcccgggttcaagtgattctcctgcctcagcctcctgattagttgggattacaggcatgcaccaccatgcccagctaattttgcatttttagtagagatggagtttctccatgttggtcaggctggtctcaaactcccaacctcaggtgatctgcccaccttggcctcccaaagtgctggaattataggcgtgagccaccacacccagccagtcctaagactttcttaggaagtgtagctgtgaaaccttagacaaatcacttaacttctttgtgcctcagtttcctcatctgtagaatggagataacaatacttccctcttcaggtttctgtgaggataagtgctgaaattatataaagtccttagaatggcacctgggacaataagcactataaaagtgtctgctatcctcttttttttttttttttaagatggagtctcaccctgtcgcccaggctggagtgcagtggtgcgatctcggctcactacaacctctgtctcccaggctcaagctattctcctgccttagcctcccgagtagctgggactacaagcgtgtgccaccacgtccggctaattttttgtacttttttttttagtagagttggggtttcaccgtgttagccaggatggtctcgatctcctgacctcgtgatccacccacctcagcctcccaaagtgctaggattacaggcatgaaccactgcacctggccttatttatctatttatttatttttggagacagactttcgctctgtcacccaggctggagtgcagtggcacggattcagctcactgcaacctccacctcccagatgcaagcaattctcctgcctcagcctcctgagtagctgggattataggcatgcaccaccatgcctggctaatttttgtatttttagtaaacatggggttttaccatgttggccagcctggtcttgaactccttgacttcaggtgatccacccgtcttggcttcccaaagtgctgggatgacaggtgtgagctgagccaccatgcctggtcaagcatctgctatcttcatcatcattatcatcctttacctagcaacttggtatctcagccctgccactacttgctctgtgaccttggacaggttacttgatctttctatgccctaatatcctcatctataaaataaaggataataatagtgtctgactcaagagttcttgtgaaaattaaatgagatagaatgtgtaagggcttagaagagtgcgtggcatatagttatgtgtgatgataacagctataaaaataagttaggaaagcaggcaaggggtgaggcagcttgtgagggagattgagctcctggtcacgtttctgtccatcccaggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaaggtaagtgacccactcccccacaggaccccaaccgccacaccttcccctcttcctgacaccaagcatagtcggaagcacaaactctatgcctgttcatctccgtgctgggttccttgaaacgtgactcgcttccctgccccaaaactgcaaggatctcttctagggaccccttctccttcccccaggcagccttctctgtttaagcttcatgaatgtctggatccaggtacatagcccagagaccagttatctcagtatctcggttctttcctctgtgctggcttcatccttaggcactttccctgtgtgatggacatagctgccgacttacataccaccaacttaatttttattttatttatttatttatttattttttgagacgagtctcgctctgtcacccaggctggaatgcagtggcgccatcttggctcactgcaagctccgccttccgggttcacgccattctcctgcctcagcctcccgagtagctggggctacaggcacccgccaccgcgcccgactaatttttttgtatttttagtagagacggggtttcaccgtgttagccaagatggactcgatctcctgaccttgtgatccgcctgcctcggccgcccaaagtgctgggattacaggagtgagccaccgcgcccggcctttatttattttgagacggagttttgctcttgttgcccaggctggggtgcaatgtcatgatctcggctcaccgcaacctctgcctcccgggttcaagcgattttcctgcctcagcctcccgagtagctgggattacaggcatgcgccaccatgcccagctaattttgtatttttagtaaaaatggggtttctccacgttggtcaggctggtctggaactcccgaactcaggtgatctgcccgcctccgcctcccaaagtgttgggattacaggcgtgagccactgcgcctgacagtttttagtttttatttatttttatttatttatttattttgagacagagttcctctctgtcgcccaggctggagtgcagtggcgcgatctcagctcactgcagcccccctcctccaggttcaagcgattctcattccttagcctcccgagtagctgggattacaggcatgcatcaccacgcccagctaatttttgggtttttagtagagacggggtttcaccatgttgcccaggctggtcttgaactcctgggctcaagtgattcgcccatgtgggactcccaaagtgccaggattacaggtgtaagccacctcctccagcccataccaccaaccgagtaacctcatcagagagaacactcatatatttcctgagagctcagcaaaaatgccaggagaggcgttcattgacctgactaagatcctggttggccttagcctgagccaatcactgagctaggagaagggagtattgggattggctaatctgcctcacgtggccttccctggtgggctccaacttaacctagtggactgggagtggggaaggcctgcgtcccaaaattaaaattgggatgccgttaccagaagaagaggaatgaatgtgaaggggtagaaacaaggaagtgatcatggaggaagaggcatttcaccttggccttaaaggatagagggtattttattattattattattattattgaaataggtcttgctttgtcgcccaggccgtagtgcggtggcccgatcatggttcactgcaacctcaacctcctgggctcaagtgatcctcctgcctcagcctccctagtagctgggaccacaagcgttcggcaccatgcctgggtaatttttacattttttgtagagacagcatctcactatgttgcccaggctggtctccaactactgagctgaagtgatcctcccacctcggcctctcaaagtgctaggattacaggcgtgagccaccctgcccagccaacagaggatattttaaaagaggaagattgaggccagttgtggtgactcgtgtctctaatcccagtactttgggaggccaaggtgggatgattgtttgaggccaggagtttgagaaccagtctgagcaacatagtgagatcctgtgtctacaaattaaaaaaaagtaataattatccaggtgtggtggcacacacctctagtcccagctacatggaaggttgaggtgggaggatcacttgaaccccacttgaaccccagaggttgcagtgagctatgattgcaccactgtgctccagcctgggcaacagagcaagaccctgtcaaaaaaaaagaagaaaagaaaagaaaaggaaagagaggaactttgagaaacagcaagtagggaaatgcctggtatgtctgggaaacagaatttcattgtggctgaaacagaggagttgtataaacagtagcaagagagagaccaaaaagatgaaatgcttagagataggagggtctagtgtttgatatgaatcatgggagaaatggaattggcactcggctgtgatggatgggtaggatttggacatgataccttgcaggttaagtaacagtgaaatagaacagtggatctgcaaaaatgaattgcgggatagattctgggagtgttaaagtgcaaacagcacagatcttttaccgaaaatagcaagttgtgagtcctgactccagagttgtaggccactgctattctatgagtttaagattcttcactgtggccaggcacaatggctaacgcctgtaatcccagcactttgggaggttaagatgggaggatcacttgagcctgggagttggagaccagcctgggcaacatagcaagacctttgtctctacaaaacaaaacaaaacaaaaaattagccaggtgtggtggtgcacacttgtggtcccagctgcttgggaggctgaggcaggaggatcgcttgagctcaggaggtcaaggctgctgtgagttgtgatcccaccattgcacgctccagcctaggtgacagagcaaggccctgtctcatttttttccttttttttttttttttgagatggagtttcgctcttgtcacccaggctggagtgcaatggcgcaatctcggctcactgcaacctccgccttccgggttcaagtggttctcctgcctcagccttctgagtagctgggattacaggcatgtaccaccacgcccagctaatttttgtgtttttagtagagacggagtttcaccatggtggtcaggctggtctcaaactcctgacctcaggtgattcacctgcctcagcctcccaaagtggggggattacaggtgtgagccactgcatctggcctcatttttaaaaataaataaaataacccgggcacagtggctcatgcctgtaatctccgcattttgggaggctgaggcaggtggatcacttgagcccaggagtttgaaaccagcctaggcaacatggcaaagccccatttctactaaaaacacagaaattagccaggtgtggtagtacgtgcctgtaatcccagctactcaggaggctgagacatgagaatggcttgaacctgggaagccgagtttgcagtgaagtgagatcatgccactgcactccagcctgggcgacagagcgagactcagtctcaaaaaataaaaaaataaaatattaaaataaaattaaaaatctcaaaaaaaaaaaaaaaaggccgggtatggtggctcacgcctataatcccagcactttgggaggctgaggcgggtggatcacctgaggtcaggtgttcgagaccagcctggccaacatggtaaaaccccatctctactaaaaaaatacaaaaattagccgggggtggttgtgggtgcctgtaatcccagctactcgggaggctgaggcaggagaatcacttgaacctgggaggcagaggttgcagtgagccgagatcacaccattgcactccagcctgggcaacaagagcgaaactccatcccaaaaaaaaaaaaaaaaaaaaaaaagaattcctcattggtatcataggcacctaaatcttaacttacagggagttttgcagctaagatccgatcaggtgggcagaaactcaaatgctctacaaatgttcacttttgctgacttgaagtaaaaactgagtagtttttgcattagctgaaattttgggtttcagcaacagcatggatgatcagaatccaactgttatttctgaggagacaatacacctacaccagccagttctctgaaggcacccctccccttacccgctatctctgctgtttccagagccaagtatctgtggctgggaatcaaaccatctgggtttgagacctgcttttgccattgtcttttgtgtgaccttgagcaagtggctttttggtctatggacctccgctctgtagaatggtggctgggatttggctagctcagtggcttccctccagaggccagggaggcaatataaatatgtgaatgaggagtgttagaactttttttgacagtctggagagtgaatgctaaacccagtggcattcagtttttaaaaacccaccaacgccagggcaatggctcatacctgtaatcccagcactttgggaggccgaggccagcggatcacctgaggtcaggagttcgagaccagcctaagtaacatggtgaaactccatctctacagaaaaaaaaaaaaaatcagaaaatgagctgctgggtggggtgtgcatgcttgtagtcccagctaccagagaggctgaggtgggaggatcacttgagcctagaagatctaggctgcaatgagctgtgatcacaccactgcactccagcctgggcaacagagtgagaccctgtctctaaaaaaattaaaaaaaaacccaggctgggcgcagtgactcatgtctgtaatcccagcattttgggaggctgaggcaggcagatcactcgaggccaggagttcaagaccagcctagccgacatggtgaaacccctgtctctactaagaatacaaaaattggccaggcacggtggctcatgcctgtaatcccagcactttgggaggccgaggcaggcagatcacctgaggtcgggagtttgagaccagcctgatcaacctggagaaaccccgtctctactaaaaatacaaaaaattagccaggcgtagtagcacatgcctataatcccagctactcaggaggcaggagaatcgcttgaacccaggaggcggaggttgcggtgagccaagattgtgccattgcactccagcctgggcaacaagtgtgaaattccatctcaaaaaaaaaaaaaatagctgggcatggtggtgcacgcctgcaatcccagctacctgggaggctgaggcatgagaattgcttgaacctggaagtcagaggctgcagtgagccaaggttgtaccactgcactccagcctgggcgacagcacaagactgtttaaaaaaaaaaaaaagcccagtgagtggccaaagaacaccccaattcagcccacatccccaatttaagatcccttgaggcctgtcctaatgcttaattgttatgactgactccttcccagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaaggtgagccttccttgtcgcaggcatgtccttcagtccacgttgccccctgaactggggatcccagcaaggccgttcagaaaggaaggctgcacatccagacttcatccacccaagccttgggtaaatccctgtcccttcagaggctgttttcttagctgaataactgctgggcttgttactgaatgcaggggtcacaaacccaaatgtcttcaagagcgagaactgctgttgggttaagtcacagattgggcaggctggagagtgggcagggtttgttaagagcaggactggatattgaacacaacaggacctagatgcggcaagaaacaggtagatcatggctgggcacggtggctcacgcctgtaataccagcactatgggaggctgaggcgggcggatcacctgaggtcgggagttcgagaccagcctgatcaacatggagaaaccctgtctctacttaaaatacaaaattagctgggcatggtgatgcatgcctgtaatcccagctactcaggaggctgaggcaggagaatcgcttgaacccgggaggcggaggttgcggtgagccgagatcgcagcactgcactccagcctgggcaagaagtgtgaaactccgtctcaaaaaagaaagaaagaaagaaaaaagaaacaggtggataaagccgggagcagtgtctcacgcctgtaatcccaacactctgggaggctcaggcaggcggatcacctgaggtcaggagttggagaccagcctggtcaatagagtgaaaccccgtctctactaaaaatacaaaaattagccgggcatggtagtgcgtgcctgtaatcccagctacttgggaggctgaggcacgagaatcgcttgagtctgcgaggtggagattgcagtgagccgggattgcgccactgcactccagcctgggcgacagagtgagactctgtctaaaaaaataaaaataggggctggacctggtggctcacgcctgtaatcccagcactttgggaggccaaggcgggcagatcacgaggtcaggagatcgagaccattctggctaacaccgtaaaaccccgtctctactaaaaatacaaaaaaaaaaaaaaagaaaaaagaaaaaaaaatagggtgtggtggcggcgcctgtagtcccagctactcgggaggctgaggcaggagaatggcgtgaaccagggaggcagagcttgcagtgaaccaagatcgcaccactgcactccagcctgggcgacagagagactccgtctcaaaaaaaatttaaaaataaataaataaataaaataaaagaataaaagaaacaggtggatcataggtaataggaaacaagcgaggtgatgtggtgcacgcatcacgagtggtgaggactgtggagaaatgaagacagcatgcccacctgggtcctgaacctgacacccctttttccctagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatgtatgtttgggtcctgcagagggtgcgacgggtgtaggctcagcaaagtgtggtatgccaatgcagtagcctgcattctgagcctgtctggctcttgcgtatctatccagaattcggtggataggctggtgcactaagggtacaggatagacgtgagagagctgggctcaaatcacatattagccaggcaacctcggacaaataaatagggcaatgcagccttccttaggggccactgtgaacaaggggctctggcctggtgcctctcactctttggaggtttctgaggcttcccctggagctatttccacggacacagacccaaactgttgcgttaacaccagcaagttggggaggtctggggagaatccagtgagctgaattggtatgagagtgtcatgagatggcacagaagctgaagtgggcgtggcttcaaagcaggtactcaggcggggcctagagttgtgtagggcgttagcgaatttggtctgtgattggccagagctggagttgggctaggctgtggatctcatggtgatggaggagggagtggacagtgggcggagttagtaatgtgcaagcttagggattgggtagtaggacatgggaggagccatagaataggggaaccctgaggcactagcataggagaaaccatggttggtcaaaacggaggcggcgccagacctgggataggagaatatgggcggggctggagagtaggaggggctaccaatgagcagagttgaggatggggcagagctggatgggaggggccagtcgcagccccgccccattgcctggtctcaccccctgcagattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaaggtactgagggatagagtcccgggatgggcaggggtcgggcaggccagagatcccgggaggtggccggtcgtggtggctcacgcctgttatcccggggccttgggaggccgaggcgggaggatcgtttgaagccaggaggttgaggctgcagtgagctatgcttgtaccactgtactccagcctgggcgacaggaaaccctgtctctaagagagagagagagagacagatcccgggagggggcacagagcaaagcctccgaggctggaagggagcccgcagttaaaacgcagcctccaaactcgccttccctcccctgcagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagagtgagccggccccgcccgcgtcccctcggccccgccccttccctgtgggccccgtcgtcggcctgtcctgtcccgacccccgtgctttctgggttccatcccttcgctcggggtccttcctggatcttcttcaaggcctgcccccatgccctttagttctcactcctccgcccggttccccgaaactgtcccctctgggtctccctctcatcttctccgggctgcatccctctttcttgcaccgacctgggctcggtccctgtttcctcgtctcacggccccgccccgtcccctcctgacccctcctctgcggcatctgagtttggcccctaaaagggctccgaccaggttcccactgggctccccgggtccacacttggctccaccttcctgtcctacgccccgccccaatcccgcagtcctatcagttgaaattgtagggagccactttgctaggaccaaggcttgtcagagcacttggtttatttgaatgccatcattgaagccccgtgctgggttggggttaggcgaagggggttcaagcccctccatactcttatggagctcgcagtctgggagggatacgcagggtggtgatcactgggtgactttgggcgaggcacttagcatttctgaggcttggtttccccatcggcgaagtaggactgaggttgtgaagagcagatggaaagttcacagggcgcatgctgccctgggcgtggcgaagtgctgtggggagagcagtgggctaattttctcagggctggggcaggagatttcacagaggaggtgacatttaaaggagctgggagtgtgtatcttttagaagagcagaaagggccaggtgcggtggatcacctgaggtctggagttcgagaccagcctggccaacatggtgaaaccccgtctctactaaaaataaaaaactatctgggcatggtggcatacgcctgtaatcccagatactcaggaggctgaggaaggagaatcgcttgaacctgggaggtggaggttgcagtaagctgagattgtgccattgcattccatcctgcgccacgggagtgatactccatctcaaaaaaaaaaaaaagaaagaaagaaagaaagaaaaagaaaattgaagagcagaaaggaatggcagctggttactttctccaaattttaggaagccagccccaaggacatggggctgtagttccatgtggcatctggaagcaatggtgggaccaaggggagaagcttcaggtagccagatttgggctggacaaagcttcccgcccctggaaggattcacaggatatcaggcctggatggggctgagagttcggctggccccgctgcctcgggctcaggagggaacctgcccaaggcagcagattgagcctgaaggtgtgccaggacccacatatctgagtccctgtccagtgctccatggctgtgaccctgggcagattccggctctgccactccctggctgaatgaccatgggccaagtcctttgaccgccctgagccctgggctccaagggagatgacagtgacattggcctctcaggataatcaggattaaatattatgtttgtgccaggtgtggtggctcacatctgaaattgcagtgctttggaaggccaaggtgggaggatcacttgagcccaggagattgagaacagcctgggcaacatagtgagaccctgtctctacaaataataaaaaatatagccaggcatggtggtatatgcctgtagtcccagctactcagaaggctgtggtgcgagaattgcttaagcccaggagtttgaggctgcagtgagccgtgatctcaccactgcattccagcttgagtgacagagcaagttctcgtctccaaaacaaagaattatatttggggccagccgtggtggctcacacctgtaatcccagcactggtggaggctgaggtgggtggatcacctgaggtcaggagttcgagaccagcctggccaacatggcgaaaccctgtctatactaaaaatacaaaaattagctgggcatggtagcgaatgcctgtaatcgcagctactcgggaggctgaggcaggagaatctcttgagtccagaaggcagaggttgcagtgagccgagatgcgccactgcactccagcctgggcgacagagcgagactcccatctcaaaaaaaaaaaaaaaaaaaaaaaaaaaaaaaaaaaaaacaagcacacacacaaagaattatatttgtttgtaaaacatttagcagggtacgtagctcaggcttatatacaagaaatggctatgattatgattccttcacaacagggttgtaaactcaaacgcctgaaggcagggagtgtatgtgagtgaactgggctgggcataatgagaatactggggacaggagagctgggccccctctaaagagggcagctgctgttccacagactacaagccatgttgggctcaccctgctgggatttggctagtatgctctggtatggtggttaaatattttgaatttcaccccaggataggggcttggggtttccccaagcaaactgtttactaaacgaagcctgaaatataacatacgttgaattttgaaaaaaattaagcctgtcattctggcctgaaaatagatgcactgcattttaagtttttccaattcatgctctcttccttctgaggaattggtgggaagtgcgtgtgtgtgcagaggtgttcagaggaaacagcctgaggctcaggcctctcccagccctaagcttctgggagattttcttttattttttttagactgggtctcactctgtcacccaggctggagtgcagtagcgtggtcaccattcactgcagcctcgacctgctgggttcgagcgatcatcccgcctccaactcctgagtagctggaaccacaggagtgcgccaccactcctggctaatttttcaattttttgtagagatggggtctctctgtgttgcccaggctgatctttgaaggccctcgctccccctgaccttgttcttctgccaccagtcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgcctgtgagtctggggcacaccctgggagggtggctgggtagccctgggagagcccgtctgccccgtgcacagtagtgcagctggcacgtgactggcatgctccccgcagtgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaaggtgcctggccagacagggcaggaggggcacaccagtgtccgggaagtgacagggctgggagagtcaggtagcacatttgagaccaatgggcgaccccacagagctcccggttctcctcctgtggcctcgtgtcctcacgggtgtgtccagaagccctgggtcgtgtgaggtcatgggattggctcaggggtgtagtagagggggccttggcttggaagtcccttgctctgaataggcctcagtttccctatcgctgacaagttctagtttggctcagactgtccaggaaccctgactttttaggggtctggagaaagaggacaaaggccctgtgctggtcactcctctctcttccccacaaagggagaaagttgaggttgagcagagggcagagagaaccaggctgtccagcccagccccaccgggctcccggcccctcccagcctcctcccctccctggctcagaccccatcccctccccctcctctccctgcagttgcctatgaggagctcctggacaaccgaaaactggaaggtcagtgagagcacaggtggagacccaggctggccaggttgggagggcaaggcagaggctggggcaggaggccaggccttggagggatgaagcccagggtttgaggcccagggcaggaggctgggagagcccaggaccgggcccagccacagctcaccggcctctcctcctcctgtagtgacccagaccacagatccatcacggcagctggaaggggggaacctggccctggccatcctgctgcctctaggcttggtcattgtcctcggcagtggcgtttacatctactacaccaagtaagtagcctgcttggggactgccggccagggcagacgtcttgcgagcctggcactggagcctgggtcaggggagctcaggggcttacctgttgataagctcctctgtcctctccctttcccaggcttcagggaaagtcccttttcggcttctcgggctcccactcctacagccccatcaccgtggagtcggacttcagcaacccgctgtatgaagctggggtaagcaccttgcctgcccctgaagagccaccacttggctctcccaggactccataaccttctcgcaaggtctctggaatctctgtcttgggaatttcaaactcagctgcccccagaggccatgtcaatgagcatagcaagccatgtgtatacaatagggagtggtgaggactgtggctaagtggaggacttgtgccccatctcaagaatacggctctaccccatagtcgaaactgaggcacaattggcagatcttccaattattcaagacaagccagaaattcagatttttgtgtcattttacgacaccgtaggatgaaccaaacacattcactggccccccagcccctagaggtcaatgttactttaaaacccaggatcgttgcccctcctcccattcggctgcctcttccacccctatcagactccaacaactgacctgatctctctgtcttcaggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaagccgcctcttctcagttgccaaacgaggggcctgccccccgccctaccggcttttggattctgggaggggaactctgcctccctgcaaatcttgcagcccctcctgcccagggcacccctcaaggactgcccccgatagctctactgttcccttggccacgaaggtgcccccctcccagatgccctggccctaggcctgactccggccaggagggtcagaagaaggacaaaggggagagctgggacaaggccttgcccccttcctgccatctccccaacccacagtctctccacctttgcttctgaattcttgtttttgagcaataaacagaaaatcgccacttgt

SEQ ID NO: 38435 - DNA, 7933 bp, Homo sapiens
tcgggccacgccaggtacgaggagctagggttgtcctgccagggtagaatcggaaccgtaggaggggtacttaaccggacggcctcccaggcctgtggccgtgcgcgggaagagcactgcaggtagacagcagggcatgtgcatgtgcaaagagcttcaagctcgtcgctttcctggaaccaaggaaagcacagcttgggtggagggagattaggcggggagatggcagaagtggacgggagttatatcacgtggtcctatagctttggaaaaccctgtaaggagttttataatatagtcaggggtgcagcagtttgcgaattctgtttgttcatctatgaaaatggtcaaaaaaatttattttggtgatggccatacaactctgttaatatagtaaaactactgaattgtacacattgggtgaattatatggtatgcaagttatatatcaataaagcttttttttcttttccccccgagatggagtcttgctcttgtctctcaggctggagtgcaatggcacgatcttggctcactgcaacctctgcttcctgggttcaagcgattctcatgcctcagcctccccagtagctgggattacaagtgcccgccaccatgtccggaaaatttttgtatttttagtagagacggggtttcgccatgttggccaggctggtctcgaactcctgacctcgtgatccccccgcctcagcctcccaaagtgttgggattacaggcgtgagccaccgcacccagccaaagttgttatttttttaaataacagtgctgagcgctgggatgctacagtgtccagagattaggcagatgagtacattttttgctgggtacgtactatatgtaggtaccaagctgaaattctagtgagtgagacagactataaccaaagcaaataaatgggatacatgttgcaggtcatgtgatatatgcatggaaaaaataaagcagagaaagtgggtcaggagtgctagggtgggagtgggatggccatatctgatagggtgcatggggaagacctcccaaggggctactatttgagcaggacttgaagaaggtgagggagcgagcagcacagatagcagctgtcgtgaaggccctgagctggggacaacttggtgcgttccagcaacttcaagaaggtccatgtgcttggagtggagtgaggaaagggagactagtgggagatgaggtcagagaggaatgagagccagtgggtaggttccctgtaggccatggaaaagacaggcttttaccttgagagaagtggggaaccattgtagaggttgagcagagagacaatggttccacctgtgtttggaaaggaacactgactgctcgactgacaataaattgtaggggctggaatagaagcagggtgacatctgtcaggaggctcttgggataatccaggctagagatgtgatgtgggtcactgggaccatttggtagcagtggcagaggtgagaggaggagggatcctggatttggaaagccaggggcatttgctgatagatggatgtgaggtgggagagaaatgaggaatcaggggtgatgcgaggttgttgatctgaatatttgaacttggtattgctgtcatccatgatggagaaggctatgggaaaaaaaggtttgggaggggaagatgagatccccattagattttcaggcagagatataggttgggaagtttgataaatgagcctagaaccctggggagagaggtctgcgctggaggagtcaagagtatagttctgtttttttttttaaaaaacaactttattgatatataacttgcataccatgtaattcatgcaatgtgtacaattcagtggttttattatattcacaaagttgtatggccatcaccaaaataaatttttttggccattttcatagatgatttttaaaaccacaggactggataagagaggagtctgagtgccgagtgccggggtgctacagtttccagaggttaggcagatgagtggggactggaaaccgagtgaaaaatggcatgtgaaggaggagcaggtgaaggccagatcagagggagctggacggaatcagagaagaggaacagaaacagtgaattcaggcagtctgtcaaggagtttggttataaaggaaaccaaagaaatggggcagttgctggtgggggggtgtcagatcaattactgagtaatgtctcaggaggagagaggatttgggacctggggcacaggttggttttccctagaagcatgggttttttatcctgaggatcaagagaggaggtggaaatggggcagttactggtggttgggaaggtatggtgggagtttgtggaagttctcttccaactttttattattttcttgatggaaaatgaagcaagcagaccatcagctggaagtgaagatgaggaacagatgatagaggcttgaggaaggggcagttggtaggagacagccatctacatagagcgggagaatggatctgaaggggcaggattccgaacttgaccctcagggccctgcttcacctatccagcctctccatccactcttctctgcttttgctttccagttgcactgactgcctttcaggttttgggcgacctcaagcactttccaccttttctctttgccaggaacattcttctccttgctggttggggggcctgtgaaacatctaagtggtgacatcctgggggctgagaaacagggcccagggttgggggctggtgggatggtggagaggctgaggggagggactggagtggagaaacaactccagttgccacatgggaattattgccacattcccttatgaagtctgttgtcacccagcttatgttctagtgagagaataggcaacacataaggaaatatatccatcaggagaaaaataaagcagagaaggtagctggggagggagtggtcaaggaagccttactgagaggtgatatttgggcaaagatgaagatgtcggggtgagccgagtagactcgtggaggaagagtcatccagctggacaaggtggcagggcacagaccagcacggtggctggagcagagtatggcagtagaaggaagaggatgagggctgagaggtctcaggatttcttggccaccgccaggtgaaatgggagctgttgggggattttgatcagagggatgtaatctgatttttgtgttacagggccttgggctgccatgtgcagaacatgggggtgggggacggcaggggagaaagccgagattgcataggagacagtagctgtcatctctgccaggaatgggtgactttgctggggtctaaaaatgggcagctagtagaggaggtgctgggaaaggaggctgagaaggttggaggaagccaagaggggcagtgatgttgggaagagagggtgttgaaagtggtgccagccatggcggacactgcatgctttgtctgatgaaggatacacctgcaggggtgttatgggatctcagcctgtgtgtcatgggtgctggccttgaggcctgggagtctgactgggctgctggggcctggatggtatgcaccctcatgggcatggaacccagccttatgaagggggcccaggggtttgggtgtggcaccagcttgggatcactgtcacagtgaagttcccttctgcggctctcagctcaggcccactttgcccagaagacatgtttctacccaaccagctgtgttttcaaagccgctgagcttctccaaagacagttcttagcacagcatgatggagaggaggctagggtgctgtggggagcctctgtctcatatcaccttccatcaggaagcccctttctattctgtatctggagctccttcagttccttcctgtctgcagctccctctgcttttctctctgtggcgtggtctgttggccaccaggtgtcgctctcacagccaggatcagtgcttagggactttgaggtgtggtttggccagaggagggtgctgttggctcagctttttctgggaaaatgggtcacctggccacctctttggggtcctcagagtcactggcactcttgggctcaggtgaggcctgattctggataacaggagactccctgctgtccaggtaatgagaagcaggcccaaacatcaaagcaagatggaaaagggaaagatgagagaaacctaacccgttgagcaatggcaggttggagaggaaagagaaagcttatggaagtcgtgaagtgtgagactgagagttggtagcctggaaagtctgggggcggagttgtatggcgtgaacctaagaaaagtcctctgtggcaaaaacagttttgttttgtttttttttgcccctggaattatcttagaggagagctgagagttttctgtcttgggtcacaaatggcctgtgtccttaggtccttgcacagaattgaaactctgcttcccttgtgctgaggcagtccttggagagtctggggagttggttttgaggctgttttacagaaatgatcctggatcttagtcttcctgaattcccctgagttccacaacattgcagggagtatttatgcgtctttgtggggctttgtcagcatgtgtacaagtctggtttaaaaactgtctttgacatcagaaacctgggcaccaggattctcattcaagtcacagcagagagacctggaggatgtagggaagtgggtagcagggaagggtccgctttgtgtggcatggtggcgggcactggaaggtatggcatcctagaggctcgtccccaactgtgttccattgtccaagagcacccagaggagagcctgaccatcctcttgccacaggggccacagtctctgggcccaacagggtggtgctcagtttagatgatttgagtggggattagtctgttcagaactgtccctaggcctcaaaactgacttatgtccagcctttctcagctgtgagctgacctgtctggcgtccccctcacagatctcaggatgatggggcgcagccctgggtttgccatgcagcacatcgtgggtgtgccccacgtactggttcggaggggcctccttggaagggacctcttcatgaccaggactctgtgcagcccaggcccaagccagcccggagagaaaagacctgaggaggtggccctggggctgcaccaccgcctcccagcactgggaagagccctggggcacagcattcagcaacgagcgacctccacagccaagacttggtgggacagatatgaagagtttgttggactcaacgaggttcgagaggcccagggaaaggtgacagaggtgaggaggggagctggggtggctggccccgccctctgacttgggaaatgtgccaaaccagtcacgtggtgctgggtagccacatccagacttgtgtttagcctcatttctcacgtggaaacctgggcttgatgcttctggggtgaaggtctccatgtaactgtgccacctactttccccgaaaacagttactgtgtaccagtaagtccctggccactaacatccactctgtgaggccagcaaatacttcctttgtggaccatttggggattgatggtgagagttacgtggggcttgctgcggtactgttactgtgtgtaattacaacatcttttgtgaagatagagggcactaggaaatgtcacagtgtgaggtggaaagagctggtggtggttgtcaagtcctttgtggtggcagaaatgcattctgtcatctctgttcccactcctgcttaggcatgtagtagtgtagcgtggtgggaagaacctggggttcagctgggactttgagacaaacagtgccatctctttccttggagattgtgagcttggctgagctggtgtttctgggtttataaactggaggccacagcagtgcctttcatggcattgttataaggcataaataaggcaacacacgggaaacagcctaccaacacaggtttgatggacacaaattgtgtgcattgttagctgttttcaagttttttcaggggcatgttatttctgcttgaatggctaaatctcgtgattctgatgggtgtggcccaaggctgcactttgagcaccactgggtgagccaggattagtgtctaaggaattccgtttccaccctttgcagctcacaccccagtgacctcttctgggaatgcctcgctgggaatgcagctgagcctgtgtgggtgtggagagaaggtgcagatggcctccggttttctctttgcaggctgagaaagtgttcatggtggctcgagggcttgtccgagaggctcgggaggacttggaagttcaccaggccaagctgaaggaggtgagggaccgcttggaccgtgtctccagggaggacagtcagtacttggaactggctactctcgagcacaggatgctgcaggtaggcacctcaggaggcagccctttcgcacctggacagtgaccctagcctggcagatcatggaggggccgggtgggaaccctgactggtctgtagtcagaggcctggtacagaggtgagccagaagctcctatggatggacagaaccccaagcttccagagtctatccatatactttcttctggagtactggggccaactcttcagggcagcgtagcctgggactcagaatgctgaggaaggagaactatggaggggctggcctagggagtgctggacacttccctttgtgtagacataagtgcacctctggtcaaacccagaactgctcaggtgggacgatcatgcaactcactttgatcactcccaattcctttgcccttctgacccagccaggttggtgctaccttcattcattcagcatgggtctatggaacatgtactctgccaggcacaaggtagtgagccatctgctggtggctatagctgcagggccaccttgtgcccatgtaatccaataacatggctttgcttctgcaggaggagaagaggcttcgcacagcctatctgcgtgcagaagactctgagcgagagaagttctccctcttctctgcagctgtgcgggaaagtcatgagaaggagcgcacaagggctgagaggaccaagaactggtccctcattggctcagtcctgggggccctgattggtgtggctggctccacctatgtgaaccgtgtgcgactacaggagctgaaggctttactcctggaggcgcagaaggggcctgtgagtctccaagaggccattcgagaacaggcgtctagctactcccgccagcagagggacctccacaatctcatggtggacttgaggggcctggtacatgctgctgggccagggcaggactctgggtcacaggcaggtagtcccccgaccagagacagagatgtagatgtcctttcagctgccttgaaagagcagcttagtcattccaggcaagtccattcatgtctagaaggcttacgagagcagcttgatggcctagaaaagacttgtagccaaatggctggggtggttcagcttgtaaagtctgcagcacacccaggcctggtggaaccagcagacggggctatgcccagcttcttgctggagcaggggagcatgatcttggcactgtcagacacggagcagagactagaagcccaagtcaacaggaacaccatctatagcaccctggtcacctgtgtgacatttgtggccacactgcctgtgctctacatgctattcaaagccagctaacccctggcccctcctccagagggtctgaggcaatagctgtgaatgtggatttaagtagagaatcgtagcaatgaagcgagcctttgggggcatgtacaacctcaatctgaaggagcagtatctgtgtggctcaccagcaggcatgcttcgctttgtagacaaggttcatttacattaattatcaaaactttgtgctaatgtccaattaaaatatcctgagttttattattt

SEQ ID NO: 38436 - DNA, 6277 bp, Homo sapiens
agaagcagtcagcccagggctctcggatgcagggagcctgggcccaaacagcagcttccggagtcggaaggagctgaggaagaagactgactgaaggagcttgcgacttttccgcctcggcaaccggacccagcagcaagcaggacgggcggcgctctgctactggtcccgttaagccagagtagcccaagccctgaagtcactgctcatccggaatggaaatcccgccgaccaactacccagcctccagggcggccttggtggcacagaactacatcaactaccagcaggggaccccgcacagggtgtttgaggtgcagaaggtcaaacaagccagcatggaggtgagtttagcagggggtggtggacagcagaggcttcaggattgcgctccctccactcacccgcggtctcagcctttgggtgcagacactccgtgccaccccctacccaccttctgttttaggacacactgctggtatctggtcttgagatattaaggtttctgggggaatgtctatactccagtctctggagacagcccgggactgttttcaccttaaggcagagacaaagtttttacgcacacagttacaagaaaacgggaacacgctctaggtaaggggcagcactttccttaagtgtaaactgtagaaaccattcaaaagactactaaggctgccacgtttctcatctgctactctgatctggaccaacaaaagctcccatcttccaagactctattgcctacattttaagacaaatccttatcagaccctttgaccaaaatgaagggggaaacaaacagcaagagaaactgacaatcaaagtcaaagaataaaagcactgtgggctgacgctggcctttagccacccaaacaccgctaccacatgactgccttaaatgatgtgcaccctctgctaaaggcttgaattaaatgtttaaggcctcagcaatcactaacgaggtttgttttcattttacgaaaatctactggatttgagattatcccttatttatctgacagaattttaactgctaacagtcttttagaggtgacacagtagatcttattttgaaactgtaccagataacagaattaggtataaattttcaatctgtatcttgatttaaaagtgaaataccatttcttagtcttatataatttgttaatcattttgcagtttcactaatgtataagtaaaaacaatacttaattgtattaagtctccaattgctttgcagtaatctgcctcaaaatgaaattcacattcattgaacattatttggagggtacactgagctttatgaaaaaatcttttcaaaggtgatattgtcatctttagaattaaacgctgtttcaaactttcttatgtagagactttaagatcacagatccaggggttaaataaagtcttttgatgattgaaagtgaattgtgcccaatttgtatgcttttatcctactcttttgttttcatccaaaataaacttgataggggacttgctaaattagatgttacattcatggtgacatgcctttttcaagacctaaggctttcaccattccccttcagccagcccctccaaccaaatgagatgcatacttctaacaatgcaagtataatgttgttataatattttcttgtctccactacattttcttaattttaggatattccaggaagaggacataagtatcaccttaaatttgctgttgaagaaattatacaaaaagtaagttaaatttcttttttctttgagacagggtctcactctatcacccaggctgaagtgcagtggcagaacatggctcactgcagcctcaacttcccgggctcaggccatcttcccacctcagcctccccaaatagctgggaccacaggtgcatgccactacacctggctaatttttgtgatcctcctgcctctgcctcccaaagtgctaggattacaagcatgagctaccaagcccagccaaaatgttcttattaaacaaatttaattctaaatattccagatcatctttgctgatcaaatctgtaagattgattagttttacctctttttaaaaagttgttgtgaaatacctgcctctgaaaaacactgaccatatgggcaaagtttacaaggatcagttctttactatctttgggtattcctaggtatatgaattatttctaccaaactacacaaaaaaagactatacacttcagttcaaatgaatttcttaagaagttacatactcttagggcagtctgaacttatgcctaatataaatgagtgaagtaatttattccccaatcaatcatcttcttaacgtctgcttttctcattctatttttcactgggtttttagagaaagaacgtgctcttagatattcagaagcaatagaatgccagctgataccaccattcagatgaagatctttcagtaatggggaagggaaattttaaagattatacacaactgtcaaattattaatgagacaaacttaaaagaaaggaactgcaatctgtaccacagccatcttgaaattttaaaaagcttgcctttctgttgagcataattcataaagagattcattaaaaggcatctgagctgctagacagccatctttacaaagcataacccaatgccataatcttctaattttatatccagacacagactgctgcatctgcatttcaaaaactttgttatttcaggagcaaagagtaagagtaatggaaaaactttaaaagtaaccagtcttgagttggtatataaagtcagattaaaatctggccttgcaaatggacaccccattaatactgaaatatactgaaagttttaagactagaattcataagattatgacaccatatcatttataaagtaagttatctattttagggtattcacatgataagtctagaatttaataggccaggcccaattagatacctctgaaaacaagcactttgaagtctagtctaaaacaacaccattaggagcctatgctttaaatcatatctcaaagatgataattaataatgaatagccttctgtatataaggatattttgctaaatttcaaacagcaagttaaggtgaactgcacagctgaagtactttacccttcaacgggacaagaaactgcaccagaagtcaacttcacatttgaaggagaaactggaaagaatccagatgaagaagacaacacattttatcaaagacttaagtccatgaaggaaccgctagaagcacaaaatattccaggtatataaatatggcatgaaaaccatttgtttgattcaaacttaaaatcaatctcaattatctgtgcttaaaattgttagttgctaagtatgttagaaacttacaggcttttgcaaaaatactcatttctaatccaatccaacaaaaaagaggcctcagaaattttatagatccatagcttaattaaattattttttgcacaacattcgaaggaaactaagacatgatttagaatttagattttgttttaaaaggttaatactatatatatgattatcatataaatgtgtctcctaccagacaattttggaaatgtatctccagaaatgacgctcgttctacatttagcctgggttgcctgtggttatataatatggcaaaattctactgaagacacatggtataaaatggtaaaaattcaaactgtcaagcaagtggtaagtagtttctataaaatacactattaatggggttaatatttatcgaaagtattgtaattcataattggattaacagtattcctatagtcattttgtatttaatagcaaacctgggatttcaaaggggaggtcaggtacaatcaagattagagaaggtgaagaattgtaggaagagtccaaagcaacagtaactggtctaaaaagttgtttgatttggctgagagatgcaaaccacaggcctcctttgcctcaaacttgcctaataactgtgctttgttagttgcatgctctgggaacatagagactaggaagcataacaaaagcaaggcaaagccaaggatttcagtgaaacacttcctgttaatacacagtatctagactgcactttcaaaaagcatcacggtaatcatagctcttaatctttcgggttagtcaagtcagatttaactatgatactttcctcaaaccctcttctagaacaaaaaggttgagagagttttattagtagcagcaagacagaatcccaggtgtacaatatacagtcaggcctctccatgggttctgcatctatggatacaaacaaccgagaatcaaaaatatttgggggaaaaaaatggatggtagcatctgtactgaacatgcacagatttttttctcgtcatgattccctaagtaatataacaactatttatataacatttagattgtatttggtattataagtaatctagagatgatttaaagtatatgagaaggtatgcataggttatacgcaaatactacactgttttatgtcagagacttgggcatccgtgcattttggtatctgaggggaatcttggaaccaatcctccatggatactaagggacaattgtaatgactctcctcacctttaatctgctctatagagatcctcagggccactttttatggcagtcacaagcaaagctgtgctttcagaagagtgaagtcttgagttataatccaacatttagcttttgtgctcagcttaatacagattatttcccttagcaatctaagttttgtgttcaaattactatagtcatgccatactgaaactatctgttttttccctctactgtacagtacagaaaaaagctttaattacacaatcacacaactacactcactacattttactattctcaggtgttctggtttttttgtttgtttgcctgtttttgagacagggtttcactctgttgcccaggctggagtgcattagtgtgatcatggctcgctgcagcctcaatctcccaggctcaggcggtcctcccacctcagcctcccaggtggctgggagtacaggcacacacaggcatgcctggctaattttttgtttattctcatagagacatggtttcactgtgttgcccagactggtcttgaactcctaggctcaggcaagttgcctacctcagccccgcaaagtgctcggattataggtgtgagccactgtgctcggccttattttcagttttcaaaaagagaatttctgttataaaattggattctttcaatgtaaacacccattgctatagcttatcccataaattatgcttttctgtacaatggaaacacagagcattcttaaataacaagctacacttgctaattctcttaagtagccaccacaacttggaaactaaaaacaggtaaacatttcttggggaacaaatataagatcatgattttaaaatgcatcttgaaagaacactttatttagtgtaagagaatagattttgtcacattaaattgaaattatgacattcaatttttatttttacctaaatggaaatattatattcatctaatcaaagatgattttcaaaattaaatgtaatttttgccaaagatattaagttttaaacaacacgtttttattttttgtcatagcaaagaaatgatgactttattgaattagactacaccattctacttcataatatagcatctcaggtaaagtataatttacctttatttgatgccattctgaaaactgagactccttgtatagccacagtatgctttattaattttgactctaaatcagaattcatgtaaatccagataggcaccagatttaagtatattataattgcagcaatttaacaaaagtactattctttgtgaagactgttttatctctaacaaaacataaacccaactacgttttcctaaatgttttctgaattttatcatggcattaattttcttcacttgcaggagattattccctggcaaatgcaagttctctggcatccacaatacggcactaaagtaaaacataatagccgtctgccaaaggaagtacaactggaataaacaaaaaccctaacactggaagtgtaaacatgtctattgatgtgtatgccaatttcactggcatctagcttatgaggccaaataatcccaaagtgtcactttatataaatgtcttgattacagtatagaactttatagagtccataatacaaagtatcactacataaaaatgtctttaaaacagtaatagtggtatgtatatccaaaataaaaagcttcaatttcagcc

SEQ ID NO: 38437 - DNA, 20582 bp, Homo sapiens
ggctaatgcacagacatgaacatctattgaggaaaaccacaaaaaacttcaaaacagctacaacggtaggcttacttttcatatattattttaaatattgtttgttaaagtgcgactgactcatctaatagtcttaataaatgtaaaggccatctctggtttaagtttcagttacctcaattaatttttaagaagtacttatgtatatcatcgcataaatttaacatccacgcaggcaagaatagggtgctgcagaagtcacaaatccattatcttcttcattttcaacctctggatttttgacaaactggcatctataatgcagcatcagcaactcttgagtgattctgtttgaagttacttaagaaaaagtctgaaatgtgtacccaccagagaaaatccattgatgagcctaaaggaatcctttctattacattcctcaaagttctttgattaaagttcggtatttcctctagcctgcaatactattctttcagttttcttagcttaaattaaaaatacaatactattaactaaaaattatgatcacctattaaaattacaaaactaagaaaattaaaaacgtatggcttttcctatattctgtaccacctaaaggtgttaatgactacttttcataatgttaaatttaagttttaaaacttttcttggaacttgtttctgttcataccaatataaatcaagagttcttataaagtagctaagtggaaatatgatatttttaactcacatgagacaggatcttgggactttattttaactatttatactacaggtatcctaagaatatttcaattaaatattagtatgtctgctgaaggcacttaattattaagaaacttaaaattatcaatctttcttgaatttctgatagagaagtaaaactattttccaaaactatttttcagaatgttcactgatacataaaaactgctagcatctaattaaagatcactaagggttaaatactgttctctggcccttactgcgcacaccctgccaaaacatcctctaagcttttaaatattgcttcgatggtctgaatttttatttccagggaaaaagagagttttgtcccacagtcagcaggccactagtttattaacttccagtcaccttgatttttgctaaaatgaagactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggtactttatttctattctaaatttagcttctaaaatactgcccatttaaatgcatgtttttgcttttcctgaatgtgtctgataaggtaaggggaagggaaaatcactttaaatgattcaaacgaattcataataattgtccctaagattgtatttttagagtatgtatgctttccaaattaataaatggtatctatggtaaccaaacagtatctatagtaaccaaaaaataaaacttaaagaaaactagactttaagatgatccctcaccagttgcaatttatatattaagtaatgttacacaatgccctatacttgcaatgttgtgttgcctcaaaaataaattagcggaaatgtgtatttggagaaataaagatgaattatcagcttaaggttattattatagaaaacaatttgaagaaaatacatagaagagtactggttattttgatatcaatagcattccacaataatttatatatgccatctacatacagtaccaaaaactgaaaacctagtcaatataggactttctttttaaatcaattttaacagtttagaccctctatcaattggtaccaagtaactgtaactgtctttgagttaacactgcaagggtgacgttataccacatcattcattccccacctttatgggcaaactaattacttgtggttttcttggcacacagaaatgaatgctgggtaaggaaaaagttaatacagcacttaagtatctgttgcccactatgtatgacacatacacatacacactggaaaatgagaaattcagccaaatatataacaatactgattgtttcagaagttcttctccactataaattggaggataaagacttataagattgaccagttataattgctactttctcttttcttttttgcaggggtacacaatgagcaaatgttaacaccacagtttctttctttcagttaatgcttttaatatgatagcattatttttgcccatcactaagacacaaaggataggtattactaattatagcttcaagttaaagaaaaaaaagtcccatcataacataggctattggctcacttggatgatttgaatctattaagattccctgatccctaaagagtttagagattatttttctctctgcttcttctctttacagggctttagaagtttctctatcttaatataaatgcagggtctaagatatttgtggagtggagtagaattcaacaggacttgatgtgcaaacacagagtagagggaggaagttcaaccaccacacagatgggagaatgaaggtgaagggcagagtcaggagtcaagaccgagactaaaatggaacatgcttacaaaggacagaaagaataggacaccacataatacactgtaatctaatggcagaaaacgtactctccaagaacaggaaagacaggatctaaattgtatctactccaatttccccagaattaatggcctaccccagtggcccaagcagggtaggtaaggtaagctggaataaaagggatccaagagccagggcttaatggagggatataggtaattaaagggtcaccccaagaagagacctaaagaccttaattggtagtttatacttgtgacatggctggagctctagtcttactcaaaatggtagaatctgaatgagaaactcagttcagacaagacccctgaggaacagtttcacctcagaaaaactttcattccaattcagggaattctcacctagctttcatttggaatttcaggatgttcaacatttattaagcactgagtgtagctactggcgatataaaaataaaaacacccagttcttttactcaaggagctcatagtctagaataaaaacaagctaaaaaatacttattgtaatttaatagatgataaaatggaaatatgtatgaaagcctaatggagcacaaaggaaatgccactaattgtaactacgagaaggtgtctgtgatcccttcattttacagagaaacacagacttaatgaagctaggtaacaaacttttatttttccaataggaaaaagaaactgtgataatacccaatgagaaaagtcttcaattacaaaaagatgaggcaataacaccattacctcccaagaaagaaaatgatggtaagtatcatctaaatatttttcaaatggatcttttaaaaatagctataatggactttattccttgtggtaatcaaaaactgactcaagatacagtaaatacaaacagtggaattttatttccaatgataaactcaaactgggagtgcacaccatttgccatcccacattatgagtgagaaatgtggagcaagaacttgtgagaacaaccaaagcttaggcaagcttagcctccacaaagtgtggtttccatccatataaaatctattcgagaaatacttaaacacggattatttgcaaaatacaatgtgcagcctcagtatacggtaaatataattattgcctttaagaaacttacagaacagaaacacacatatacatcaataattacacatacatttcaattaaaatagaaaacttgtcatgaaataacaaattacaagtcctacttaataattcctgtgtacttggcttactcttactctatcacagaacattatttcacatgaaaacatgacaaaaaccacatattaatttctatatttctaaaataaaatgaaaatgaaccataacagaaaataaagcttaaaaagcgagaagtatgatagtaaaaatagatttgaataaatttaaagacatcccaggctgggcgtggtggctcacgcctgtaatcccagtactttgggaggctgaggcgggtggatcacgaggtcaggagttcaagaccagcctggtcaagatggtgaaaccctgtctctactaaaaatacaaaaaattagccaggcgtggtggcaggtgcctgtaatcccagctactcgggaagctgaggcagagaattgcttgaacctgggaggtggaggttgcggtgagccgaggtcgtgccattgtactccagcctaggcggcagagcaagactctgtctcaaaaaaaacaaaaacaaaaacaaaaaacaaaagacatcccttgttcttggatggaatgactcaaaatcataaagatgtcagttctttctaaatttataaatttaaaacaatccaactaaaattaccaataaatttttttataaagctggaaaaccagattctagaattcatatggaacaacatgtaacaaataacaagggaaacagtaaacagtaacaagtatatgtaggaatcagatgtactacacattaaaatatattataaaactctatactttaaaaagtgcgatactggtatatgaatagacaaaaagatcaatgaaatagaatagaaaatccagaaacagacaaaaatacacatgaaaattcagtacatactaaaggtaccaacctaaatcactgaagcaaaaatggtctttttaaaaaatggtgctgggagaaacagccatttgaagaggtgtacatttaggtccataccttacacaaaaaataaactccaaatagattagcaatctgaatgtataaaatgaaatcgtacaagtactagaaaagaatctgggtgcagggtgcctcaaaatccagagacaacaatagaacagaacaataaatttgaccctaaaaatacctgtggtaaagtcgaaggcaactaaaaactgggaaaaatatttgtaacatatactacagataaataatatcactagataaagagctcacagataatataactaaaaataaagatctagtaactctaatttataaagcactcttaaaaatcgaggaaaagagattaaccaaaaatccactggaaaaatgacagttcacaagatgatttaaatgatttaacccaaataagtgttcaatctcacacagagacatataaattaaaattacattgagataccatttttaacctatctgattgaaaaaaattgaagtatgacaacacattaatatattccatgagcaagggctatggggtaagacactcatacacggcagcaggaaggcaaatcaacacaatgcttttggacaggaacttggcaatatctaacaaaataaaaaatgcatttactttttgacataagaaccaactttgaggatttttttttttttttgagacagagtctcgctctcagactggtgtgcagcagtacaatcttggctcactgcaacctccgccatttgggctcaagcaattctcctgcttcagcctccgagtagctgggattacaggcacgcgccaccacgccaggctaatttattgtatttttagtagagacaggtttcaccatgttggtcaggctggtcttgaactcctgacctcaagtgcctcagcctcccaaagtgctggtattacaggcgtgagccaccactcccggccaactttgagaaatttaccttgatgatatactccaaaataaaatacaaatgcaaaatcactaaagcattgcatgcaattgcaaaatatcagaaataatttaactgcccaaacactgaagagtagttgaataaacaatggtaaatccaacagaagagaatactatgcagttgtaaaaatgaatgaggaagatctctaagaactaacatggagtgatttccaggatacactatgtggaaaaaaaaaacaaagtgcaaaagaatatctataatatgctgtctttcatgtaagaaagaaaaggatataagaaaatatatatgtatctgcttgtttctgtgaaaataaatacaggctaaaaagaaattgggggagaggggatggcagttctctgcgtatatactttttaatgtagatttaatttttagaacaatgctgtttcgtatagtcaaaaaaccaaatacgtatataaatgaaatcaacaagaataaggtaaaaagaacccaaattggaatacaaacataaaaacataaacttgattgtgcttcaaattaataactcagcaaaggaagaaaaaactctaagtaactgttaaacacagcattttcctatataccttcaggctaaggacaaaaaagaactataaacaaatatgaagttccagtgagtaggtttgttatgcacagtgttatgagttagcaatactggaactacttaatatgtgtgccagaactaagtaaatatacgtaaataatgagagccaggttccgcactgtcagagaaacattacaaatacggaaaggtggaaggctagaaagaacactgtggagttggtttggaatagaagatactactattaactcagggtttgtatatacagagatacagaaatatagaaatgtttctctctgtttatctctatgtgtgtgtatgtatacatgagtatatggtatacatatgcatgtatattgtatatgtttatatccgtatatgttgcatgtatgtgtattatctgtggagaaagagacaaataaacacacacatttatttcctagctctctctgctgaaagagcctagaagcaacgtgatctcaatggcaatgagcacacccagcacctgcatcttggtttctaataccattctccactaaaagaaaccaatgctggccgggtgtggtggctcatgcctgtaatatcagcactctgggaggccaaggcgggtggaccacctgaagttaggaatttgagacaagcctggccaacatggtgaaaccccgtctctactaaaaatacaaaaaaaattagctgggcatggtggcacatgtctgtaatcccagctactcgggaggctgaggtgggagcatcacttggactcaggaggcagagctgcagtgagacgagatggcaccactgcactccagcctgggtgacagggcgagactctgtcttaaaaacaaatgaacaaaccaaaaaaacccccagtgctttctgaagagatagctgatttcagggttggggcaggaaaaatgcaaggttagtttgggacatcttgctatgttaggaaataaggaagttctcaaagaataatggtgtttttttgtttgtttgtttgtttttttagacagggtctcgctctattacccatgctggagtatagtggcatgatcatggctcactgcagtcttgacctcctgggctccagcaatcctcctgcctcagcctcccaagtagctgggactacaggaacgtgccaccacacctggctaatttttgtatttttttgtagagatgaggtttcatcatgttgcccaggttggtctcaaactcctagactcaaatgatccacctgcctcagcctctaaaagtgccaagattacatatatgagccattgcacccagtctcctgacaaaatgtttttaaatccatcaaaatatataaaagaaatagatataaaagatgtttatgggaaggccgaggcaagaggactgcttgacctcaggagtttgagaccagcttgggcaacatagtgacaccatgtctctacaaaaaatttaaccaagaaaaagccaggtgtggtggcacaaacctgtagtcccagttacttgagaggctgaggcaggaggatcgcttgagcccaggaggtcgaggtttgcagtgaaccatgatcatgcgactgtaccccaccctgagtgacagcatgagatcttgtctcaaaaaaaaaaaaataaaggtatgtaaggcctgtacactgaaatctaaataacgctgctaagagaaaataaagaagacctatatataaggagaaatgtattatgttcgaggtctagaagattcaatatcattaagatgtcagttttccccaaatttagagattcaacacaatcccaatcaaaatcctaataggttttttttttgtttaattaacaagctgattctaaaatatatataaaaatataaaggacctagaatagtctaacaacattgaagaagaacaaagttgcaggatttatactaacaagactgttacaaaggtacaggaatcaagacactgcagtattggcataaaaatgttaaagtgggtcaccagaacaaaataaaatccagaaacaggctaacatgaagtaaccaactagttcttgacaatgtgacaatacaattcaatggggaaagaataatccttttaaaaaacggtgctgaaagaaccagacaactgtaggaaaatttttcaaaaaagaattaacccttcctggcaccatatataaaaattagcccaaagtataccccacacctaaaggtaaagatcttaaactatacaacttctagaagaaaacaaagtgtcaaatcttggtggtcggcaaacattacttaaatacaacacagaaaccatgaattatcaaggaaccaactgttcttcattaaaatttaaaatgtttcatttccaaaaggaaaactagtaagagggaaaaaaaaaaagacaagtcatcaaatatatggatgccaaacaagcacatgaaaagatgctaacatcattagttatcagagaatacaaattaaaacacaatgagatactataacatgccctacatttcaattgctaaaattaaaaagactgaccataccaaatgttggcaaggatgtggagcagctggaactctcatatgctgctggtaggaatgtaaaatggcacagtcctttggaaaatagtttgacactttcttcaaaagataaaacatacatttataaaaagacccagccattccactccttaggtacttacccaagagaaatgaaagcattaagtccacacaaacttacacataaatttctttgaaatagtgaaaacctggaaacaacccaatgtccatatgaaatgaccatgtaaattgtatatattgagacaattgaatactactgagtaataaagaagaatgaactactgataaagattgaaaatcaaaataataatgctgagtaaaagaagccagaaaaggaagtagatactccatgattcttttaatataaaattctcctaaatgcaaactaatgtatactgaccaaaagcaggtcagtcattgctcgaggacaagagtgggagggagagattaccaaagggcaggagaaaactttttggagtgacaggtatgttaattaactcacttgtagtgaacgtttcatgggggtgtacatatgtaaaaatcgtatatgttgtacgatttaaatacacgcaattaattgtaagtcagctaaccacaaaaagctgtagcaggaaaaaaaagcttgaaagggcctaatctgtgacaatttgactattaaaataaacacagattatgacttatgggacacaattcatattgatatgaaaatatcaattaaaatttcaaaaaataggccgggcgtggtggctcacacctgtaatcctagcactttgggaggctgaggcgggcagatcacctgaggtcaggagttcgaaagcagcctggccaacatggtgaaacccagtctctactaaaaatacaaaaaaattagccggacatggtggcacatgcctgtaatcccggatacttgggaggctgaggcaggagaattgcttgaacccgggaggcggagactgcagtgagccgagatcacaccactgcactccaacctgggtgacgaagcgagacttcatctcaaaaaaaagaaaaaaaattcaaaaaataaaatttgacatgtttatttgatatatttaaaatatatcaaaataggtcaggtgtgatggctcacgtctgtaatcccggcactttgggagaccgaggcaggcagatcacttgaggtcatgttcgagaccagcctggccaacatggtgaaaccttgtctatactaaaaattcaaaaaaaaaaaaaaaatagccatgtgtggtggcatacgccagtaatcccagctactcaggaggctgaggcagaagaatcgcttgaaatggggaggtggaggttgcaatgagccaagatcacaccaccacactccagcatgagcaacagggcaagactctgtctcaaaaataagtaagtaaataaaataataaaatatatcaaaatatataaaacaagttcatattgatataaaaataagaagagagtgccaactaacaaatgtagaaggaatgatggaattagaaaatcactatttggttagtcacaaatgattcgggtaagaatcatcaatggatgctaaaactagtatatgaaagtacaatgtcacaccagacatttagattctcaaagtacttctccagaattacttgttatgaagtgaaaaatattaactttactcagtgagaaacatggcaaatactagttgaaccaagtgaccaaagatattatcaggaatgggataaacagatatcatgtgcttttggacacacagcactgacgatccatggtactcctgccaaaaatgagaaacctctgccaactgaaaggcattctgcagaataaatgccctgaaaaagaaaactaaacaaaaaaaaaagctctacacttttcaaaaacaggaaaaggtataaaaaacaaagactaaggaatgttccaagaggtatgacaagtaaatgtaataaatgacttggggtgctaaaggatccaaacagtgcctacgattactctaattttcaagttaatggcttccttacttaactagtggttactaaagtctagctactgtcaccaatctgaaatatgtttctcacacattaaacttaataagtcaagctcatgtttaccttaactcctgctttgtaaatttttttggttttcaaataaggaaatgtaactgtcaatcaattcagcatttaagcaatcaccagtaaaacaaaataaaaagagattctcaaacaatattctggtgaattatcaagcacaatataggtaacgagttaccatgactatctttcttatgattctgtaaaacatctcttcaaattagtaatagcattcataatagcaataattttactactagaggagaaatattttcaaacgattgttcatatttttatgattttattcccaatttagaaatgcccacgtgtctgctgtgtgtttgtttaagtggctctgtatactgtgaagaagttgacattgatgctgtaccacccttaccaaaggaatcagcctatctttacgcacgattcaacaaaattaaaaagctgactgccaaagattttgcagacatacgtaagttaagctgaaatatgatattagtattaactcgtattagtatttaactcatataaacacaagtttctatatagttgctgcctatcacattcaggtttgtcacttgaagtacataaatatctaacatgtttcacaaaagtccattcatttgttggtgaatcatctttccacttagacagatcctgtgatctttctttactggtgacttcactgtctatgatgacagcccatctaacatatgggcaactatatcttctcaactccaatacttcaagatcccttgcttcagacactgagcaacaccaatataactgggatgcttctccaaccacaatgttttattttctacctggactataaaaacacagaaagtgctttttcttactttaactaatggctcttaaacctggctgcatattaaaaatatcttgggaagtgttttttttttctcccccctccccccaacccgacatggagtcttgctctgttgcccaggctggagtagagtggcgtgatcttggctcactgcaacctctgtctcccaggtttaagtggctctcctgtctcagcctctcacgtagctgaggtgtgtgccaccacacctggctaatatttgtatttttagtagagatggggtttcaccatgttggccaggctggtctggaactcctgaccttgtgatccgcccgcctcggcctcccaaagtgctgggaatacaggcgtgagccaccatgcccggcagggaagtattttttaaatactgatactaggtcctacttcccaggggttgtaattcagatctggggtagggcccaagcaacatcattaaaaacaaacaaactccttggatgattctaatatggaaatactgttgagaacagtggtatttaattccttaccaggtcattatcaatcttgaacttctagcaaaccttaactcagttagtgttgccataagcacaccagaatcctccatttctgcagtaccaaatcccagtcctagatcactaatttcttgtcagttttctagactcctaatattgtcaagagttctgaaaaaaatcacaccgagaaatgcatactagccccgctacacatttatgagactaaccataaccaggttcatgctgccactgatagctcccaaatgtggattgaagtatagttgatccttgttatttgtggattccatatttgtgaatacccacttgctaaaatttatttataaccccaaaattaatacacattgtgctttcatgggctttctcagacatgctcagagtggcaaaaaatttgaattacttgacatgcacattcccatctgaggttgaacaaggtaacactgtcttctggttccagttctcatactgtaaataaatgccctgttcacagtctatttaacgacatgtttttcacatttttgtgctttgtgtttatgattttgctgtttattgatttttgttttttggggggtttttttgtttgagacagggtctcgctctgttgcccaggctgaagtgcagtggtgtgatctcagctcactgcagcctctgcctcctgggttcaagggattcttgtccctcagtctcgcaagtagctgagactacaggcatgtgccaccacacctggttacttgttttattgtaatttaatttaatttaatttatttattttttgagatggagtcttactctgttgcccaggctggagtgcagtggcaccatctcggctcactgctagctccgcctcccaggttcatgccattctcctgcctcagcttcccgagtagctgggactacaagtgctcgccaccacgcctggctaattttttttttttttttggtatttttagtagagatggggtttcaccgtgttagccaggatggtctcgatctcctgacctcatgatccgcccaccttggcctcccaaagtgctgggattacaggtgtgagccaccgcgcctggcctattataattttaatagagatgaggttgcgctgtgttggccaggctggtctcgaactcctgacctcaagtgatctgcccaccttggcctcccaaagtgctaggattacaggcataagccaccacacctggcctgattttgctgtttaacatgacccaacacatggtgctgaagtgacgtctaacatccccaagcacaaaaaggctgtgatatgcctacagggaaaatatgttagataaggtttgttcaggcatgagttatagtgcaatattaatgattcaacaatatatactcagccaagtgtccttaagcaaaaacacataaagttatatactaatagttgatggaaatgtgtggccagaggctcacaggaacataaccctgtatttctcctaggaataatggttcagtatttacaaattcaacacttgtggtaattttatagaacatgattcctgtgaataagaaacaattgatttcctaattatcccagatatacgtgatgcacacgcaagtacgcgcgcgcgcacacacacacacacacacacacactgaatttctctctcaatctgtgtcactttaacaaatcagggaacatctttgtctttgttgttgttaagcgataaggcatagagagattaagattaagataacatactcagaatcacaacgcaacatgccagcaaaaaaataaaaaaaattacatgattccaatcaaatgtaatgcttcctttccatgatttgcaacaagaatttctttcaaactgcctgaccatcccaaggaatttgaacagagaaagatgaaaagactcgattaactttaagatcactttcaaacctgagattctaggactccagtcagaaagggaatcaatttcaggcacaaagaggtgttcagtgatcattccacaaaactttactgggctatgaattgtaaacagtctaccaggcactaaaaatgaaagatgcttgagtgatctgttaaacaaatgcttttcttcagtccatacaataagaattttacttacgtagttgttttttatatttttttccctctagctaacttaagaagactcgattttacaggaaatttgatagaagatatagaagatggtactttttcaaaactttctctgttagaagaactttcacttgctgaaaatcaactactaaaacttccagttcttcctcccaagctcactttatttaatgcaaaatacaacaaaatcaagagtaggggaatcaaagcaaatgcattcaaagtaagtattttatagtaaaactaagcatagtatgagtgatgatatgatagataaaagagaaactttggtctagaattgtattttgattacacttaaaaactattttgatttaataaatgaagacattatttacataataaataaccatcctattaggctcattcagcctagcttatacccatatctcagttaaaatacataacctttattttatttcatgggactattttgtttctcattttttcacttgttcatacagcaaatatttatttagacagacatggttggccctctcatgacacttacagtctacgaaagctcaaaatgggatatttcctgtgtttctttttccttacaatgttagcaaattataaacaccagaaaaaaataaagatccaaaagtaaatactgaatttaacttttaatatttaaagatattagactgtgaaattctatagggagattttcctttgaatttcatgagagcatgtaatataaaattttatatgtagtaagaattaaatacatttcttaacaattcaagcaaatattatgtaggaaaaagggaaagtaatctacttcggtttaggtagacaatttgtctcaaaatgcatgacctacaggagtaatcactttagtccaggatttccatagctctgatgtaatcattccccagataaaatgatgaccatgccattgctggtaacagacataatctcattcaaaaggcaaggtttcttgcttctaaaggtaacttcagaaactatcaaatattcattatcataaagtttatgataatcacacacaggtaaattctgtcaaaaaatgtacaatctgttagaaagtgtacaaatagtccattttttcatttttcattacaattaaggtatctttattcaactttaagggacattttaaagttacatcagagctcatctgatgtttcttataaggaactcagaagttaagggactcttagaggactttttaaaagcagatacaccttttttttttttttttttgagatggagtcttgctctgtcacccaggctggagtgcagtggcgtgatcttggcttactgcaacctccgcctcccaggtttgagcaattctcctgcctcagcctcccaagtggctgggactacaggcacacaccaccacgcccggctaatttctacacttttagtagagatgggtgttggccaggctggtcttgaactcctgacctcaggtgatccgcccactttggcctcccaaagtgctaggattacaggcgtaagccaccgtgcctggcctttttttttttgttttaaagttgtaatttgaaaatattaatttgagttggtcactctttgaataacagacatgttaaagacctataaaagttgatcaggacaggttcagtggctcacgcctataatcccagcactttaggaggatgaggcaggcggatcacttgaggtcaggaggtcaggaccagcctggccaacatggtgaaactctgtctccactaaaaatacaaaaattagctaggcgtggtggtgggcgcctgtagtcccagctactcaggaggctgaggcacaagaattgcttgaacctgggaggcagaagttgcagtgaactgctgagattgtaccactgcactccagcctgggccacagagcaagattcagtctccaaaaaaaaaggagctgatcaacatttcacaaaaagaacatttgaatattctggggtttagacaggaattacagaagggatttatgacaagttggtatgaaaataataaacttggccaggcacggtggctcatgcctgtaatcctagcactttgggaggccaaggcgggcagattgcctgagctcaagagttcgagaccagcctgggcaacatggtgaaaccctgtctctactgaaatacaaaaaattagctgggcgtggtggtgggcacctgtcgtcccagctactcaggaggctgaggcaggagaattgctttaacctgggaggcggaggttgcagtgagctcagatcatgacactgcactacagcctgggcaacagagtgagactccatctctaaaaaaaaagaaaagaaaataataaattcagctgccctatagttttgtttaatgtcctaagctgctacagtcactagtagaattaggttattctacctcatgtaaatgagactcactgggaagacaagagcttgatgcccacatggtggaagggtagggtgcttaagaaagtattaaaatagcaacacagaaaagaattagcaaaatctaccacaggatacatattgaagataaggtaaaagagtaatgtcaggggaaattacaattatacacaataatgggttactgatcatgaagaataatccaacattaagcccttagggaaaaaacctgcatcaagctaactgtttgctaaactgctttgggaaacatcttgctaagaacacatttttttttttttttcttgagatggagtctcgttctgtggcccaggctggagtgcagtggcacaatctcggctcactgcaacctccaccccctgggttcaagcaattctcctgcctcactcaggctccctagtagctgggattacaggcatgtgctaccacaccagttaatttttgtatttttagtagaaatggggtttcaccatgttggccaggctggtctcgaactcctgacctcaagtgatccacccacattgacctctcaaagtactgggattacaggcgtgagccaccatgcccggctaagcacacacatttcttttttttttttttttttttttctttttgagacagagtctcgctctgttgcccaggctgtagtacagtggtgcgatctcagctcactgcaagctctgcctcctgggttcacagcattctcctgcctcagcctcccgagtagctgggactacaggcgcccaccaccacgcctgtctaattttttgtatttttttaggccgggcatggtggctcacacctgtaatcccagcactttgggaggctgaggcgggcagatcacgaggtcaggaaatcgataccataccagccaacatggtgaaacctcgtctctactaaaaacatacaagcacacacatttctaagaagtaaccacttagctagaaattggtggaactgagatgggaaactccagaggtacaggagaggttatggcagcaccagggtcaaaattcaatcccacatagggactcacctcattagttcctatcaagacaaacacaaagagtaccagaagttggcattagagccggatattcagagatcagatgaatggacagaagtgtggggtatgcggcagagctccactggccatcataaaggatcaaaatacactacacgtgaagtcagaaaaaaaacccaaacaagaaactaccatacgaacaattgatataattgatgtattcatatcaatatgcaagtctgtatatatagacatatactcatatgcacatatatattgcttgaatcctgtgaaagaatgtacagaacctcaataacactcacatgaaattttccttacagaaactgaataacctcaccttcctctacttggaccataatgccctggaatccgtgcctcttaatttaccagaaagtctacgtgtaattcatcttcaggtatgatagttcctttcacaatatctgactctaattacctatgagtcaaaatcttgtgactcattgggaacctcacttattcacatacaaattttggttagatcactgtagtagcgtgatagctaaatgtctgcctatcaaaaagattaatactaggctcatgaactttcttcccagaagtccagattccatccagagcataacaagtagaccagcacagtacgtgtgaagtctgctcttgattgtatttgtctccaggtgtacatttgagtatttcctaattaatttgacacaaggatttgaagtgagggggcactcagacctctgacttaggtttcctttacccattatatagcatatgaaaggttgatttcagatttctgaacaatgttttcctcgttttttttcagttcaacaacatagcttcaattacagatgacacattctgcaaggctaatgacaccagttacatccgggaccgcattgaagagatacgcctggagggcaatccaatcgtcctgggaaagcatccaaacagttttatttgcttaaaaagattaccgatagggtcatacttttaacctctattggtacaacatataaatgaaagtacacctacactaatagtctgtctcaacaatgagtaaaggaacttaagtattggtttaatattaaccttgtatctcattttgaaggaatttaatattttaagcaaggatgttcaaaatcttacatataataagtaaaaagtaagactgaatgtctacgttcgaaacaaagtaatatgaaaatatttaaacagcattacaaaatcctagtttatactagactaccatttaaaaatcatgtttttatataaatgcccaaatttgagatgcattattcctattactaatgatgtaagtacgaggataaatccaagaaactttcaactctttgcctttcctggcctttactggatcccaaaagcatttaaggtacatgttccaaaaactttgaaaagctaaatgtttcccatgatcgctcattcttcttttatgattcatacgttattccttataaagtaagaactttgttttcctcctatcaaggcagctattttattaaatttttcacttagtctgagaaatagcagatagtctcatatttaggaaaactttccaaataaaataaatgttattctctgataaagagctaatacagaaatgttcaagttattttactttctggtaatgtcttcagtaaaatattttctttatctaaatattaacattctaagtctaccaaaaaaagttttaaactcaagcaggccaaaaccaatatgcttataagaaataatgaaaagttcatccatttctgataaagttctctatggcaaagtctttcaaatacgagataactgcaaaatattttccttttatactacagaaatgagaatctcatcaataaattagttcaagcataagatgaaaacagaatattctgtggtgccagtgcacactaccttcccacccatacacatccatgttcactgtaacaaactgaatattcacaataaagcttctgagtaacactttctgattactcatgataaactgacatggctaactgcaagaattaaatcttctatctgagagtaataatttatgatgactcagtggtgccagagtaaagtttctaaaataacattcctctcacttgtaccccactaaaagtattagactacacattacattgaagttaaacacaaaattatcagtgttttagaaacatgagtccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaagaacacaattattattctaacaatgattattagctcattcacttattttgataactaatgatcacagctattatactactttctcgttattttgtgtgcatgcctcatttccctgacttaaacctcactgagagcgcaaaatgcagctttatactttttactttcaattgcctagcacaatagtgagtacatttgaattgaatatataataaatattgcaaaataaaatcc

SEQ ID NO: 38438 - DNA, 10189 bp, Homo sapiens
tcgctttgtgattcttgatccggaacttgtcacccaggaaccccggaagaggtagctcacgcgatagaaacgtgttcgctgcccagaagaagggaaggcgcgagtgaggaaaggaggtactgtaggtaggttggttggctccttacagggcgaaggagaccaatatcattattcattttctcgccagtaggaacgtttcttttcacctcgttgcattacccaccttcttcattttctcctttataaactgtcttccgcccaggggccgctgagccctctgttcctgttctgcgaaccgtcctttggaggaaaggaacaggctgctggggaggggaagactcagaatttctagttcccagcaaagcctccaggcaggcagtatcgatgcgctctctccgaaattgataaaatagcgagcaggcctcataccctcagctgggcacttatgaatatccccagcgtttcgagctgtcgagctctgcgtggaaagaattggtttctaagaatatagtcgaaaatttggggccgggcgcggtggctgacgcctgtaatcccagcactttgggaggctgatgtgggcggatcacctgaggtcagaagttcgagaccatcctggccaacatggcgaaaacccatctatactaaaaatacaaaaattagccggcgtggtggcgcgtgcctgtaatcccagctactcgggaggctgaggcaggagaatgacttgaactcgggaggcggaggttgcagtgagccgatatcgctccattgctctccagcctgggcgacagagtgagacttcgtctcagaaaaaaaaaaaaaagaaagaaaaaatttcccccctttttcacacaaagagattaactagagaggtattaatccttactgacataccccaggcaccatactagactctgggaatatgttatacagggaaagtggggcagtggcttaagggtcagagaagatttgggaaaggtttgtttgtttttttcggttgtaaactgcagacccggcgcggtggctcagcctgtaatccaacactttgggaggctgagacaggaggattgcttgagcccaggagtttgagaacagcctgggccacatagggggccacatagtgagaccctgtctcttaaaaaaagattaacgggtggagcatggtgcagaaggaggtaatgggatcaagagcactactgaaatgggtttactgaggcaggggaattagaaggcaccaagaagaagattttataggatgtacttattttgttctgctgtcattgcccagaattatttatgagacaaagaatggttatttgttttaccttagtcttaggcactaggcttattgatacgcttgtcgtaagtgtacagaaaaagagacagacatgttgttttagaggagttagatgataatctgatcagattaatatgagattagaacatcctaaagaacaaaaatatgtgttaattttagcatttttatgattagacactccattgagatatgggacataataaataaacttggtaacttttggaactttcactgtcctgtttttgatcttattgggtttttttttttttttggagacagggttttgcattgttgtccagcctggggtgcagtggcacgatcatggctcactgcaatttccacctcccagcctgaggtgtcctcctaccttatcccctgagtagctgggagtatgggcatgtggcaccacatctggctaattatttaaattttttgtaaagatgaggtctcactgggttgcccagattggttttgaactggactcgagatgctgctgcctcgacctcaagcaactccttgaggccaggagttccagaccagcctgggcaacatagcaagaccaagtccatacaaaaataaaaaatttttaaaaaatcaggagggtgtggtggcatgcacctgtagtcccatctacttggaaggctgaggtaggagaattgcttaagcccaggagtttgaggctgtagcgagctatgatcatgccactgaactctagcctgggtgacagagggagaccccttctctttaaaaaaaaataaagaaaaaggcaacttctctgtttgatcctcatatttctcatctttaaaatgaggctaatatatcttcctttttatgtgttcatagcaacaataaatgaggtaatggatataaaggatttagtatgttatccagcacataatagcttctctatgtagagcagttccttctccagatagtaccggaatgtagtgtatgggatatttggttactttgcagcctagaaattatttcagagaatcctaattgctgacattgcatatttgttcagtttggagtctggttgttagattatcaaagaaaagtcctgctgatatgtaagcatcaaatagaaacttggccaggcatggtggcccatgcctgtatcccagcactttgggaggctgaggcaggcagatcacttgaggtcaggagttcgagaccagcctggccaacatggtgaaaccccgtctctactaaaaatacaaaaattagccaggtgtggtggcgggtgcctgtaatcccatgtacgtgggaggctgaggcgggagaattgcttgaacccggaggcagaggttgcagtgagctgagatggcgccactgcactccagcctgggtgacaaagtgagatgccgtcttaagaaaaaaaaaagaattctctgtctttgtctcttttagggggtgggggctgtaaaggcactagaaccataaatactatgtctgtgcagccctgtcaccgtatttaggcacttgagtggaagagcactgaaactaggtgcactacagcttaccctatgtgaccctcctactcctggccactccatgtcagtctcctttgattcctaatgttcatttcctcaggattatgttttagtcctttcttcattctacatatttgtccaagtggcctcatactcttccatctcttcagtaacttcaattatatggtaaggtctctcaaatctatatttccagcccagacctttctgactttaaactgatatatcctagacctttctgtcctttaagctgatatatccttttttttcttctttctagatatctctgagatgtcttttgttcagaacaaaactaattcattatcttttccattcaaacctggtatttcaccaaaattctccatttgttcaaatctagctgtcattattaacttctccctttcttttgccaccagacttcctgtcagtcactaaatcagacaggtgtaccttagacactttttttatttctcattcccactactgttgtctaaatgaccatcatctcatctagactgctgggagaggcctgatatagtaatgttaagaacaagggctcggcagggcatggtggctcacgcctgcaatcccagcactttgggaggtcgaggtgggtggatcacctgaggtcaggagctcgagactagcctggccaacatggtgaaaccccatctctactaaaaatacaaaaattagccgggtgtggtagcacatgcctgaagtcccacctacttgggaggctgaggcaggagaagcacttgaaccccagaggtggaggttgcagtgaaccaagattgcaccactgcactccagcctggcaatagagtgagactccgtctccaaaaaaaagaacaagggctcggcagggcatggtggctcacgcccgtaatcccagcactttgggaggccgaggtggctggatcacctgagatcaggagtttgagaccagcctggccaacctggtgaaaccccgtctctactaaaaatacaaacaattagctcggtgtagtggcgggtgtctgtaatcccagctatttgggaggctgaggcaggagaatcacttgaacccaggaggcagaggttgcagtgagccgagattgtgccattgcactccagcatgggagacaagaacaagactctgtctcaaaaagaaaaaagaacaagggctctggattaagacgaccacttatgagctgggtgaatttaggcaagctataacttgtgtacctcatttttctacatccgaaaaatggggatcataattatatatagatgcttctcaacttagggtggggttatatcctgataaacccatcataaattgaaagtaccataaattgagagccaggcacagtggctcatgcctgtaaatgtagctacatgggaggctgaggtgggagggatcatatgaggcccagagttcgagaccagcctgggcaacataatgaaacccctgtgtcttaaaaaaaaaagtttttttttaaattagcagtgtgtggtggtatgtgcttgtagtcccagctactggggaggttgaagtgggaggattgcttgagctcaggagttcgaggctgcagtgagctatgatcactccactgtattccagcctggacaaaagagtgaaaccctgtctcttagaaaaggaaatagaagttggaaataaatttaatacacctaacctaccaaacatggtagtttagcctagcctaccttaaaggtgctcagaacacttaatttattagcgtacaatagggcaaaatcatctaacataaggcctacaagtgttgaatatctcatgtaattcgttgaatactgtactgaaggtgaaaaacagaatgtttgtatgggtaaagtttctactgaatatgtgttgcttttgaaccattgtaaagccaaaaagcttaagcgaaactacagtaagtccatgaccagctctatttaccttgaagtgctgttaggcacattaaagaagacaattcctatagagtgtttagccagtgtgtagcagaacacttcataaatgttaactattactacattatagcagcctctgaaatgatctccctgtatctattgccaactgctagtcaaggctcaggtatcttttagaacaggcgtccctgtggcctgttaggaactgggccgcacagcaggaggtgagtggtgggcaactgagtgaagttttatctgtatttgcagccactccccatcgctaacattacctcctgagctccgtctaattagcgacagcattagattctcatgcgagtgtgaaccctgttatgaactgcccatgcgagggatctgtgttgtgtacttcttatgagaatctaatgtctgatgatctgttactgcctcccatctcacccccgatgggactgtcaaacacctttttataacatttaccagtcttgcaattatttgtcttcactacttatctatgaacagctgacagtggcccatattcatcactatatcctcagcttaacagggtgtatggctggcacatagatagccagtaaacatttgttttattgaacttaacttctcttggtctgaatttcttcatttttgatatggcagtaatcctcacttctcagtggatcaaataacaatacatgtcaaagtattgtggaaattttgagctataaagacaaagttttggccgagcacagtggctcacacctgtaatcccagcactttgggaggccgaggtgggcggatcacgaggtcaggagattgagaccatcctggctaacacggtgaaaccctgtctctactaaaaatacaaaaaaaaaaaaaaaaaattagccgggtgtgatggtgggtgcctgtagggaggctgaggcaggagaatggcatgaacccgggaggcggagctggcagtgagctgagatcgcgccactgcatgctagcctgggcgacagagcgagactccatctcaaatagacaaacaaacaaacaaaaaaaccccaaagttttaaaacagcatgaaagaaattcaaaattaggattggaccatttcaaaaccattgctaaaatgtaagcttcattagagaaaggactttttctgctttgtgcactcctgtatcccttagattctagaacagggtcaatcagtatttgtggaagggaagcagtatatcataaaactaaaagaattgaaaaagtagaaagtagtcacacttctatttcagatacccattcctatagctatgttctttgtaattgttcgtctccaaaatcaaaaccctatgcatcgctctaagtctttccagtttactttcattacacctgttcttcaacagcatgtctagataaatagcatgcatcactttattgtccataaatcagtctttgataatacaggttgctttttatcaggtaggccaaaagagaaaaatgtaataacacaggttgcatggtctatcatgtcaaacattcttacccttatcctaaattcccttgtaccactgtgtcttggggcgtgctcctggcataatttaaacttggatacatccaactaccatttcagtaggaggggagagcaaaggatgagtgtggatggaggttagtttgtatgtctggaggaagtgattagtagttttagtcttttggcttctaagtactactggagaaaatcacaaatagtatgttgccattaaaaagtcatcattaatcttaaccatgctttcaatattcctctgcaatcctgccatattttgccacaccttttatttccgcctttctcttctctactccattttaacttctgtctgagctccttccctcagggggaatactttcctgccttcaaatccgtggacctacttgatttaaaactgaaattgggaaaggtgtcccttttcctttccaaaaccacatccctttataaagtctttctctatcttgagcatttacctgcctttcttctggcttcatcctattaacatttaaatatgcttatcctttcttcttaggagaaaaaaaaaattgctttcctctgtgtcgccttatatccattgctttttctttttgctctatctcttgaccccacctcaaacgaatttctgccccaccaaagacagtaaccccttttatgttaaaattagtggaaagaatgttaatataatgccctaactttaaagaagaacataaaggaaatttataagtacttccagggctgtcatctatgccgtgccaatcatgcagtgcacaattccaagggcaccactttacattacaaatacagtgcattacaaatatagtggccccatgtttataaatgcttagataatactccactagaaaaagaaactgatagttgcttgccacatagaagcactgtgaatccagcagcctcatttgtagactgatataagtgtcttattggtgactcaaatattatgaacagctttgccgaagtagcaagattttctaaaataataaaggatgacattcctttgttttatgatagctacacttctggaaaattcagtatggacagtctccgacttaggatttttcaactttaggatggtgtgaaagagacacccattcagtagaaactgtacttcgagttttgcattttgatcttttcctggcctagtgataatgtggtacagtacactcttgtgatgctgggcagcggcagcgagccacagctcccagtcacccatgtgatcacgggaatcaacaacccatcctctaccgtgtactgtgttgtcagcttttttggatattgtgttttgtgttttcacattccatcatgtctacaaaatgtccatcagtgtctcctgtttctggtgagatgaagaagaggaaggcaattactcttgaaatgaaactcaagataattgcccagcatgaaggtggcaagccagtaatggccattgcacgtgagttaggactttggcaatccacgatttcaaccatcttaagggataagaagcaaatcagtgatgcagcgaaatcgtcagcatcagttaaatccactgtcatcacaaagaaaagggctggaccaattgatgatatggaaaaattacttgttatgtggatggaagaccagatacagaagcgtataccacttagcctactgatgatccaggctaaggcaagaagtctttttaatatgctaaaagaccgtgccagtgatcctacatatacacaaatgtttaaagcaagtcatggatggttccagcgcttcaaaaggcgtcataattttcacaatgtaaagatcactggtgaggcagcacgtgctggtaatgaaggtgccatagcttttaaggaacagctgcataggataattatggctaaagatctttgcaataaggagctgattgcactggaggaagaaagaggtaaaggcgttgaggcagtggaagaagttacacccacggcacctagaaagttcacagcaaagaaactggcagaggcatttgctgctatcagcagtggcctacacgttagaagaaatggacgtcaattacgagagattcgccacagttgacaggcgcagatacaggatgctcttgcttgctacagagaaatatatagtgaaaagaagaaacaagctgtacggtcaaaacttggtatcttcctgaagaacaacactatgcttgctaaaccatcaactagtgttgatgtcccaatgccttctaccacctattctcgatgttcatcagaagagagagaaattgaggaccctgttgcatccccatcatccagcaattaattctatttcagtgcttcaaacatttttcaggaccactgtgctttcagctgtgtaaattaatggtgagtacccatacaaccattgttttccacttacagtattcaataaattacaggagatattcaacactattataaaagagcctcgtgttagatgatttttgtccaactgtaggctaatgtaagtgttctgagcacatttaaggtaggctaggctaagtcatgatattctgtaggtgtattaaatgcatttttggcttacagtattttcaattaattgggttaattgggatataaccccatggaaaattgaggagcacctgtacatagtaaaactatgcaaaaaatattttgtgttcttaagtaaaatgatgttgagttctcatctcagttattaagtttttcagctgcactcacgtccaatgggacaactcttcattttgtaaggtttttagcatccttgctcaggcttagtaaatttcagtagtgcacctcactccaggcccattaatgtgacagtgaggttcttctgagggtaactgatttgataccatctccactgagaaccactgcattgtgaaaacaccgattagcactgtattccaggaaagggttatttttggtttctttaaatcttaggcatcttggtaaaacggaacatctccacaagactaagggaagactgaggaatagagtttttgaactttatgcaacttcgtttacatcaagattcaaaatgacctaaactgtttcatgtggatgcttgaatcttttctagtacactggtggtgggcaagagggtgttggaaacagggtgcaggcataagatcaaaggtgtgttttgccttttttctggatgaccattaagtgtatagtcaaaatgtttctctgataagcctatacctctgtaagttgttactgccggatagtgataactgttttcctttcctttaagatgccctccaaatccttggttatggaatatttggctcatcccagtacactcggcttggctgttggagttgcttgtggcatgtgcctgggctggagccttcgagtatgctttgggatgctccccaaaagcaagacgagcaagacacacacagatactgaaagtgaagcaagcatcttgggagacagcggggagtacaagatgattcttgtggttcgaaatgacttaaagatgggaaaagggaaagtggctgcccagtgctctcatgctgctgtttcagcctacaagcagattcaaagaagaaatcctgaaatgctcaaacaatgggaatactgtggccagcccaaggtggtggtcaaagctcctgatgaagaaaccctgattgcattattggcccatgcaaaaatgctgggactgactgtaagtttaattcaagatgctggacgtactcagattgcaccaggctctcaaactgtcctagggattgggccaggaccagcagacctaattgacaaagtcactggtcacctaaaactttactaggtggactttgatatgacaacaacccctccatcacaagtgtttgaagcctgtcagattctaacaacaaaagctgaatttcttcacccaacttaaatgttcttgagatgaaaataaaacctattcccatgttct
